United States Patent
Edwards et al.

(10) Patent No.: US 6,639,063 B1
(45) Date of Patent: Oct. 28, 2003

(54) EST'S AND ENCODED HUMAN PROTEINS

(75) Inventors: Jean-Baptiste Dumas Milne Edwards, Paris (FR); Severin Jobert, Paris (FR); Jean-Yves Giordano, Paris (FR)

(73) Assignee: Genset S.A. (FR)

( * ) Notice: Subject to any disclaimer, the term of this patent is extended or adjusted under 35 U.S.C. 154(b) by 0 days.

(21) Appl. No.: 09/621,976

(22) Filed: Jul. 21, 2000

Related U.S. Application Data

(60) Provisional application No. 60/147,499, filed on Aug. 5, 1999.

(51) Int. Cl.[7] .................. C07H 21/04; C07K 14/435
(52) U.S. Cl. .................. 536/23.5; 536/24.1; 530/300
(58) Field of Search ............... 536/23.5, 24.1, 536/24.2, 24.3, 24.31; 530/300

(56) References Cited

FOREIGN PATENT DOCUMENTS

| WO | WO 96/34981 A2 | 11/1996 |
| WO | WO 99/47540 A1 | 9/1999 |
| WO | WO 99/53051 A2 | 10/1999 |

OTHER PUBLICATIONS

Mark D. Adams, et al..; "3,400 New Expressed Sequence Tags Identify Diversity of Transcripts in Human Brain"; Nature, Genetics, US, New York, NY, vol. 4, Jul. 1993; pp. 256–267.

Mark D. Adams, et al.; "Rapid CDNA Sequencing (Expressed Sequence Tags) from a Directionally Cloned Human Infant Brain CDNA Library"; Nature Genetics, US, New York, NY, vol. 4, Aug. 1, 1993, pp. 373–380.

Kei Tashiro, et al.; "Signal Sequence Trap: A Cloning Strategy for Secreted Proteins and Type 1 Membrane Proteins"; Science, vol. 261, Jul. 30, 1993, pp. 600–603.

Piero Carninci, et al.; "High–Efficiency Full–Length CDNA Cloning by Biotinylated Cap Trapper"; Genomics. US, Academic Press, San Diego, vol. 37, No. 3, Nov. 1, 1996, pp. 327–336.

Seisho Kato, et al.; "Construction of a Human Full–Length CDNA Bank"; Gene, Elsevier Biomedical Press., Amsterdam, NL, vol. 150, 1994, pp. 243–250.

*Primary Examiner*—Michael P. Woodward
*Assistant Examiner*—Marjorie A. Moran
(74) *Attorney, Agent, or Firm*—Saliwanchik, Lloyd & Saliwanchik

(57) ABSTRACT

The sequences of 5' ESTs and consensus contigated 5' ESTs derived from mRNAs encoding secreted proteins are disclosed. The 5' ESTs and consensus contigated 5' ESTs may be used to obtain cDNAs and genomic DNAs corresponding to the 5' ESTs and consensus contigated 5' ESTs. The 5' ESTs and consensus contigated 5' ESTs may also be used in diagnostic, forensic, gene therapy, and chromosome mapping procedures. Upstream regulatory sequences may also be obtained using the 5' ESTs and consensus contigated ESTs. The 5' ESTs and consensus contigated 5' ESTs may also be used to design expression vectors and secretion vectors.

20 Claims, 10 Drawing Sheets

| Minimum signal peptide score | false positive rate | false negative rate | proba(0.1) | proba(0.2) |
|---|---|---|---|---|
| 3.5 | 0.121 | 0.036 | 0.467 | 0.664 |
| 4 | 0.096 | 0.06 | 0.519 | 0.708 |
| 4.5 | 0.078 | 0.079 | 0.565 | 0.745 |
| 5 | 0.062 | 0.098 | 0.615 | 0.782 |
| 5.5 | 0.05 | 0.127 | 0.659 | 0.813 |
| 6 | 0.04 | 0.163 | 0.694 | 0.836 |
| 6.5 | 0.033 | 0.202 | 0.725 | 0.855 |
| 7 | 0.025 | 0.248 | 0.763 | 0.878 |
| 7.5 | 0.021 | 0.304 | 0.78 | 0.889 |
| 8 | 0.015 | 0.368 | 0.816 | 0.909 |
| 8.5 | 0.012 | 0.418 | 0.836 | 0.92 |
| 9 | 0.009 | 0.512 | 0.856 | 0.93 |
| 9.5 | 0.007 | 0.581 | 0.863 | 0.934 |
| 10 | 0.006 | 0.679 | 0.835 | 0.919 |

Figure 2

Description of Transcription Factor Binding Sites Present on Promoters Isolated From SignalTag Sequences

Promoter sequence P13H2 (546 bp):

| Matrix | Position | Orientation | Score | Length | Sequence |
|---|---|---|---|---|---|
| CMYB_01 | -502 | + | 0.983 | 9 | TGTCAGTTG |
| MYOD_Q6 | -501 | - | 0.961 | 10 | CCCAACTGAC |
| S8_01 | -444 | - | 0.960 | 11 | AATAGAATTAG |
| S8_01 | -425 | + | 0.966 | 11 | AACTAAATTAG |
| DELTAEF1_01 | -390 | - | 0.960 | 11 | GCACACCTCAG |
| GATA_C | -364 | - | 0.964 | 11 | AGATAAATCCA |
| CMYB_01 | -349 | + | 0.958 | 9 | CTTCAGTTG |
| GATA1_02 | -343 | + | 0.959 | 14 | TTGTAGATAGGACA |
| GATA_C | -339 | + | 0.953 | 11 | AGATAGGACAT |
| TAL1ALPHAE47_01 | -235 | + | 0.973 | 16 | CATAACAGATGGTAAG |
| TAL1BETAE47_01 | -235 | + | 0.983 | 16 | CATAACAGATGGTAAG |
| TAL1BETAITF2_01 | -235 | + | 0.978 | 16 | CATAACAGATGGTAAG |
| MYOD_Q6 | -232 | - | 0.954 | 10 | ACCATCTGTT |
| GATA1_04 | -217 | - | 0.953 | 13 | TCAAGATAAAGTA |
| IK1_01 | -126 | + | 0.963 | 13 | AGTTGGGAATTCC |
| IK2_01 | -126 | + | 0.985 | 12 | AGTTGGGAATTC |
| CREL_01 | -123 | + | 0.962 | 10 | TGGGAATTCC |
| GATA1_02 | -96 | + | 0.950 | 14 | TCAGTGATATGGCA |
| SRY_02 | -41 | - | 0.951 | 12 | TAAAACAAAACA |
| E2F_02 | -33 | + | 0.957 | 8 | TTTAGCGC |
| MZF1_01 | -5 | - | 0.975 | 8 | TGAGGGGA |

Promoter sequence P15B4 (861bp):

| Matrix | Position | Orientation | Score | Length | Sequence |
|---|---|---|---|---|---|
| NFY_Q6 | -748 | - | 0.956 | 11 | GGACCAATCAT |
| MZF1_01 | -738 | + | 0.962 | 8 | CCTGGGGA |
| CMYB_01 | -684 | + | 0.994 | 9 | TGACCGTTG |
| VMYB_02 | -682 | - | 0.985 | 9 | TCCAACGGT |
| STAT_01 | -673 | + | 0.968 | 9 | TTCCTGGAA |
| STAT_01 | -673 | - | 0.951 | 9 | TTCCAGGAA |
| MZF1_01 | -556 | - | 0.956 | 8 | TTGGGGGA |
| IK2_01 | -451 | + | 0.965 | 12 | GAATGGGATTTC |
| MZF1_01 | -424 | + | 0.986 | 8 | AGAGGGGA |
| SRY_02 | -398 | - | 0.955 | 12 | GAAAACAAAACA |
| MZF1_01 | -216 | + | 0.960 | 8 | GAAGGGGA |
| MYOD_Q6 | -190 | + | 0.981 | 10 | AGCATCTGCC |
| DELTAEF1_01 | -176 | + | 0.958 | 11 | TCCCACCTTCC |
| S8_01 | 5 | - | 0.992 | 11 | GAGGCAATTAT |
| MZF1_01 | 16 | - | 0.986 | 8 | AGAGGGGA |

Promoter sequence P29B6 (555 bp):

| Matrix | Position | Orientation | Score | Length | Sequence |
|---|---|---|---|---|---|
| ARNT_01 | -311 | + | 0.964 | 16 | GGACTCACGTGCTGCT |
| NMYC_01 | -309 | + | 0.965 | 12 | ACTCACGTGCTG |
| USF_01 | -309 | + | 0.985 | 12 | ACTCACGTGCTG |
| USF_01 | -309 | - | 0.985 | 12 | CAGCACGTGAGT |
| NMYC_01 | -309 | - | 0.956 | 12 | CAGCACGTGAGT |
| MYCMAX_02 | -309 | - | 0.972 | 12 | CAGCACGTGAGT |
| USF_C | -307 | + | 0.997 | 8 | TCACGTGC |
| USF_C | -307 | - | 0.991 | 8 | GCACGTGA |
| MZF1_01 | -292 | - | 0.968 | 8 | CATGGGGA |
| ELK1_02 | -105 | + | 0.963 | 14 | CTCTCCGGAAGCCT |
| CETS1P54_01 | -102 | + | 0.974 | 10 | TCCGGAAGCC |
| AP1_Q4 | -42 | - | 0.963 | 11 | AGTGACTGAAC |
| AP1FJ_Q2 | -42 | - | 0.961 | 11 | AGTGACTGAAC |
| PADS_C | 45 | + | 1.000 | 9 | TGTGGTCTC |

Figure 5

| Step | Search characteristic | | | Selection Characteristics | | |
|---|---|---|---|---|---|---|
| | Program | Strand | Parameters | Identity (%) | Length (bp) | Comments |
| miscellanaeous | FASTA | both | - | 90 | 15 | |
| tRNA | FASTA | both | - | 80 | 60 | |
| rRNA | BLASTN | both | S=108 | 80 | 40 | |
| mtRNA | BLASTN | both | S=108 | 80 | 40 | |
| Procaryotic | BLASTN | both | S=144 | 90 | 40 | |
| Fungal | BLASTN | both | S=144 | 90 | 40 | |
| Alu | BLASTN | both | S=72, B=5 | 70 | 40 | max 5 matches, masking |
| L1 | BLASTN | both | S=72, B=5 | 70 | 40 | max 5 matches, masking |
| Repeats | BLASTN | both | S=72 | 70 | 40 | masking |
| PolyA | BLAST2N | top | W=6, S=10, E=1000, N=-12 | 90 | 10 | in the last 100 nucleotides |
| Polyadenylation signal | - | top | AATAAA allowing 1 mismatch | | | in the 50 nucleotides preceding the 5' end of the polA |
| Vertebrate | BLASTN then FASTA | both | | 90 then 70 | 30 | first BLASTN and then FASTA on matching sequences |
| ESTs | BLAST2N | both | - | 90 | 30 | |
| Geneseq | BLASTN | both | W=8, B=10 | 90 | 30 | |
| ORF | BLASTP | top | W=8, B=10 | - | - | on ORF proteins, max 10 matches |
| Proteins | BLASTX | top | E = 0.001 | 70 | 30 | |

Figure 10

EST'S AND ENCODED HUMAN PROTEINS

RELATED APPLICATIONS

This application claims benefit of U.S. Provisional Patent Application Ser. No. 60/147,499, filed Aug. 5, 1999, the disclosure of which is incorporated herein by reference in its entirety.

BACKGROUND OF THE INVENTION

The estimated 50,000–100,000 genes scattered along the human chromosomes offer tremendous promise for the understanding, diagnosis, and treatment of human diseases. In addition, probes capable of specifically hybridizing to loci distributed throughout the human genome find applications in the construction of high resolution chromosome maps and in the identification of individuals.

In the past, the characterization of even a single human gene was a painstaking process, requiring years of effort. Recent developments in the areas of cloning vectors, DNA sequencing, and computer technology have merged to greatly accelerate the rate at which human genes can be isolated, sequenced, mapped, and characterized.

Currently, two different approaches are being pursued for identifying and characterizing the genes distributed along the human genome. In one approach, large fragments of genomic DNA are isolated, cloned, and sequenced. Potential open reading frames in these genomic sequences are identified using bioinformatics software. However, this approach entails sequencing large stretches of human DNA which do not encode proteins in order to find the protein encoding sequences scattered throughout the genome. In addition to requiring extensive sequencing, the bioinformatics software may mischaracterize the genomic sequences obtained, i.e., labeling non-coding DNA as coding DNA and vice versa.

An alternative approach takes a more direct route to identifying and characterizing human genes. In this approach, complementary DNAs (cDNAs) are synthesized from isolated messenger RNAs (mRNAs) which encode human proteins. Using this approach, sequencing is only performed on DNA which is derived from protein coding portions of the genome. Often, only short stretches of the cDNAs are sequenced to obtain sequences called expressed sequence tags (ESTs). The ESTs may then be used to isolate or purify extended cDNAs which include sequences adjacent to the EST sequences. The extended cDNAs may contain all of the sequence of the EST which was used to obtain them or only a portion of the sequence of the EST which was used to obtain them. In addition, the extended cDNAs may contain the full coding sequence of the gene from which the EST was derived or, alternatively, the extended cDNAs may include portions of the coding sequence of the gene from which the EST was derived. It will be appreciated that there may be several extended cDNAs which include the EST sequence as a result of alternate splicing or the activity of alternative promoters. Alternatively, ESTs having partially overlapping sequences may be identified and contigs comprising the consensus sequences of the overlapping ESTs may be identified.

In the past, these short EST sequences were often obtained from oligo-dT primed cDNA libraries. Accordingly, they mainly corresponded to the 3' untranslated region of the mRNA. In part, the prevalence of EST sequences derived from the 3' end of the mRNA is a result of the fact that typical techniques for obtaining cDNAs, are not well suited for isolating cDNA sequences derived from the 5' ends of mRNAs (Adams et al., *Nature* 377:3–174, 1996, Hillier et al., *Genome Res.* 6:807–828, 1996).

In addition, in those reported instances where longer cDNA sequences have been obtained, the reported sequences typically correspond to coding sequences and do not include the full 5' untranslated region (5' UTR) of the mRNA from which the CDNA is derived. Indeed, 5' UTRs have been shown to affect either the stability or translation of mRNAs. Thus, regulation of gene expression may be achieved through the use of alternative 5' UTRs as shown, for instance, for the translation of the tissue inhibitor of metalloprotease mRNA in mitogenically activated cells (Waterhouse et al, *J Biol Chem*. 265:5585–9. 1990). Furthermore, modification of 5' UTR through mutation, insertion or translocation events may even be implied in pathogenesis. For instance, the fragile X syndrome, the most common cause of inherited mental retardation, is partly due to an insertion of multiple CGG trinucleotides in the 5' UTR of the fragile X mRNA resulting in the inhibition of protein synthesis via ribosome stalling (Feng et al, *Science* 268:731–4, 1995). An aberrant mutation in regions of the 5' UTR known to inhibit translation of the proto-oncogene c-myc was shown to result in upregulation of C-myc protein levels in cells derived from patients with multiple myelomas (Willis et al, *Curr Top Microbiol Immunol* 224:269–76, 1997). In addition, the use of oligo-dT primed cDNA libraries does not allow the isolation of complete 5' UTRs since such incomplete sequences obtained by this process may not include the first exon of the mRNA, particularly in situations where the first exon is short. Furthermore, they may not include some exons, often short ones, which are located upstream of splicing sites. Thus, there is a need to obtain sequences derived from the 5' ends of mRNAs.

While many sequences derived from human chromosomes have practical applications, approaches based on the identification and characterization of those chromosomal sequences which encode a protein product are particularly relevant to diagnostic and therapeutic uses. In some instances, the sequences used in such therapeutic or diagnostic techniques may be sequences which encode proteins which are secreted from the cell in which they are synthesized. Those sequences encoding secreted proteins as well as the secreted proteins themselves, are particularly valuable as potential therapeutic agents. Such proteins are often involved in cell to cell communication and may be responsible for producing a clinically relevant response in their target cells. In fact, several secretory proteins, including tissue plasminogen activator, G-CSF, GM-CSF, erythropoietin, human growth hormone, insulin, interferon-α, interferon-β, interferon-γ, and interleukin-2, are currently in clinical use. These proteins are used to treat a wide range of conditions, including acute myocardial infarction, acute ischemic stroke, anemia, diabetes, growth hormone deficiency, hepatitis, kidney carcinoma, chemotherapy-induced neutropenia and multiple sclerosis. For these reasons, extended cDNAs encoding secreted proteins or portions thereof represent a valuable source of therapeutic agents. Thus, there is a need for the identification and characterization of secreted proteins and the nucleic acids encoding them.

In addition to being therapeutically useful themselves, secretory proteins include short peptides, called signal peptides, at their amino termini which direct their secretion. These signal peptides are encoded by the signal sequences located at the 5' ends of the coding sequences of genes encoding secreted proteins. These signal peptides can be used to direct the extracellular secretion of any protein to which they are operably linked. In addition, portions of the signal peptides called membrane-translocating sequences, may also be used to direct the intracellular import of a peptide or protein of interest. This may prove beneficial in gene therapy strategies in which it is desired to deliver a particular gene product to cells other than the cells in which it is produced. Signal sequences encoding signal peptides also find application in simplifying protein purification techniques. In such applications, the extracellular secretion of the desired protein greatly facilitates purification by reducing the number of undesired proteins from which the desired protein must be selected. Thus, there exists a need to identify and characterize the 5' portions of the genes for secretory proteins which encode signal peptides.

Sequences coding for non-secreted proteins may also find application as therapeutics or diagnostics. In particular, such sequences may be used to determine whether an individual is likely to express a detectable phenotype, such as a disease, as a consequence of a mutation in the coding sequence of a protein. In instances where the individual is at risk of suffering from a disease or other undesirable phenotype as a result of a mutation in such a coding sequence, the undesirable phenotype may be corrected by introducing a normal coding sequence using gene therapy. Alternatively, if the undesirable phenotype results from overexpression of the protein encoded by the coding sequence, expression of the protein may be reduced using antisense or triple helix based strategies.

The secreted or non-secreted human polypeptides encoded by the coding sequences may also be used as therapeutics by administering them directly to an individual having a condition, such as a disease, resulting from a mutation in the sequence encoding the polypeptide. In such an instance, the condition can be cured or ameliorated by administering the polypeptide to the individual.

In addition, the secreted or non-secreted human polypeptides or portions thereof may be used to generate antibodies useful in determining the tissue type or species of origin of a biological sample. For example, the antibodies may be used to distinguish between human and non-human cells and tissues or to distinguish between human tissues that do and do not express the polypeptides. The antibodies may also be used to determine the cellular localization of the secreted or non-secreted human polypeptides or the cellular localization of polypeptides which have been fused to the human polypeptides. In addition, the antibodies may also be used in immunoaffinity chromatography techniques to isolate, purify, or enrich the human polypeptide or a target polypeptide which has been fused to the human polypeptide. Public information on the number of human genes for which the promoters and upstream regulatory regions have been identified and characterized is quite limited. In part, this may be due to the difficulty of isolating such regulatory sequences. Upstream regulatory sequences such as transcription factor binding sites are typically too short to be utilized as probes for isolating promoters from human genomic libraries. Recently, some approaches have been developed to isolate human promoters. One of them consists of making a CpG island library (Cross et al., *Nature Genetics* 6: 236–244, 1994). The second consists of isolating human genomic DNA sequences containing SpeI binding sites by the use of SpeI binding protein (Mortlock et al., *Genome Res.* 6:327–335, 1996). Both of these approaches have their limits due to a lack of specificity and of comprehensiveness. Thus, there exists a need to identify and systematically characterize the 5' portions of the genes.

The present 5' ESTs may be used to efficiently identify and isolate 5' UTRs and upstream regulatory regions which control the location, developmental stage, rate, and quantity of protein synthesis, as well as the stability of the mRNA. Once identified and characterized, these regulatory regions may be utilized in gene therapy or protein purification schemes to obtain the desired amount and locations of protein synthesis or to inhibit, reduce, or prevent the synthesis of undesirable gene products. The regulatory regions may also be used for expressing polypeptides in cell types from which the 5' ESTs of the present invention were isolated.

In addition, ESTs containing the 5' ends of protein genes may include sequences useful as probes for chromosome mapping and the identification of individuals. Thus, there is a need to identify and characterize the sequences upstream of the 5' coding sequences of genes.

SUMMARY OF THE INVENTION

The present invention relates to purified, isolated, or enriched 5' ESTs which include sequences derived from the authentic 5' ends of their corresponding mRNAs. The term "corresponding mRNA" refers to the mRNA which was the template for the cDNA synthesis which produced the 5' EST. These sequences will be referred to hereinafter as "5' ESTs". The present invention also includes purified, isolated or enriched nucleic acids comprising contigs assembled by determining a consensus sequences from a plurality of ESTs containing overlapping sequences. These contigs will be referred to herein as "consensus contigated ESTs."

As used herein, the term "purified" does not require absolute purity; rather, it is intended as a relative definition. Individual 5' EST clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$–$10^6$ fold purification of the native message. Purification of starting material or natural material to at least one order of magnitude, preferably two or three orders, and more preferably four or five orders of magnitude is expressly contemplated. Alternatively, purification may be expressed as "at least" a percent purity relative to heterologous polynucleotides (DNA, RNA or both). As a preferred embodiment, the polynucleotides of the present invention are at least; 10%, 20%, 30%, 40%, 50%, 60%, 70%, 80%, 90%, 95%, 96%, 96%, 98%, 99%, or 100% pure relative to heterologous polynucleotides. As a further preferred embodiment the polynucleotides have an "at least" purity ranging from any number, to the thousandth position, between 90% and 100% (e.g., 5' EST at least 99.995% pure) relative to heterologous polynucleotides. Additionally, purity of the polynucleotides may be expressed as a percentage (as described above) relative to all materials and compounds other than the carrier solution. Each number, to the thousandth position, may be claimed as individual species of purity.

As used herein, the term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated. Specifically excluded from the definition of "isolated" are: naturally occurring chromosomes (e.g., chromosome spreads) artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies. Also specifically excluded are the above libraries wherein the 5' EST makes up less than 5% of the number of nucleic acid inserts in the vector molecules. Further specifically excluded are whole cell genomic DNA or whole cell RNA preparations (including said whole cell preparations which are mechanically sheared or enzymaticly digested). Further specifically excluded are the above whole cell preparations as either an in vitro preparation or as a heterogeneous mixture separated by electrophoresis (including blot transfers of the same) wherein the polynucleotide of the invention have not been further separated from the heterologous polynucleotides in the electrophoresis medium (e.g., further separating by excising a single band from a heterogeneous band population in an agarose gel or nylon blot).

As used herein, the term "recombinant" means that the 5' EST is adjacent to "backbone" nucleic acid to which it is not adjacent in its natural environment. Additionally, to be "enriched" the 5' ESTs will represent 5% or more of the number of nucleic acid inserts in a population of nucleic acid backbone molecules. Backbone molecules according to the present invention include nucleic acids such as expression vectors, self-replicating nucleic acids, viruses, integrating nucleic acids, and other vectors or nucleic acids used to maintain or manipulate a nucleic acid insert of interest. Preferably, the enriched 5' ESTs represent 15% or more of the number of nucleic acid inserts in the population of recombinant backbone molecules. More preferably, the enriched 5' ESTs represent 50% or more of the number of nucleic acid inserts in the population of recombinant backbone molecules. In a highly preferred embodiment, the enriched 5' ESTs represent 90% or more (including any integer between 90 and 100%, to the thousandth position, e.g., 99.5%) of the number of nucleic acid inserts in the population of recombinant backbone molecules.

"Stringent", "moderate," and "low" hybridization conditions are as defined below.

The term "polypeptide" refers to a polymer of amino acids without regard to the length of the polymer; thus, peptides, oligopeptides, and proteins are included within the definition of polypeptide. This term also does not specify or exclude chemical or post-expression modifications of the polypeptides of the invention, although chemical or post-expression modifications of these polypeptides may be included excluded as specific embodiments. Therefore, for example, modifications to polypeptides which include the covalent attachment of glycosyl groups, acetyl groups, phosphate groups, lipid groups and the like are expressly encompassed by the term polypeptide. Further, polyeptides with these modifications may be specified as individual species to be included or excluded from the present invention. The natural or other chemical modifications, such as those listed in example above, can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POSTTRANSLATIONAL COVALENT MODIFICATION OF PROTEINS, B. C. Johnson, Ed., Academic Press, New York, pgs. 1–12 (1983); Seifter et al., Meth Enzymol 182:626–646 (1990); Rattan et al., Ann NY Acad Sci 663:48–62 (1992).). Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

As used interchangeably herein, the terms "nucleic acids", "oligonucleotides", and "polynucleotides" include RNA or DNA (either double or single stranded (coding or antisense), or RNA/NA hybrid sequences of more than one nucleotide in either single chain or duplex form (although each of the above species may be particularly specified). The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. Preferred modifications of the present invention include, but are not limited to, 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethyl-aminomethyl-2-thiouridine, 5-carboxymethylamino-methyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v) ybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid, 5-methyl-2-thiouracil, 3-(3-amino-3-N-2-carboxypropyl)uracil, and 2,6-diaminopurine. Methylenemethylimino linked oligonucleosides as well as mixed backbone compounds having, may be prepared as described in U.S. Pat. Nos. 5,378,825; 5,386,023; 5,489,677; 5,602,240; and 5,610,289. Formacetal and thioformacetal linked oligonucleosides may be prepared as described in U.S. Pat. Nos. 5,264,562 and 5,264,564. Ethylene oxide linked oligonucleosides may be prepared as described in U.S. Pat. No. 5,223,618. Phosphinate oligonucleotides may be prepared as described in U.S. Pat. No. 5,508,270. Alkyl phosphonate oligonucleotides may be prepared as described in U.S. Pat. No. 4,469,863. 3'-Deoxy-3'-methylene phosphonate oligonucleotides may be prepared as described in U.S. Pat. Nos. 5,610,289 or 5,625,050. Phosphoramidite oligonucleotides may be prepared as described in U.S. Pat. No. 5,256,775 or U.S. Pat. No. 5,366,878. Alkylphosphonothioate oligonucleotides may be prepared as described in published PCT applications WO 94/17093 and WO 94/02499. 3'-Deoxy-3'-amino phosphoramidate oligonucleotides may be prepared as described in U.S. Pat. No. 5,476,925. Phosphotriester oligonucleotides may be prepared as described in U.S. Pat. No. 5,023,243. Borano phosphate oligonucleotides may be prepared as described in U.S. Pat. Nos. 5,130,302 and 5,177,198.

The polynucleotide sequences of the invention may be prepared by any known method, including synthetic, recombinant, ex vivo generation, or a combination thereof, as well as utilizing any purification methods known in the art.

In specific embodiments, the polynucleotides of the invention are at least 15, at least 30, at least 50, at least 100, at least 125, at least 500, or at least 1000 continuous nucleotides but are less than or equal to 300 kb, 200 kb, 100 kb, 50 kb, 10 kb, 7.5 kb, 5 kb, 2.5 kb, 2 kb, 1.5 kb, or 1 kb in length. In a further embodiment, polynucleotides of the invention comprise a portion of the coding sequences, as disclosed herein, but do not comprise all or a portion of any intron. In another embodiment, the polynucleotides comprising coding sequences do not contain coding sequences of a genomic flanking gene (i.e., 5' or 3' to the gene of interest in the genome). In other embodiments, the polynucleotides of the invention do not contain the coding sequence of more than 1000, 500, 250, 100, 75, 50, 25, 20, 15, 10, 5, 4, 3, 2, or 1 genomic flanking gene(s).The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, 4$^{th}$ edition, 1995).

The terms "complementary" or "complement thereof" are used herein to refer to the sequences of polynucleotides which is capable of forming Watson & Crick base pairing with another specified polynucleotide throughout the entirety of the complementary region. For the purpose of the present invention, a first polynucleotide is deemed to be complementary to a second polynucleotide when each base in the first polynucleotide is paired with its complementary base. Complementary bases are, generally, A and T (or A and U), or C and G. "Complement" is used herein as a synonym from "complementary polynucleotide", "complementary nucleic acid" and "complementary nucleotide sequence". These terms are applied to pairs of polynucleotides based solely upon their sequences and not any particular set of conditions under which the two polynucleotides would actually bind. Preferably, a "complementary" sequence is a sequence which an A at each position where there is a T on the opposite strand, a T at each position where there is an A on the opposite strand, a G at each position where there is a C on the opposite strand and a C at each position where there is a G on the opposite strand.

The terms "vertebrate nucleic acid" and "vertebrate polypeptide" are used herein to refer to any nucleic acid or polypeptide respectively which are derived from a vertebrate species including birds and more usually mammals, preferably primates such as humans, farm animals such as swine, goats, sheep, donkeys, and horses, rabbits or rodents, more preferably rats or mice. As used herein, the term "vertebrate" is used to refer to any vertebrate, preferably a mammal. The term "vertebrate" expressly embraces human subjects unless preceded with the term "non-human".

Thus, 5' ESTs in CDNA libraries in which one or more 5' ESTs make up 5% or more of the number of nucleic acid inserts in the backbone molecules are "enriched recombinant 5' ESTs" as defined herein. Likewise, 5' ESTs in a population of plasmids in which one or more 5' ESTs of the present invention have been inserted such that they represent 5% or more of the number of inserts in the plasmid backbone are "enriched recombinant 5' ESTs" as defined herein. However, 5' ESTs in cDNA libraries in which 5' ESTs constitute less than 5% of the number of nucleic acid inserts in the population of backbone molecules, such as libraries in which backbone molecules having a 5' EST insert are extremely rare, are not "enriched recombinant 5' ESTs."

The term"capable of hybridizing to the polyA tail of said mRNA" refers to and embraces all primers containing stretches of thymidine residues, so-called oligo(dT) primers, that hybridize to the 3' end of eukaryotic poly(A)+ mRNAs to prime the synthesis of a first cDNA strand. Techniques for generating said oligo(dT) primers and hybridizing them to mRNA to subsequently prime the reverse transcription of said hybridized mRNA to generate a first cDNA strand are well known to those skilled in the art and are described in *Current Protocols in Molecular Biology*, John Wiley and Sons, Inc. 1997 and Sambrook et al., *Molecular Cloning: A Laboratory Manual*, Second Edition, Cold Spring Harbor Laboratory Press, 1989, the entire disclosures of which are incorporated herein by reference. Preferably, said oligo(dT) primers are present in a large excess in order to allow the hybridization of all mRNA 3' ends to at least one oligo(dT) molecule. The priming and reverse transcription step are preferably performed between 37° C. and 55° C. depending on the type of reverse transcriptase used.

Preferred oligo(dT) primers for priming reverse transcription of mRNAs are oligonucleotides containing a stretch of thymidine residues of sufficient length to hybridize specifically to the polyA tail of mRNAs, preferably of 12 to 18 thymidine residues in length. More preferably, such oligo(T) primers comprise an additional sequence upstream of the poly(dT) stretch in order to allow the addition of a given sequence to the 5' end of all first cDNA strands which may then be used to facilitate subsequent manipulation of the cDNA. Preferably, this added sequence is 8 to 60 residues in length. For instance, the addition of a restriction site in 5' of cDNAs facilitates subcloning of the obtained cDNA. Alternatively, such an added 5' end may also be used to design primers of PCR to specifically amplify cDNA clones of interest.

In some embodiments, the present invention relates to 5' ESTs which are derived from genes encoding secreted proteins. As used herein, a "secreted" protein is one which, when expressed in a suitable host cell, is transported across or through a membrane, including transport as a result of signal peptides in its amino acid sequence. "Secreted" proteins include without limitation proteins secreted wholly (e.g. soluble proteins), or partially (e.g. receptors) from the cell in which they are expressed. "Secreted" proteins also include without limitation proteins which are transported across the membrane of the endoplasmic reticulum.

Such 5' ESTs include nucleic acid sequences, called signal sequences, which encode signal peptides which direct the extracellular secretion of the proteins encoded by the genes from which the 5' ESTs are derived. Generally, the signal peptides are located at the amino termini of secreted proteins. Polypeptides comprising these signal peptides (as delineated in the sequence listing), and polynucleotides encoding the same, are preferred embodiments of the present invention.

Secreted proteins are translated by ribosomes associated with the "rough" endoplasmic reticulum. Generally, secreted proteins are co-translationally transferred to the membrane of the endoplasmic reticulum. Association of the ribosome with the endoplasmic reticulum during translation of secreted proteins is mediated by the signal peptide. The signal peptide is typically cleaved following its co-translational entry into the endoplasmic reticulum. After delivery to the endoplasmic reticulum, secreted proteins may proceed through the Golgi apparatus. In the Golgi apparatus, the proteins may undergo post-translational modification before entering secretory vesicles which transport them across the cell membrane.

The 5' ESTs of the present invention have several important applications. For example, the 5' EST sequences of the sequence listing, and fragments thereof, may be used to distinguish human tissues or cells from non-human tissues or cells and to distinguish between human tissues or cells that do and do not express polynucleotides comprising the 5' EST sequences of the present invention. By knowing the tissue expression pattern of the 5' EST sequences, either through routine experimentation or by using the Tables herein, the polynucleotides of the present invention may be used in methods of determining the identity of an unknown tissue or cell sample. For example, if a 5' EST is expressed in a particular tissue or cell type, as shown in the Tables below, and the unknown tissue or cell sample does not express the 5' EST, it may be inferred that the unknown tissue or cells are either not human or not the same human tissue or cell type as that which expresses the 5' EST. Conversely, if a 5' EST is not expressed in a particular tissue or cell type, as shown in the Tables below, and the unknown tissue or cell sample does express the 5' EST, it may be inferred that the unknown tissue or cells are either not human or not the same human tissue or cell type as that which does not express the 5' EST. The above procedure may be used for either homogeneous tissue or cell samples or heterogeneous tissue or cell samples since one may only want to narrow the identity to human or non-human or to a tissue type. Further assays may be used in conjunction with the above methods to narrow or confirm the identification process. These methods of determining tissue or cell identity are based on methods which detect the presence or absence of the 5' EST sequences in a tissue or cell sample using methods well know in the art (e.g., hybridization or PCR methods).

In other useful applications, fragments of the 5' EST sequences encoding signal peptides as well as degenerate polynucleotides encoding the same, may be ligated to sequences encoding either the polypeptide from the same gene or to sequences encoding a heterologous polypeptide to facilitate secretion The 5' EST sequences, and fragments thereof, may also be used to obtain and express cDNA clones which include the full protein coding sequences of the corresponding gene products, including the authentic translation start sites derived from the 5' ends of the coding sequences of the mRNAs from which the 5' ESTs are derived. These cDNAs will be referred to hereinafter as "full-length cDNAs." These cDNAs may also include DNA derived from mRNA sequences upstream of the translation start site. The full-length cDNA sequences may be used to express the proteins corresponding to the 5' ESTs. As discussed above, secreted proteins and non-secreted proteins may be therapeutically important. Thus, the proteins expressed from the cDNAs may be useful in treating or controlling a variety of human conditions.

The 5' ESTs may also be used to obtain the corresponding genomic DNA. The term "corresponding genomic DNA" refers to the genomic DNA which encodes the mRNA from which the 5' EST was derived.

Another use of the polynucleotides of the present invention is to map and clone promoter regions and open reading frames from a genomic sequence. For example, the 5' ESTs can be used in combination with the sequence information from genome sequencing projects, such as the U.S. Human Genome Project or other public and private genome sequencing projects, to map and clone regions of the genome that comprise promoters and expressed open reading frames. The polynucleotides of the present invention are particularly useful for mapping and identifying coding regions (regions containing expressed open reading frames) from a genomic sequence since the vast majority of the human genome does not encode expressed genes and because of the difficulty in identifying authentic open reading frames (open reading frames that encode expressed genes). The 5' EST sequences of the present invention can be used in conjunction with various algorithms to identify promoter or entire ORF sequences.

Alternatively, the 5' ESTs may be used to obtain and express extended cDNAs encoding portions of the protein. In the case of secreted proteins, the portions may comprise the signal peptides of the secreted proteins or the mature proteins generated when the signal peptide is cleaved off.

The present invention includes isolated, purified, or enriched "EST-related nucleic acids." The terms "isolated", "purified" or "enriched" have the meanings provided above.

As used herein, the term "EST-related nucleic acids" means the nucleic acids of SEQ ID NOs. 24–3883 and 7744–19335, extended cDNAs obtainable using the nucleic acids of SEQ ID NOs. 24–3883 and 7744–19335, full-length cDNAs obtainable using the nucleic acids of SEQ ID NOs. 24–3883 and 7744–19335 or genomic DNAs obtainable using the nucleic acids of SEQ ID NOs. 24–3883 and 7744–19335. The present invention also includes the sequences complementary to, or allelic variants of, the EST-related nucleic acids.

The present invention also includes isolated, purified, or enriched "fragments of EST-related nucleic acids." The terms "isolated", "purified" and "enriched" have the meanings described above. As used herein the term "fragments of EST-related nucleic acids" means fragments comprising at least 8, 10, 12, 15, 18, 20, 23, 25, 28, 30, 35, 40, 50, 75, 100, 200, 300, 500, or 1000 consecutive nucleotides of the EST-related nucleic acids to the extent that fragments of these lengths are consistent with the lengths of the particular EST-related nucleic acids being referred to. The present invention also includes the sequences complementary to the fragments of the EST-related nucleic acids. In particular, fragments of EST-related nucleic acids refer to the polynucleotides described in Tables IVa and IVb, and polynucleotides described in Tables IVa and IVb updated as defined below.

The present invention also includes isolated, purified, or enriched "positional segments of EST-related nucleic acids." The terms "isolated", "purified", or "enriched" have the meanings provided above. As used herein, the term "positional segments of EST-related nucleic acids" includes segments comprising nucleotides 1–25, 26–50, 51–75, 76–100, 101–125, 126–150, 151–175, 176–200, 201–225, 226–250, 251–300, 301–325, 326–350, 351–375, 376–400, 401–425, 426–450, 451–475, 476–500, 501–525, 526–550, 551–575, 576–600 and 601-the terminal nucleotide of the EST-related nucleic acids to the extent that such nucleotide positions are consistent with the lengths of the particular EST-related nucleic acids being referred to, and wherein position "1" is defined as the 5' most position defined in the sequence listing or Tables below. The term "positional segments of EST-related nucleic acids also includes segments comprising nucleotides 1–50, 51–100, 101–150, 151–200, 201–250, 251–300, 301–350, 351–400, 401–450, 450–500, 501–550, 551–600 or 601-the terminal nucleotide of the EST-related nucleic acids to the extent that such nucleotide positions are consistent with the lengths of the particular EST-related nucleic acids being referred to. The term "positional segments of EST-related nucleic acids" also includes segments comprising nucleotides 1–100, 101–200, 201–300, 301–400, 501–500, 500–600, or 601—the terminal nucleotide of the EST-related nucleic acids to the extent that such nucleotide positions are consistent with the lengths of the particular EST-related nucleic acids being referred to. In addition, the term "positional segments of EST-related nucleic acids" includes segments comprising nucleotides 1–200, 201–400, 400–600, or 601-the terminal nucleotide of the EST-related nucleic acids to the extent that such nucleotide positions are consistent with the lengths of the particular EST related nucleic acids being referred to. The present invention also includes the sequences complementary to the positional segments of EST-related nucleic acids.

The present invention also includes isolated, purified, or enriched "fragments of positional segments of EST-related nucleic acids." The terms "isolated", "purified", or "enriched" have the meanings provided above. As used herein, the term "fragments of positional segments of EST-related nucleic acids" refers to fragments comprising at least 8, 10, 15, 18, 20, 23, 25, 28, 30, 35, 40, 50, 75, 100, 150, or 200 consecutive nucleotides of the positional segments of EST-related nucleic acids. The present invention also includes the sequences complementary to the fragments of positional segments of EST-related nucleic acids.

In addition to the above "positional segments of EST-related nucleic acids" and "fragments of positional segments of EST-related nucleic acids", for the nucleic acids of SEQ ID NOs. 24–3883 and 7744–19335, further preferred nucleic acids comprise at least 8 nucleotides, wherein "at least 8" is defined as any integer between 8 and the integer representing the 3' most nucleotide position in the sequence listing or Tables below. Further included are nucleic acid fragments at least 8 nucleotides in length, as described above, that are further specified in terms of their 5' and 3' position. The 5' and 3' positions are represented by the position number set forth in the sequence listing below. Therefore, every combination of a 5' and 3' nucleotide position that a fragment at least 8 contiguous nucleotides in length could occupy is included in the invention as an individual species. The polynucleotide fragment specified by 5' and 3' positions can be immediately envisaged and are therefore not individually listed solely for the purpose of not unnecessarily lengthening the specifications. It is noted that the above species of polynucleotides fragments of the present invention may alternatively be described by the formula "a to b"; where "a" equals the 5" nucleotide position and "b" equals 3" nucleotide position of the polynucleotide fragment; and further where "a" equals an integer between 1 and the number of nucleotides of the polynucleotide sequence of the present invention minus 8, and where "b" equals an integer between 9 and the number of nucleotides of the polynucleotide sequence of the present invention; and where "a" is an integer smaller then "b" by at least 8.

The present invention also provides for the exclusion of any polynucleotide fragments specified by 5' and 3' positions or by size in nucleotides as described above. Any number of fragments specified by 5' and 3' positions or by size in nucleotides, as described above, may be excluded.

The present invention also includes isolated or purified "EST-related polypeptides." The terms "isolated" or "purified" have the meanings provided above. As used herein, the term "EST-related polypeptides" means the polypeptides encoded by the EST-related nucleic acids, including the polypeptides of SEQ ID NOs. 3884–7743.

The present invention also includes isolated or purified "fragments of EST-related polypeptides." The terms "isolated" or "purified" have the meanings provided above. As used herein, the term "fragments of EST-related polypeptides" means fragments comprising at least 5, 10, 15, 20, 25, 30, 35, 40, 50, 75, 100, or 150 consecutive amino acids of an EST-related polypeptide to the extent that fragments of these lengths are consistent with the lengths of the particular EST-related polypeptides being referred to. In particular, fragments of EST-related polypeptides refer to polypeptides encoded by polynucleotides described in Tables IVa and IVb, and polynucleotides described in Tables IVa and IVb updated.

The present invention also includes isolated or purified "positional segments of EST-related polypeptides." As used herein, the term "positional segments of EST-related polypeptides" includes polypeptides comprising amino acid residues 1–25, 26–50, 51–75, 76–100, 101–125, 126–150, 151–175, 176–200, or 201-the C-terminal amino acid of the EST-related polypeptides to the extent that such amino acid residues are consistent with the lengths of the particular EST-related polypeptides being referred to. The term "positional segments of EST-related polypeptides also includes segments comprising amino acid residues 1–50, 51–100, 101–150, 151–200 or 201-the C-terminal amino acid of the EST-related polypeptides to the extent that such amino acid residues are consistent with the lengths of the particular EST-related polypeptides being referred to. The term "positional segments of EST-related polypeptides" also includes segments comprising amino acids 1–100 or 101–200 of the EST-related polypeptides to the extent that such amino acid residues are consistent with the lengths of particular EST-related polypeptides being referred to. In addition, the term "positional segments of EST-related polypeptides" includes segments comprising amino acid residues 1–200 or 201-the C-terminal amino acid of the EST-related polypeptides to the extent that amino acid residues are consistent with the lengths of the particular EST related polypeptides being referred to.

The present invention also includes isolated or purified "fragments of positional segments of EST-related polypeptides." The terms "isolated" or "purified" have the meanings provided above. As used herein, the term "fragments of positional segments of EST-related polypeptides" means fragments comprising at least 5, 10, 15, 20, 25, 30, 35, 40, 50, 75, 100, or 150 consecutive amino acids of positional segments of EST-related polypeptides to the extent that fragments of these lengths are consistent with the lengths of the particular EST-related polypeptides being referred to.

In addition to the above "positional segments of EST-related polypeptides" and "fragments of positional segments of EST-related polypeptides", for the polypeptides of the present invention, further preferred polypeptides comprise at least 8 amino acids, wherein "at least 8" is defined as any integer between 8 and the integer representing the C-terminal amino acid of the polypeptide of the present invention including the polypeptide sequences of the sequence listing below. Further included are polypeptide fragments at least 8 amino acids in length, as described above, that are further specified in terms of their N-terminal and C-terminal positions. Preferred polypeptide fragment species specified by their N-terminal and C-terminal positions include the signal peptides delineated in the sequence listing below. However, included in the present invention as individual species are all polypeptide fragments, at least 5 amino acids in length, as described above, and may be particularly specified by a N-terminal and C-terminal position.

The present invention also provides for the exclusion of any fragments specified by N-terminal and C-terminal positions or by size in amino acid residues as described above. Any number of fragment species specified by N-terminal and C-terminal positions or sub-genus of fragments specified by size in amino acid residues as described above may be excluded from the present invention.

The polypeptide fragments of the present invention can be immediately envisaged using the above description and are therefore not individually listed solely for the purpose of not unnecessarily lengthening the specification. The above fragments need not be active since they would be useful, for example, inimmunoassays, in epitope mapping, epitope tagging, as vaccines, to raise antibodies, stimulate an immune response in a heterologous species, and as molecular weight markers. The above fragments may also be used to generate antibodies to a particular portion of the polypeptide. These antibodies can then be used in immunoassays well known in the art to distinguish between human and non-human cells and tissues or to determine whether cells or tissues in a biological sample are or are not of the same type which express the polypeptide of the present invention. Further preferred polypeptide fragments of the present invention comprise the signal peptides as delineated in the sequence listing. These signal peptides may be used to facilitate secretion of either the polypeptide of the same gene or a heterologous polypeptide.

The present invention also includes antibodies which specifically recognize the EST-related polypeptides, fragments of EST-related polypeptides, positional segments of EST-related polypeptides, or fragments of positional segments of EST-related polypeptides. In the case of secreted proteins, such as those of SEQ ID NOs. 5199–5919 antibodies which specifically recognize the mature protein generated when the signal peptide is cleaved may also be obtained as described below. Similarly, antibodies which specifically recognize the signal peptides of SEQ ID NOs. 3884–4243 or 5199–5919 may also be obtained.

In some embodiments and in the case of secreted proteins, the EST-related nucleic acids, fragments of EST-related nucleic acids, positional segments of EST-related nucleic acids, or fragments of positional segments of nucleic acids include a signal sequence. In other embodiments, the EST-related nucleic acids, fragments of EST-related nucleic acids, positional segments of EST-related nucleic acids, or fragments of positional segments of nucleic acids may include the full coding sequence for the protein or, in the case of secreted proteins, the full coding sequence of the mature protein (i.e. the protein generated when the signal polypeptide is cleaved off). In addition, the EST-related nucleic acids, fragments of EST-related nucleic acids, positional segments of EST-related nucleic acids, or fragments of positional segments of nucleic acids may include regulatory regions upstream of the translation start site or downstream of the stop codon which control the amount, location, or developmental stage of gene expression.

As discussed above, both secreted and non-secreted human proteins may be therapeutically important. Thus, the proteins expressed from the EST-related nucleic acids, fragments of EST-related nucleic acids, positional segments of EST-related nucleic acids, or fragments of positional segments of nucleic acids may be useful in treating or controlling a variety of human conditions.

The EST-related nucleic acids, fragments of EST-related nucleic acids, positional segments of EST-related nucleic acids, or fragments of positional segments of nucleic acids may be used in forensic procedures to identify individuals or in diagnostic procedures to identify individuals having genetic diseases resulting from abnormal gene expression. In addition, the EST-related nucleic acids, fragments of EST-related nucleic acids, positional segments of EST-related nucleic acids, or fragments of positional segments of nucleic acids are useful for constructing a high resolution map of the human chromosomes.

The present invention also relates to secretion vectors capable of directing the secretion of a protein of interest. Such vectors may be used in gene therapy strategies in which it is desired to produce a gene product in one cell which is to be delivered to another location in the body. Secretion vectors may also facilitate the purification of desired proteins. The secretion vectors may also be used to express a desired protein, such as a heterologous protein, such that the protein is secreted into the culture medium, thereby facilitating purification.

The present invention also relates to expression vectors capable of directing the expression of an inserted gene in a desired spatial or temporal manner or at a desired level. Such vectors may include sequences upstream of the EST-related nucleic acids, fragments of EST-related nucleic acids, positional segments of EST-related nucleic acids, or fragments of positional segments of nucleic acids, such as promoters or upstream regulatory sequences. Preferred chimeric polypeptides, and vectors encoding the same, comprise a signal peptide set forth in the sequence listing below.

The present invention also comprises fusion vectors for making chimeric polypeptides comprising a first polypeptide and a second polypeptide. Such vectors are useful for determining the cellular localization of the chimeric polypeptides or for isolating, purifying or enriching the chimeric polypeptides.

The EST-related nucleic acids, fragments of EST-related nucleic acids, positional segments of EST-related nucleic acids, or fragments of positional segments of nucleic acids may also be used for gene therapy to control or treat genetic diseases. In the case of secreted proteins, signal peptides may be fused to heterologous proteins to direct their extracellular secretion.

Bacterial clones containing Bluescript plasmids having inserts containing the sequence of the non-aligned 5' ESTs, also referred to as singletons, and sequences of the 5' ESTs which were aligned to yield consensus contigated 5' ESTs are presently stored at −80° C. in 4% (v/v) glycerol in the inventor's laboratories under internal designations. The non-aligned 5' ESTs of the invention are those sequences which are present in the sequence listing but which identification number either corresponds to a single EST from a single tissue in the second column of Table V or is absent from the first column of Table V. The inserts may be recovered from the stored materials by growing the appropriate clones on a suitable medium. The Bluescript DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be performed with primers designed at both ends of the inserted EST-related nucleic acids, fragments of EST-related nucleic acids, positional segments of EST-related nucleic acids, or fragments of positional segments of nucleic acids. The PCR product which corresponds to the EST-related nucleic acids, fragments of EST-related nucleic acids, positional segments of EST-related nucleic acids, or fragments of positional segments of nucleic acids can then be manipulated using standard cloning techniques familiar to those skilled in the art.

One embodiment of the present invention is a purified nucleic acid comprising a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

Another embodiment of the present invention is a purified nucleic acid comprising at least 8, 10, 12, 15, 18, 20, 23, 25, 28, 30, 35, 40, 50, 75, 100, 200, 300, 500, or 1000 consecutive nucleotides, to the extent that fragments of these lengths are consistent with the specific sequence, of a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

A further aspect of this embodiment is a purified vertebrate nucleic acid comprising at least 8, 10, 12, 15, 18, 20, 23, 25, 28, 30, 35, 40, 50, 75, 100, 200, 300, 500, or 1000 consecutive nucleotides, to the extent that fragments of these lengths are consistent with the specific sequence, of a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

A further aspect of this embodiment is a purified human nucleic acid comprising at least 8, 10, 12, 15, 18, 20, 23, 25, 28, 30, 35, 40, 50, 75, 100, 200, 300, 500, or 1000 consecutive nucleotides, to the extent that fragments of these lengths are consistent with the specific sequence, of a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

Another embodiment of the present invention is a purified nucleic acid comprising at least 8, 10, 12, 15, 18, 20, 23, 25, 28, 30, 35, 40, 50, 75, 100, 200, 300, 500, or 1000 consecutive nucleotides, to the extent that fragments of these lengths are consistent with the specific sequence, of a sequence selected from the group consisting of the preferred polynucleotides described in Tables IVa and IVb and sequences complementary to the sequences the preferred polynucleotides described in Tables IVa and IVb.

Another embodiment of the present invention is a purified nucleic acid comprising at least 8, 10, 12, 15, 18, 20, 23, 25, 28, 30, 35, 40, 50, 75, 100, 200, 300, 500, or 1000 consecutive nucleotides, to the extent that fragments of these lengths are consistent with the specific sequence, of a sequence selected from the group consisting of the preferred polynucleotides described in Tables IVa and IVb updated and sequences complementary to the sequences the preferred polynucleotides described in Tables IVa and IVb updated.

Another embodiment of the present invention is a purified nucleic acid comprising at least 15 consecutive nucleotides of a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

A further aspect of this embodiment is a purified vertebrate nucleic acid comprising at least 15 consecutive nucleotides of a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

A further aspect of this embodiment is a purified human nucleic acid comprising at least 15 consecutive nucleotides of a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

Another embodiment of the present invention is a purified nucleic acid comprising at least 15 consecutive nucleotides of a sequence selected from the group consisting of the preferred polynucleotides described in Tables IVa and IVb and sequences complementary to the sequences of the preferred polynucleotides described in Tables IVa and IVb.

A further embodiment of the present invention is a purified nucleic acid comprising the coding sequence of a sequence selected from the group consisting of 24–3883.

Yet another embodiment of the present invention is a purified nucleic acid comprising the full coding sequences of a sequence selected from the group consisting of SEQ ID NOs. 1339–2059 wherein the full coding sequence comprises the sequence encoding the signal peptide and the sequence encoding the mature protein.

Still another embodiment of the present invention is a purified nucleic acid comprising a contiguous span of a sequence selected from the group consisting of SEQ ID NOs. 1339–2059 which encodes the mature protein.

Another embodiment of the present invention is a purified nucleic acid comprising a contiguous span of a sequence selected from the group consisting of SEQ ID NOs. 24–383 and 1339–2059 which encodes the signal peptide.

Another embodiment of the present invention is a purified nucleic acid encoding a polypeptide comprising a sequence selected from the group consisting of the sequences of SEQ ID NOs. 3884–7743.

Another embodiment of the present invention is a purified nucleic acid encoding a polypeptide comprising a sequence selected from the group consisting of the sequences of SEQ ID NOs. 5199–5919.

Another embodiment of the present invention is a purified nucleic acid encoding a polypeptide comprising a mature protein included in a sequence selected from the group consisting of the sequences of SEQ ID NOs. 5199–5919.

Another embodiment of the present invention is a purified nucleic acid encoding a polypeptide comprising a signal peptide included in a sequence selected from the group consisting of the sequences of SEQ ID NOs. 3884–4243 and 5199–5919.

Another embodiment of the present invention is a purified nucleic acid of at least 15, 18, 20, 23, 25, 28, 30, 35, 40, 50, 75, 100, 200, 300, 500 or 1000 nucleotides in length which hybridizes under stringent conditions to a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

Another embodiment of the present invention is a vertebrate purified nucleic acid of at least 15, 18, 20, 23, 25, 28, 30, 35, 40, 50, 75, 100, 200, 300, 500 or 1000 nucleotides in length which hybridizes under stringent conditions to a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

Another embodiment of the present invention is a human purified nucleic acid of at least 15, 18, 20, 23, 25, 28, 30, 35, 40, 50, 75, 100, 200, 300, 500 or 1000 nucleotides in length which hybridizes under stringent conditions to a sequence selected from the group consisting of SEQ ID NOs. 24–3883 and SEQ ID NOs. 7744–19335 and sequences complementary to the sequences of SEQ ID NOs. 24–3883 and SEQ ID NOs. 7744–19335.

Another embodiment of the present invention is a purified or isolated polypeptide comprising a sequence selected from the group consisting of the sequences of SEQ ID NOs. 3884–7743.

Another embodiment of the present invention is a purified or isolated polypeptide comprising a sequence selected from the group consisting of SEQ ID NOs. 5199–5919.

Another embodiment of the present invention is a purified or isolated polypeptide comprising a mature protein of a polypeptide selected from the group consisting of SEQ ID NOs. 5199–5919.

Another embodiment of the present invention is a purified or isolated polypeptide comprising a signal peptide of a sequence selected from the group consisting of the polypeptides of SEQ ID NOs. 3884–4243 and 5199–5919.

Another embodiment of the present invention is a purified or isolated polypeptide comprising at least 5, 8, 10, 12, 15, 18, 20, 23, 25, 28, 30, 35, 40, 50, 75, 100, 200, 300, 500, or 1000 consecutive amino acids, to the extent that fragments of these lengths are consistent with the specific sequence, of a sequence selected from the group consisting of the sequences of SEQ ID NOs. 3884–7743.

Another embodiment of the present invention is a method of making a cDNA comprising the steps of contacting a collection of mRNA molecules from human cells with a primer comprising at least 12, 15, 18, 20, 23, 25, 28, 30, 35, 40, or 50 consecutive nucleotides of a sequence selected from the group consisting of the sequences complementary to SEQ ID NOs. 24–3883 and SEQ ID NOs. 7744–19335, hybridizing said primer to an mRNA in said collection that encodes said protein, reverse transcribing said hybridized primer to make a first cDNA strand from said mRNA, making a second cDNA strand complementary to said first cDNA strand and isolating the resulting cDNA encoding said protein comprising said first cDNA strand and said second cDNA strand.

Another embodiment of the present invention is a purified cDNA obtainable by the method of the preceding paragraph. In one aspect of this embodiment, the cDNA encodes at least a portion of a human polypeptide.

Another embodiment of the present invention is a purified cDNA obtained by a method of making a cDNA of the invention. In one aspect of this embodiment, the cDNA encodes at least a portion of a human polypeptide.

Another embodiment of the present invention is a method of making a cDNA comprising the steps of contacting a cDNA collection with a detectable probe comprising at least 12, 15, 18, 20, 23, 25, 28, 30, 35, 40, or 50 consecutive nucleotides of a sequence selected from the group consisting of SEQ ID NOs. 24–3883 and SEQ ID NOs. 7744–19335 and the sequences complementary to SEQ ID NOs. 24–3883 and SEQ ID NOs. 7744–19335 under conditions which permit said probe to hybridize to cDNA, identifying a cDNA which hybridizes to said detectable probe, and isolating said cDNA which hybridizes to said probe.

Another embodiment of the present invention is a purified cDNA obtainable by the method of the preceding paragraph. In one aspect of this embodiment, the cDNA encodes at least a portion of a human polypeptide.

Another embodiment of the present invention is a method of making a cDNA comprising the steps of contacting a collection of mRNA molecules from human cells with a first primer capable of hybridizing to the polyA tail of said mRNA, hybridizing said first primer to said polyA tail, reverse transcribing said mRNA to make a first cDNA strand, making a second cDNA strand complementary to said first cDNA strand using at least one primer comprising at least 12, 15, 18, 20, 23, 25, 28, 30, 35, 40, or 50 consecutive nucleotides of a sequence selected from the group consisting of SEQ ID NOs. 24–3883 and SEQ ID NOs. 7744–19335, and isolating the resulting cDNA comprising said first cDNA strand and said second cDNA strand. In another aspect of this method the second cDNA strand is made by contacting said first cDNA strand with a second primer comprising at least 12, 15, 18, 90, 23, 25, 28, 30, 35, 40, or 50 consecutive nucleotides of a sequence selected from the group consisting of SEQ ID NOs. 24–3883 and SEQ ID NOs. 7744–19335 and a third primer which sequence is fully included within the sequence of said first primer, performing a first polymerase chain reaction with said second and third primers to generate a first PCR product, contacting said first PCR product with a fourth primer, comprising at least 12, 15, 18, 20, 23, 25, 28, 30, 35, 40, or 50 consecutive nucleotides of said sequence selected from the group consisting of SEQ ID NOs. 24–3883 and SEQ ID NOs. 7744–19335, and a fifth primer, which sequence is fully included within the sequence of said third primer, wherein said fourth and fifth hybridize to sequences within said first PCR product, and performing a second polymerase chain reaction, thereby generating a second PCR product. Alternatively, the second cDNA strand may be made by contacting said first cDNA strand with a second primer comprising at least 12, 15, 18, 20, 23, 25, 28, 30, 35, 40, or 50 consecutive nucleotides of a sequence selected from the group consisting of SEQ ID NOs. 24–3883 and SEQ ID NOs. 7744–19335 and a third primer which sequence is fully included within the sequence of said first primer, performing a polymerase chain reaction with said second and third primers to generate said second cDNA strand. Alternatively, the second cDNA strand may be made by contacting said first cDNA strand with a second primer comprising at least 12, 15, 18, 20, 23, 25, 28, 30, 35, 40, or 50 consecutive nucleotides of a sequence selected from the group consisting of SEQ ID NOs. 24–3883 and SEQ ID NOs. 7744–19335, hybridizing said second primer to said first strand cDNA, and extending said hybridized second primer to generate said second cDNA strand.

Another embodiment of the present invention is a purified cDNA obtainable by a method of making a cDNA of the invention. In one aspect of this embodiment, said cDNA encodes at least a portion of a human polypeptide.

Another embodiment of the present invention is a method of making a polypeptide comprising the steps of obtaining a cDNA which encodes a polypeptide encoded by a nucleic acid comprising a sequence selected from the group consisting of SEQ ID NOs. 24–3883 or a cDNA which encodes a polypeptide comprising at least 6, 8, 10, 12, 15, 18, 20, 23, 25, 28, 30, 35, 40, or 50 consecutive amino acids of a polypeptide encoded by a sequence selected from the group consisting of SEQ ID NOs. 24–3883, inserting said cDNA in an expression vector such that said cDNA is operably linked to a promoter, introducing said expression vector into a host cell whereby said host cell produces the protein encoded by said cDNA, and isolating said protein.

Another embodiment of the present invention is a method of obtaining a promoter DNA comprising the steps of obtaining genomic DNA located upstream of a nucleic acid comprising a sequence selected from the group consisting of SEQ ID NOs. 24–3883 and SEQ ID NOs. 7744–19335 and the sequences complementary to the sequences of SEQ ID NOs. 24–3883 and SEQ ID NOs. 7744–19335, screening said genomic DNA to identify a promoter capable of directing transcription initiation, and isolating said DNA comprising said identified promoter.

In one aspect of this embodiment, said obtaining step comprises walking from genomic DNA comprising a sequence selected from the group consisting of SEQ ID NOs. 24–3883 and SEQ ID NOs. 7744–19335 and the sequences complementary to SEQ ID NOs. 24–3883 and SEQ ID NOs. 7744–19335. In another aspect of this embodiment, said screening step comprises inserting genomic DNA located upstream of a sequence selected from the group consisting of SEQ ID NOs. 24–3883 and SEQ ID NOs. 7744–19335 and the sequences complementary to SEQ ID NOs. 24–3883 and SEQ ID NOs. 7744–19335 into a promoter reporter vector. For example, said screening step may comprise identifying motifs in genomic DNA located upstream of a sequence selected from the group consisting of SEQ ID NOs. 24–3883 and SEQ ID NOs. 7744–19335 and the sequences complementary to SEQ ID NOs. 24–3883 and SEQ ID NOs. 7744–19335 which are transcription factor binding sites or transcription start sites.

Another embodiment of the present invention is a isolated promoter obtainable by the methods of the above paragraphs.

Another embodiment of the present invention is a isolated promoter obtained by the methods described in the above paragraphs.

Another embodiment of the present invention is the inclusion of at least one sequence selected from the group consisting of SEQ ID NOs. 24–3883 and SEQ ID NOs. 7744–19335, the sequences complementary to the sequences of SEQ ID NOs. 24–3883 and SEQ ID NOs. 7744–19335 and fragments comprising at least 12, 15, 18, 20, 23, 25, 28, 30, 35, 40, 50, or 100 consecutive nucleotides of said sequence in an array of discrete ESTs or fragments thereof of at least 12, 15, 18, 20, 23, 25, 28, 30, 35, 40, 50, or 100 nucleotides in length. In some aspects of this embodiment, the array includes at least two sequences selected from the group consisting of SEQ ID NOs. 24–3883 and SEQ ID NOs. 7744–19335, the sequences complementary to the sequences of SEQ ID NOs. 24–3883 and SEQ ID NOs. 7744–19335, and fragments comprising at least 12, 15, 18, 20, 23, 25, 28, 30, 35, 40, 50, or 100 consecutive nucleotides of said sequences. In another aspect of this embodiment, the array includes at least one, three, five, ten, fifteen, or twenty sequences selected from the group consisting of SEQ ID NOs. 24–3883 and SEQ ID NOs. 7744–19335, the sequences complementary to the sequences of SEQ ID NOs. 24–3883 and SEQ ID NOs. 7744–19335 and fragments comprising at least 12, 15, 18, 20, 23, 25, 28, 30, 35, 40, 50, or 100 consecutive nucleotides of said sequences.

Another embodiment of the present invention is an enriched population of recombinant nucleic acids, said recombinant nucleic acids comprising an insert nucleic acid and a backbone nucleic acid, wherein at least 0.01%, 0.05%, 0.1%, 0.5%, 1%, 2%, 5%, 10%, or 20% of said insert nucleic acids in said population comprise a sequence selected from the group consisting of SEQ ID NOs. 24–3883 and SEQ ID NOs. 7744–19335 and the sequences complementary to SEQ ID NOs. 24–3883 and SEQ ID NOs. 7744–19335.

Another embodiment of the present invention is a purified or isolated antibody capable of specifically binding to a polypeptide comprising a sequence selected from the group consisting of SEQ ID NOs. 3884–7743.

Another embodiment of the present invention is a purified or isolated antibody capable of specifically binding to a polypeptide comprising at least 6, 8, 10, 12, 15, 18, 20, 23, 25, 28, 30, 35, 40, or 50 consecutive amino acids of a sequence selected from the group consisting of SEQ ID NOs. 3884–7743.

Yet, another embodiment of the present invention is an antibody composition capable of selectively binding to an epitope-containing fragment of a polypeptide comprising a contiguous span of at least 8, 10, 12, 15, 18, 20, 23, 25, 28, 30, 35, 40, or 50 amino acids of any of SEQ ID NOs. 3884–7743, wherein said antibody is polyclonal or monoclonal.

Another embodiment of the present invention is a computer readable medium having stored thereon a sequence selected from the group consisting of a nucleic acid code of SEQ ID NOs. 24–3883 and 7744–19335 and a polypeptide code of SEQ ID NOs. 3884–7743.

Another embodiment of the present invention is a computer system comprising a processor and a data storage device wherein said data storage device has stored thereon a sequence selected from the group consisting of a nucleic acid code of SEQ ID NOs. 24–3883 and 7744–19335 and a polypeptide code of SEQ ID NOs. 3884–7743. In one aspect of this embodiment the computer system further comprises a sequence comparer and a data storage device having reference sequences stored thereon. For example, the sequence comparer may comprise a computer program which indicates polymorphisms. In another aspect of this embodiment, the computer system further comprises an identifier which identifies features in said sequence.

Another embodiment of the present invention is a method for comparing a first sequence to a reference sequence wherein said first sequence is selected from the group consisting of a nucleic acid code of SEQ ID NOs. 24–3883 and 7744–19335 and a polypeptide code of SEQ ID NOs. 3884–7743 comprising the steps of reading said first sequence and said reference sequence through use of a computer program which compares sequences and determining differences between said first sequence and said reference sequence with said computer program. In some aspects of this embodiment, said step of determining differences between the first sequence and the reference sequence comprises identifying polymorphisms.

Another embodiment of the present invention is a method for identifying a feature in a sequence selected from the group consisting of a nucleic acid code of SEQ ID NOs. 24–3883 and 7744–19335 and a polypeptide code of SEQ ID NOs. 3884–7743 comprising the steps of reading said sequence through the use of a computer program which identifies features in sequences and identifying features in said sequence with said computer program.

Another embodiment of the present invention is a vector comprising a nucleic acid according to any one of the nucleic acids described above.

Another embodiment of the present invention is a host cell containing the above vector.

Another embodiment of the present invention is a method of making any of the nucleic acids described above comprising the steps of introducing said nucleic acid into a host cell such that said nucleic acid is present in multiple copies in each host cell and isolating said nucleic acid from said host cell.

Another embodiment of the present invention is a method of making a nucleic acid of any of the nucleic acids described above comprising the step of sequentially linking together the nucleotides in said nucleic acids.

Another embodiment of the present invention is a method of making any of the polypeptides described above wherein said polypeptides is 150 amino acids in length or less comprising the step of sequentially linking together the amino acids in said polypeptide.

Another embodiment of the present invention is a method of making any of the polypeptides described above wherein said polypeptides is 120 amino acids in length or less comprising the step of sequentially linking together the amino acids in said polypeptides.

BRIEF DESCRIPTION OF THE SEQUENCE LISTING

SEQ ID NOs. 1, 3, 5, 7, 9, 11, and 13 are full-length cDNAs prepared using the methods described herein.

SEQ ID NOs. 2, 4 and 6 are the signal peptides encoded by the nucleic acids of SEQ ID NOs. 1, 3 and 5 respectively.

SEQ ID NOs. 8, 10, 12, and 14 are the polypeptides encoded by the nucleic acids of SEQ ID NOs. 7, 9, 11, and 13 respectively.

SEQ ID NOs. 15, 16, 18, 19, 21 and 22 are primers whose use is described in the specification.

SEQ ID NOs. 17, 20, and 23 are the sequences of nucleic acids containing transcription factor binding sites which were obtained as described below.

SEQ ID NOs. 24–383 are nucleic acids having an incomplete ORF which encodes a signal peptide. As used herein, an "incomplete ORF" is an open reading frame in which a start codon has been identified but no stop codon has been identified. The locations of the incomplete ORFs and sequences encoding signal peptides are listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "/" in the signal peptide sequence indicates the location where proteolytic cleavage of the signal peptide occurs to generate a mature protein.

SEQ ID NOs. 384–1338 are nucleic acids having an incomplete ORF in which no sequence encoding a signal peptide has been identified to date. However, it remains possible that subsequent analysis will identify a sequence encoding a signal peptide in these nucleic acids. The locations of the incomplete ORFs are listed in the accompanying Sequence Listing.

SEQ ID NOs. 1339–2059 are nucleic acids having a complete ORF which encodes a signal peptide. As used herein, a "complete ORF" is an open reading frame in which a start codon and a stop codon have been identified. The locations of the complete ORFs and sequences encoding signal peptides are listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "/" in the signal peptide sequence indicates the location where proteolytic cleavage of the signal peptide occurs to generate a mature protein.

SEQ ID NOs. 2060–3883 are nucleic acids having a complete ORF in which no sequence encoding a signal peptide has been identified to date. However, it remains possible that subsequent analysis will identify a sequence encoding a signal peptide in these nucleic acids. The locations of the complete ORFs are listed in the accompanying Sequence Listing.

SEQ ID NOs. 3884–4243 are "incomplete polypeptide sequences" which include a signal peptide. Incomplete polypeptide sequences" are polypeptide sequences encoded by nucleic acids in which a start codon has been identified but no stop codon has been identified. These polypeptides are encoded by the nucleic acids of SEQ ID NOs. 24–383. The location of the signal peptide is listed in the accompanying Sequence Listing.

SEQ ID NOs. 4244–5198 are incomplete polypeptide sequences in which no signal peptide has been identified to date. However, it remains possible that subsequent analysis will identify a signal peptide in these polypeptides. These polypeptides are encoded by the nucleic acids of SEQ ID NOs. 384–1338.

SEQ ID NOs. 5199–5919 are "complete polypeptide sequences" which include a signal peptide. "Complete polypeptide sequences" are polypeptide sequences encoded by nucleic acids in which a start codon and a stop codon have been identified. These polypeptides are encoded by the nucleic acids of SEQ ID NOs. 1339–2059. The location of the signal peptide is listed in the accompanying Sequence Listing.

SEQ ID NOs. 5920–7743 are complete polypeptide sequences in which no signal peptide has been identified to date. However, it remains possible that subsequent analysis will identify a signal peptide in these polypeptides. These polypeptides are encoded by the nucleic acids of SEQ ID NOs.2060–3883.

SEQ ID NOs. 7744–19335 are nucleic acid sequences in which no open reading frame of at least 150 nucleotides has been conclusively identified to date. However, it remains possible subsequent analysis will identify an open reading frame in these nucleic acids.

In the accompanying Sequence Listing, all instances of the symbol "n" in the nucleic acid sequences mean that the nucleotide can be adenine, guanine, cytosine or thymine. In some instances the polypeptide sequences in the Sequence Listing contain the symbol "Xaa." These "Xaa" symbols indicate either (1) a residue which cannot be identified because of nucleotide sequence ambiguity or (2) a stop codon in the determined sequence where applicants believe one should not exist (if the sequence were determined more accurately). In some instances, several possible identities of the unknown amino acids may be suggested by the genetic code.

In the case of secreted proteins, it should be noted that, in accordance with the regulations governing Sequence Listings, in the appended Sequence Listing, the encoded protein (i.e. the protein containing the signal peptide and the mature protein or part thereof) extends from an amino acid residue having a negative number through a positively numbered amino acid residue. Thus, the first amino acid of the mature protein resulting from cleavage of the signal peptide is designated as amino acid number 1, and the first amino acid of the signal peptide is designated with the appropriate negative number.

BRIEF DESCRIPTION OF THE DRAWINGS

FIG. 2 is an analysis of the 43 amino terminal amino acids of all human SwissProt proteins to determine the frequency of false positives and false negatives using the techniques for signal peptide identification described herein.

FIG. 5 describes the transcription factor binding sites present in each of the promoters of FIG. 4.

FIG. 10 is a table describing algorithms, parameters and criteria that can be used for each step of extended cDNA analysis.

DETAILED DESCRIPTION OF THE PREFERRED EMBODIMENT

Figure 1:
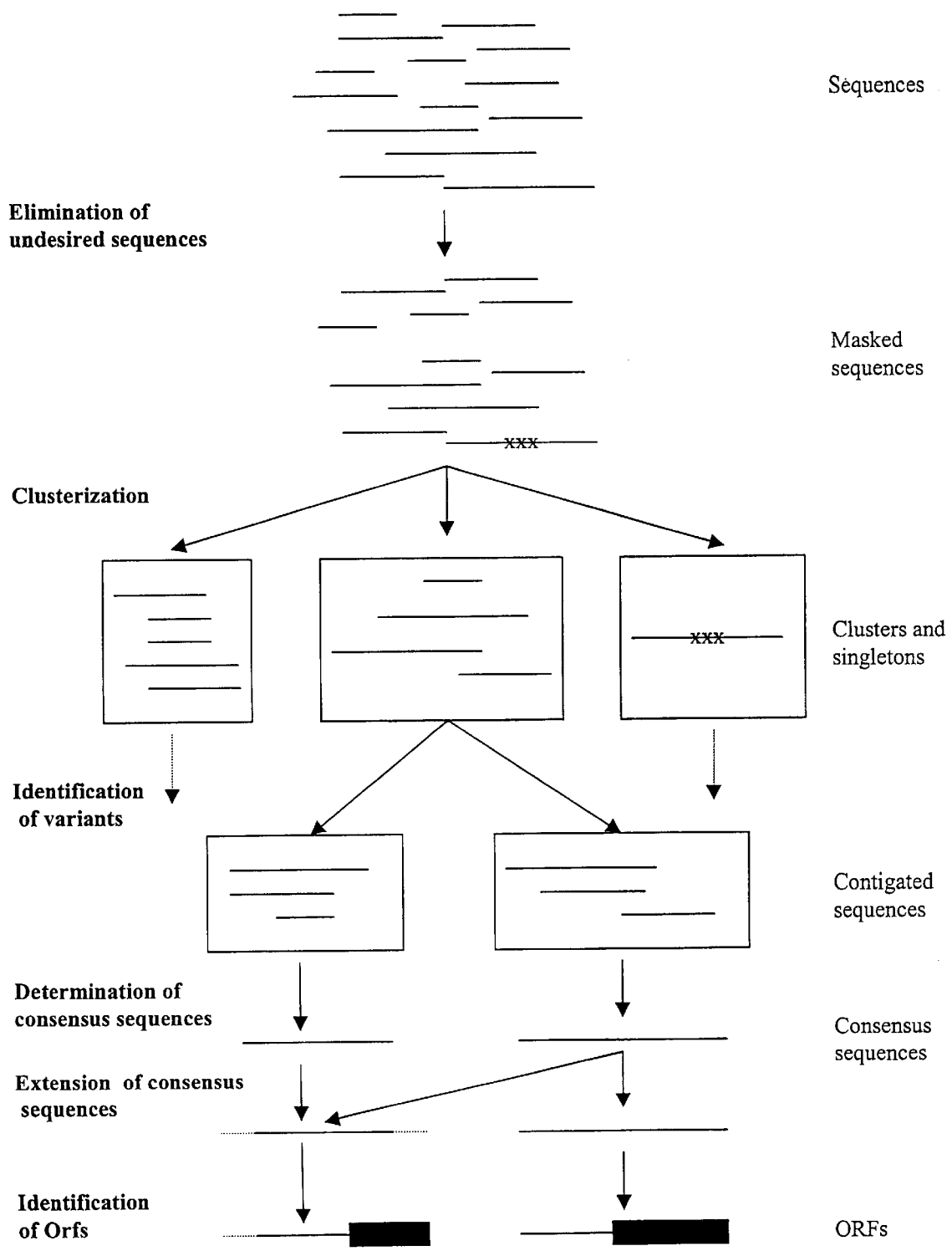
FIG. 1 summarizes the computer analysis procedure for obtaining consensus contigated ESTs.

1. General Methods for Obtaining 5' ESTs Derived From mRNAs With Intact 5' ends

The 5' ESTs of the present invention were obtained from cDNA libraries derived from mRNAs having intact 5' ends as described in Examples 1 to 5 using either a chemical or enzymatic approach.

EXAMPLE 1

Preparation of mRNA

Total human RNAs or polyA+ RNAs derived from different tissues were respectively purchased from LABIMO and CLONTECH and used to generate cDNA libraries as described below. The purchased RNA had been isolated from cells or tissues using acid guanidium thiocyanate-phenol-chloroform extraction (Chomczyniski and Sacchi, *Analytical Biochemistry* 162:156–159, 1987). PolyA+ RNA was isolated from total RNA (LABIMO) by two passes of oligo dT chromatography, as described by Aviv and Leder, *Proc. Natl. Acad. Sci. USA* 69:1408–1412, 1972) in order to eliminate ribosomal RNA.

The quality and the integrity of the polyA+ RNAs were checked. Northern blots hybridized with a probe corresponding to an ubiquitous mRNA, such as elongation factor 1 or elongation factor 2, were used to confirm that the mRNAs were not degraded. Contamination of the polyA+ mRNAs by ribosomal sequences was checked using Northern blots and a probe derived from the sequence of the 28S rRNA. Preparations of mRNAs with less than 5% of rRNAs were used in library construction. To avoid constructing libraries with RNAs contaminated by exogenous sequences (prokaryotic or fungal), the presence of bacterial 16S ribosomal sequences and of two highly expressed fungal mRNAs was examined using PCR.

EXAMPLE 2

Methods for Obtaining mRNAs Having Intact 5' Ends

Following preparation of the mRNAs from various tissues as described above, selection of mRNA with intact 5' ends and specific attachment of an oligonucleotide tag to the 5' end of said mRNA is performed using either a chemical or enzymatic approach. Both techniques take advantage of the presence of the "cap" structure, which characterizes the 5' end of intact mRNAs and which comprises a guanosine generally methylated once, at the 7 position.

The chemical modification approach involves the optional elimination of the 2',3'-cis diol of the 3' terminal ribose, the oxidation of the 2',3', -cis diol of the ribose linked to the cap of the 5' ends of the mRNAs into a dialdehyde, and the coupling of the said obtained dialdehyde to a derivatized oligonucleotide tag. Further detail regarding the chemical approaches for obtaining mRNAs having intact 5' ends are disclosed in International Application No. WO96/34981, published Nov. 7, 1996, the disclosure of which is incorporated herein by reference in its entirety.

The enzymatic approach for ligating the oligonucleotide tag to the 5' ends of mRNAs with intact 5' ends involves the removal of the phosphate groups present on the 5' ends of uncapped incomplete mRNAs, the subsequent decapping of mRNAs with intact 5' ends and the ligation of the phosphate present at the 5' end of the decapped mRNA to an oligonucleotide tag. Further detail regarding the enzymatic approaches for obtaining mRNAs having intact 5' ends are disclosed in Dumas Milne Edwards J. B. (Doctoral Thesis of Paris VI University, Le clonage des ADNc complets: difficultes et perspectives nouvelles. Apports pour l'etude de la regulation de l'expression de la tryptophane hydroxylase de rat, Dec. 20, 1993), EPO 625572 and Kato et al., *Gene*

150:243–250 (1994), the disclosures of which are incorporated herein by reference in their entireties.

In either the chemical or the enzymatic approach, the oligonucleotide tag has a restriction enzyme site (e.g. EcoRI sites) therein to facilitate later cloning procedures. Following attachment of the oligonucleotide tag to the mRNA, the integrity of the mRNA was then examined by performing a Northern blot using a probe complementary to the oligonucleotide tag.

EXAMPLE 3 cDNA Synthesis Using mRNA Templates Having Intact 5' Ends

For the mRNAs joined to oligonucleotide tags using either the chemical or the enzymatic method, first strand cDNA synthesis was performed using a thermostable reverse transcriptase with an oligo-dT primer. In some instances, this oligo-dT primer contained an internal tag of at least 4 nucleotides which is different from one tissue to the other. In order to protect internal EcoRI sites in the cDNA from digestion at later steps in the procedure, methylated dCTP was used for first strand synthesis. After removal of RNA by an alkaline hydrolysis, the first strand of cDNA was precipitated using isopropanol in order to eliminate residual primers.

The second strand of the cDNA was then synthesized with a Klenow fragment using a primer corresponding to the 5' end of the ligated oligonucleotide. Preferably, the primer is 20–25 bases in length. Methylated dCTP was also used for second strand synthesis in order to protect internal EcoRI sites in the cDNA from digestion during the cloning process.

EXAMPLE 4

Cloning of cDNAs Derived From mRNA With Intact 5' Ends

Following second strand synthesis, the cDNAs were cloned into the phagemid pBlueScript II SK⁻ vector (Stratagene) or one of its derivative. The ends of the cDNAs were blunted with T4 DNA polymerase (Biolabs) and the cDNA was digested with EcoRI. Since methylated dCTP was used during cDNA synthesis, the EcoRI site present in the tag was the only hemi-methylated site, hence the only site susceptible to EcoRI digestion. In some instances, to facilitate subcloning, an HindIII adaptor was added to the 3' end of cDNAs.

The cDNAs were then size fractionated using either exclusion chromatography (AcA, Biosepra) or electrophoretic separation which yields 3 or 6 different fractions. The cDNAs were then directionally cloned either into pBlueScript using either the EcoRI and SmaI restriction sites or the EcoRI and HindIII restriction sites when the HindIII adaptor was present in the cDNAs. The ligation mixture was electroporated into bacteria and propagated under appropriate antibiotic selection.

EXAMPLE 5

Selection of Clones Having the Oligonucleotide Tag Attached Thereto

Clones containing the oligonucleotide tag attached to cDNAs were then selected as follows.

The plasmid DNAs containing cDNA libraries made as described above were purified (Qiagen). A positive selection of the tagged clones was performed as follows. Briefly, in this selection procedure, the plasmid DNA was converted to single stranded DNA using gene II endonuclease of the phage F1 in combination with an exonuclease (Chang et al., *Gene* 127:95–8, 1993) such as exonuclease III or T7 gene 6 exonuclease. The resulting single stranded DNA was then purified using paramagnetic beads as described by Fry et al., *Biotechniques*, 13: 124–131, 1992. In this procedure, the single stranded DNA was hybridized with a biotinylated oligonucleotide having a sequence corresponding to the 3' end of the oligonucleotide tag described in Example 2. Preferably, the primer has a length of 20–25 bases. Clones including a sequence complementary to the biotinylated oligonucleotide were captured by incubation with streptavidin coated magnetic beads followed by magnetic selection. After capture of the positive clones, the plasmid DNA was released from the magnetic beads and converted into double stranded DNA using a DNA polymerase such as the ThermoSequenase obtained from Amersham Pharmacia Biotech. Alternatively, protocols such as the Gene Trapper kit (Gibco BRL) may be used. The double stranded DNA was then electroporated into bacteria. The percentage of positive clones having the 5' tag oligonucleotide was estimated to typically rank between 90 and 98% using dot blot analysis.

Following electroporation, the libraries were ordered in 384-microtiter plates (MTP). A copy of the MTP was stored for future needs. Then the libraries were transferred into 96 MTP and sequenced.

EXAMPLE 6

Sequencing of Inserts in Selected Clones

Plasmid inserts were first amplified by PCR on PE-9600/PE-9700 thermocyclers (PE Biosystems, Applied Biosystems Division, Foster City, Calif.) or tetrades thermocyclers (MJ Research), using L7AF3 and SETA primers (Genset SA), ExTaq polymerase (Takara), dNTPs (Boehringer), buffer and cycling conditions as recommended by the PE Biosystems Corporation. PCR products were then sequenced using MegaBace Capillary sequencers (Molecular Dynamics). Sequencing reactions were performed using PE 9600/PE-9700 thermocyclers with ET primer (Energy Transfer) chemistry and ThermoSequenase (Amersham Pharmacia Biotech). The primer used was Reverse Primer (RP) (Amersham Pharmacia Biotech) as appropriate. The dNTPs and ddNTPs used in the sequencing reactions were purchased from Boehringer. Sequencing buffer, reagent concentrations and cycling conditions were as recommended by Amersham. Following the sequencing reaction, the samples were purified with Sephadex (G50) and injected in the capillaries of the MegaBace. Injection was performed for 12 seconds at 10000 V and electrophoresis for 100 minutes at 1000V. The sequence data were collected and analyzed using the Instrument Control Manager analysis software of the MegaBace prior to the Genset's proprietary sequence verification software.

Alternatively, plasmid inserts were first amplified by PCR on PE-9600 thermocyclers (PE Biosystems, Applied Biosystems Division, Foster City, Calif.), using standard SETA-A and SETA-B primers (Genset SA), AmpliTaqGold (PE Biosystems), dNTPs (Boehringer), buffer and cycling conditions as recommended by the PE Biosystems Corporation. PCR products were then sequenced using automatic ABI Prism 377 sequencers (PE Biosystems). Sequencing reactions were performed using PE 9600 thermocyclers with standard dye-primer chemistry and ThermoSequenase (Amersham Pharmacia Biotech). The primers used were either T7 or 21M13 (available from Genset SA) as appropriate. The primers were labeled with the JOE, FAM, ROX and TAMRA dyes. The dNTPs and ddNTPs used in the sequencing reactions were purchased from Boehringer. Sequencing buffer, reagent concentrations and cycling conditions were as recommended by Amersham. Following the sequencing reaction, the samples were precipitated with ethanol, resuspended in formamide loading buffer, and loaded on a standard 4% acrylamide gel. Electrophoresis was performed for 2.5 hours at 3000V on an ABI 377 sequencer, and the sequence data were collected and analyzed using the ABI Prism DNA Sequencing Analysis Software, version 2.1.2.

II. Computer Analysis of the Isolated 5' ESTs

The sequence data from the different cDNA libraries made as described above were transferred to a database, where quality control and validation steps were performed. A base-caller, working using a Unix system, automatically flagged suspect peaks, taking into account the shape of the peaks, the inter-peak resolution, and the noise level. The proprietary base-caller also performed an automatic trimming. Any stretch of 25 or fewer bases having more than 4 suspect peaks was considered unreliable and was discarded. Sequences corresponding to cloning vector or ligation oligonucleotides were automatically removed from the 5' EST sequences. However, the resulting 5' EST sequences may contain 1 to 5 bases belonging to the above mentioned sequences at their 5' end. If needed, these can easily be removed on a case to case basis.

Following sequencing as described above, the sequences of the 5ESTs were entered in a database for storage and manipulation as described below and as depicted in FIG. 1. Before searching the 5' ESTs in the database for sequences of interest, 5' ESTs derived from mRNAs which were not of interest were identified. Briefly, such undesired sequences may be of three types. First, contaminants of either endogenous (ribosomal RNAs, transfert RNAs, mitochondrial RNAs) or exogenous (prokaryotic RNAs and fungal RNAs) origins were identified. Second, uninformative sequences, namely redundant sequences, small sequences and highly degenerate sequences were identified. Third, repeated sequences (Alu, L1, THE and MER repeats, SSTR sequences or satellite, micro-satellite, or telomeric repeats) were identified and masked in further processing.

Then, in order to determine the accuracy of the sequencing procedure as well as the efficiency of the 5' selection described above, the analyses described in Examples 7 and 8 respectively were performed on 5' ESTs.

EXAMPLE 7

Measurement of Sequencing Accuracy by Comparison to Known Sequences

To further determine the accuracy of the sequencing procedure described in Example 6, the sequences of 5' ESTs derived from known sequences were identified and compared to the original known sequences. First, a FASTA analysis with overhangs shorter than 5 bp on both ends was conducted on the 5' ESTs to identify those matching an entry in the public human mRNA database available at the time of filing the present documents. The 5' ESTs which matched a known human mRNA were then realigned with their cognate mRNA and dynamic programming was used to include substitutions, insertions, and deletions in the list of "errors" which would be recognized. Errors occurring in the last 10 bases of the 5' EST sequences were ignored to avoid the inclusion of spurious cloning sites in the analysis of sequencing accuracy. This analysis revealed that the sequences incorporated in the database had an accuracy of more than 99.3% using Megabaces Capillary sequencers and more than 99.5% using ABI 377 sequencers.

EXAMPLE 8

Determination of Efficiency of 5' EST Selection

To determine the efficiency at which the above selection procedures isolated cDNAs which include the 5' ends of their corresponding mRNAs, the sequences of 5' ESTs were aligned with a reference pool of complete mRNA/cDNA extracted from the EMBL release 57 using the FASTA algorithm. The reference mRNA/cDNA starting at the most 5' transcription start site was obtained, and then compared to the 5' transcription start site position of the 5' EST. More than 75% of 5' ESTs had their 5' ends close to the 5' ends of the known sequence. As some of the mRNA sequences available in the EMBL database are deduced from genomic sequences, a 5' end matching with these sequences will be counted as an internal match. Thus, the method used here underestimates the yield of 5' ESTs including the authentic 5' ends of their corresponding mRNAs.

EXAMPLE 9

Generation of Consensus Contigated 5' ESTs

Since the cDNA libraries made above include multiple 5' ESTs derived from the same mRNA, overlapping 5' ESTs may be assembled into continuous sequences. The following method describes how to efficiently align multiple 5' ESTs in order to yield not only consensus contigated 5' EST sequences for mRNAs derived from different genes but also consensus contigated 5' EST sequences for different mRNAs, so called variants, transcribed from the same gene such as alternatively spliced mRNAs.

A subset of 5' ESTs free from endogenous contaminants and uninformative sequences, and following the masking of repeats, was first selected.

This whole set of sequences was first partitioned into small clusters containing sequences which exhibited perfect matches with each other on a given length and which derived from a small number of different genes. Some 5' EST sequences, so called singletons, were not aligned using this approach because they were not homologous to any other sequence.

Thereafter, all variants of a given gene were identified in each cluster using a proprietary software. 5' EST sequences belonging to the same variant were then contigated and consensus contigated 5' EST sequences generated for each variant. All consensus contigated 5' EST sequences were subsequently compared to the whole set of individual 5' EST sequences used to obtained them.

If desired, the consensus contigated 5' EST sequences may be verified by identifying clones in nucleic acid samples derived from biological tissues, such as cDNA libraries, which hybridize to the probes based on the sequences of the consensus contigated 5' ESTs using any methods described herein and sequencing those clones.

To assess the yield of new sequences, the 5' ESTs obtained and consensus contigated 5' ESTs were compared to all known complete human mRNAs extracted from the EMBL release 58 using BLASTN with the following parameters S=1000, S2=1000, V=5 and B=5. All sequences with high scoring pairs whose significance was above e-100 were kept. Then, the obtained 5' ESTs and consensus contigated 5' ESTs were compared to all the human proteins extracted from SwissProt release 37, TrEMBL release 58 and Genseqp (Derwent's database of patented amino acid sequences) release 35.3 on both strands using blastx with the following parameters: S=450, S2=450, V=5 and B=5. All sequences with high scoring pairs whose significance was above e-50 were kept. Using this process, about 86% of 5' ESTs or consensus assembled 5' ESTs were considered unidentified.

EXAMPLE 10

Identification of the Most Probable Open Reading Frame of 5' ESTs

Subsequently, consensus contigated 5' ESTs and 5' ESTs were screened to identify those having an open reading frame (ORF).

The nucleic acid sequence was first divided into several subsequences which coding propensity was evaluated separately using one or several different methods known to those skilled in the art such as the evaluation of N-mer frequency and its variants (Fickett and Tung, *Nucleic Acids Res*; 20:6441–50 (1992)) or the Average Mutual Information method (Grosse et al, International Conference on Intelligent Systems for Molecular Biology, Montreal, Canada. Jun. 28–Jul. 1, 1998). Each of the scores obtained by the techniques described above were then normalized by their distribution extremities and then fused using a neural network into a unique score that represents the coding probability of a given subsequence. The coding probability scores obtained for each subsequence, thus the probability score profiles obtained for each reading frame, was then linked to the initiation codons present on the sequence. For each open reading frame, defined as a nucleic acid sequence beginning with an ATG codon, an ORF score was determined. Preferably, this score is the sum of the probability scores computed for each subsequence corresponding to the considered ORF in the correct reading frame corrected by a function that negatively accounts for locally high score values and positively accounts for sustained high score values. The most probable ORF with the highest score was selected.

Alternatively, open reading frames were simply defined as uninterrupted nucleic acid sequences longer than 150 nucleotides and beginning with an ATG codon.

In some embodiments, nucleic acid sequences encoding an "incomplete ORF", as described herein, namely an open reading frame in which a start codon has been identified but no stop codon has been identified, were obtained.

In other embodiments, nucleic acid sequences encoding a "complete ORF", as used herein, namely an open reading frame in which a start codon and a stop codon have been identified, are obtained.

In a preferred embodiment, open reading frames encoding polypeptides of at least 50 amino acids were obtained.

To confirm that the chosen ORF actually encodes a polypeptide, the consensus contigated 5' EST or 5' EST may be used to obtain an extended cDNA using any of the techniques described herein, and especially those described in Examples 17 and 18. Then, such obtained extended cDNAs may be screened for the most probable open reading frame using any of the techniques described herein. The amino acid sequence of the ORF encoded by the consensus contigated 5' EST or 5' EST may then be compared to the amino acid sequence of the ORF encoded by the extended cDNA using any of the algorithms and parameters described herein in order to determine whether the ORF encoded by the extended cDNA is basically the same as the one encoded by the consensus contigated 5' EST or 5' EST.

Alternatively, to confirm that the chosen ORF actually encodes a polypeptide, the consensus contigated 5' EST or 5' EST may be used to obtain an extended cDNA using any of the techniques described herein, and especially those described in Examples 17 and 18. Such an extended cDNA may then be inserted into an appropriate expression vector and used to express the polypeptide encoded by the extended cDNA as described herein. The expressed polypeptide may be isolated, purified, or enriched as described herein. Several methods known to those skilled in the art may then be used, including in combination, to determine whether the expressed polypeptide is the one actually encoded by the chosen ORF, herein referred to as the expected polypeptide. Such methods are based on the determination of predictable features of the expressed polypeptide, including but not limited to its amino acid sequence, its size or its charge, and the comparison of these features to those predicted for the expected polypeptide. The following paragraphs present examples of such methods.

One of these methods involves the determination of at least a portion of the amino acid sequence of the expressed polypeptide using any technique known to those skilled in the art. For example, the amino-terminal residues may be determined using automated techniques based on Edman's degradation of polypeptides in which N-terminal residues are sequentially labeled and cleaved from the polypeptide of interest (see Stryer, Exploring proteins in Biochemistry, Freeman and Company, New York, (1995)). The amino acid sequence of the expressed polypeptide may then be compared to the one predicted for the expected polypeptide using any algorithm and parameters described therein.

Alternatively, the size of the expressed polypeptides may be determined using techniques familiar to those skilled in the art such as Coomassie blue or silver staining and subsequently compared to the size predicted for the expected polypeptide. Generally, the band corresponding to the expressed polypeptide will have a mobility near that expected based on the number of amino acids in the open reading frame of the extended cDNA. However, the band may have a mobility different than that expected as a result of modifications such as glycosylation, ubiquitination,or enzymatic cleavage.

Alternatively, specific antibodies or antipeptides may be generated against the expected polypeptideas described in Example 33 and used to perform immunoblotting or immunoprecipitationstudies against the expressed polypeptide. The presence of a band in samples from cells containing the expression vector with the extended cDNA which is absent in samples from cells containing the expression vector encoding an irrelevant polypeptide indicates that the expected polypeptide or portion thereof is being expressed. Generally, the band corresponding to the expressed polypeptide will have a mobility near that expected based on the number of amino acids in the open reading frame of the extended cDNA. However, the band may have a mobility different than that expected as a result of modifications such as glycosylation, ubiquitination, or enzymatic cleavage.

EXAMPLE 11

Identification of Potential Signal Sequences in 5' ESTs

The 5' ESTs or consensus contigated 5' ESTs found to include an ORF were then searched to identify potential signal motifs using slight modifications of the procedures disclosed in Von Heijne, *Nucleic Acids Res.* 14:4683–4690, 1986. Those sequences encoding a peptide with a score of at least 3.5 in the Von Heijne signal peptide identification matrix were considered to possess a signal sequence.

EXAMPLE 12

Confirmation of Accuracy of Identification of Potential Signal Sequences in 5' ESTs The accuracy of the above procedure for identifying signal sequences encoding signal peptides was evaluated by applying the method to the 43 amino acids located at the N terminus of all human SwissProt proteins. The computed Von Heijne score for each protein was compared with the known characterization of the protein as being a secreted protein or a non-secreted protein. In this manner, the number of non-secreted proteins having a score higher than 3.5 (false positives) and the number of secreted proteins having a score lower than 3.5 (false negatives) could be calculated.

Using the results of the above analysis, the probability that a peptide encoded by the 5' region of the mRNA is in fact a genuine signal peptide based on its Von Heijne's score was calculated based on either the assumption that 10% of human proteins are secreted or the assumption that 20% of human proteins are secreted. The results of this analysis are shown in FIG. 2.

Using the above method of identification of secretory proteins, 5' ESTs of the following polypeptides known to be secreted were obtained: human glucagon, gamma interferon induced monokine precursor, secreted cyclophilin-like protein, human pleiotropin, and human biotinidase precursor. Thus, the above method successfully identified those 5' ESTs which encode a signal peptide.

To confirm that the signal peptide encoded by the 5' ESTs or consensus contigated 5' ESTs actually functions as a signal peptide, the signal sequences from the 5' ESTs or consensus contigated 5' ESTs may be cloned into a vector designed for the identification of signal peptides. Such vectors are designed to confer the ability to grow in selective medium only to host cells containing a vector with an operably linked signal sequence. For example, to confirm that a 5' EST or consensus contigated 5' EST encodes a genuine signal peptide, the signal sequence of the 5' EST or consensus contigated 5' EST may be inserted upstream and in frame with a non-secreted form of the yeast invertase gene in signal peptide selection vectors such as those described in U.S. Pat. No. 5,536,637. Growth of host cells containing signal sequence selection vectors with the correctly inserted 5' EST or consensus contigated 5' EST signal sequence confirms that the 5' EST or consensus contigated 5' ESTs encodes a genuine signal peptide.

Alternatively, the presence of a signal peptide may be confirmed by cloning the extended cDNAs obtained using the ESTs or consensus contigated 5' ESTs into expression vectors such as pXT1 as described below, or by constructing promoter-signal sequence-reporter gene vectors which encode fusion proteins between the signal peptide and an assayable reporter protein. After introduction of these vectors into a suitable host cell, such as COS cells or NIH 3T3 cells, the growth medium may be harvested and analyzed for the presence of the secreted protein. The medium from these cells is compared to the medium from control cells containing vectors lacking the signal sequence or extended cDNA insert to identify vectors which encode a functional signal peptide or an authentic secreted protein.

EXAMPLE 13

Analysis of the Sequences of the Invention

The set of the nucleic acid sequences of the invention (SEQ ID NOs. 24–3883 and 7744–19335) was obtained as described in Example 9. Subsequently, the most probable open reading frame was determined and signal sequences were searched, as described in Examples 10 and 11, for all sequences of the invention.

The nucleotide sequences of the SEQ ID NOs. 24–3883 and 7744–19335 and the preferred polypeptides sequences encoded by SEQ ID NOs. 24–3883 (i.e. polypeptide sequences of SEQ ID NOs. 3884–7743) are provided in the appended sequence listing. In addition, for each of the nucleic acid sequences of the invention as referred to by its sequence identification number in the first column, Table I provides the positions of the first and last codons for each of the corresponding open reading frames in the second column.

For each of the consensus contigated 5' ESTs of the invention as referred to by its sequence identification number in the first column of Table II, the second column gives a list of the positions of the biological 5' ESTs which were used to obtain this consensus contigated 5' EST. For example, if the first column indicates 250 and the second column indicates 1–120; 6–230; 200–350, this means that the consensus contigated 5' ESTs of SEQ ID NO:250 was computed from 3 different 5' ESTs, the first one matching from positions 1 to 120 of the consensus contigated 5' EST, the second one from positions 6 to 230 of the consensus contigated 5' EST, and the third one from positions 200 to 350 of the consensus contigated 5' EST.

If one of the nucleic acid sequences of SEQ ID NOs. 24–3883 and 7744–19335 is suspected of containing one or more incorrect or ambiguous nucleotides, the ambiguities can readily be resolved by resequencing a fragment containing the nucleotides to be evaluated. If one or more incorrect or ambiguous nucleotides are detected, the corrected sequences should be included in the clusters from which the sequences were isolated, and used to compute other consensus contigated sequences on which other ORFs would be identified. Nucleic acid fragments for resolving sequencing errors or ambiguities may be obtained from deposited clones or can be isolated using the techniques described herein. Resolution of any such ambiguities or errors may be facilitated by using primers which hybridize to sequences located close to the ambiguous or erroneous sequences. For example, the primers may hybridize to sequences within 50–75 bases of the ambiguity or error. Upon resolution of an error or ambiguity, the corresponding corrections can be made in the protein sequences encoded by the DNA containing the error or ambiguity. The amino acid sequence of the protein encoded by a particular clone can also be determined by expression of the clone in a suitable host cell, collecting the protein, and determining its sequence.

In addition, if one of the sequences of SEQ ID NOs. 3884–7743 is suspected of containing a truncated ORF as the result of a frameshift in the sequence, such frameshifting errors may be corrected by combining the following two approaches. The first one involves thorough examination of all double predictions, i.e. all cases where the probability scores as defined in Example 10 for two ORFs located on different reading frames are high and close; preferably different by less than 0.4. The fine examination of the region where the two possible ORFs overlap may help to detect the frameshift. In the second approach, homologies with known proteins are used to correct suspected frameshifts.

Of the identified clusters, some were shown to be multivariant, i.e. to contain several variants of the same gene. Table III gives for each of the multivariant clusters named by its internal reference (first column), the list of all variant consensus contigated 5' ESTs (second column), each being represented by a different sequence identification number.

EXAMPLE 14

Categorization of 5' ESTs and Consensus Contigated 5' ESTs

The nucleic acid sequences of the present invention (SEQ ID NOs. 24–3883 and 7744–19335) were grouped based on their homology to known sequences as follows. All sequences were compared to the nucleic acid sequences of all vertebrates present in the EMBL release 58 and Genseqn (Derwent's database of patented nucleic acids) releases 35.3 or release 36. It should be noted that, because of the large number of sequences of the invention, the comparison of the polynucleotides of the invention to public sequences was done in a time frame of 15 days, meaning that the first sequences were compared to Geneseqn release 35.3 and the last ones with Geneseqn release 36. The comparison to EMBL vertebrate sequences was performed after masking of repeated sequences and using blastn with the parameters S=108 and X=16 followed by fasta. The comparison to Geneseqn was performed after masking of repeated sequences and using blastn with the parameters S=108 and X=16.

All matches with a minimum of 30 nucleotides with 95% identity or 100% identity were retrieved and used to compute Tables IVa and IVb respectively. Tables IVa and IVb give for each sequence of the invention referred to by its sequence identification number in the first column, the positions of their preferred fragments in the second column entitled "Positions of preferred fragments." These preferred fragments are novel fragments which do not match any publicly available vertebrate sequence according to the algorithm, parameters and criteria defined above. As used herein the term "polynucleotides described in Tables IVa and IVb" refers to all of the preferred polynucleotide fragments defined in Tables IVa and IVb in this manner.

The term "polynucleotides described in Tables IVa and IVb updated" refers to all of the preferred polynucleotide fragments defined in manner described above except that the most recent updates of the EMBL and Derwent databases are used to define the preferred fragments as of the filing date of the instant application.

The present invention encompasses isolated, purified, or recombinant nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Tables IVa and IVb, or a sequence complementary thereto, wherein said polynucleotide described in Tables IVa and IVb is selected individually or in any combination from the polynucleotides described in Tables IVa and IVb. In particular, the present invention encompasses isolated, purified, or recombinant vertebrate nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Tables IVa and IVb, or a sequence complementary thereto, wherein said polynucleotide described in Tables IVa and IVb is selected individually or in any combination from the polynucleotides described in Tables IVa and IVb. In particular, the present invention encompasses isolated, purified, or recombinant human nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Tables IVa and IVb, or a sequence complementary thereto, wherein said polynucleotide described in Tables IVa and IVb is selected individually or in any combination from the polynucleotides described in Tables IVa and IVb.

The present invention also encompasses isolated, purified, or recombinant nucleic acids which comprise, consist of, or consist essentially of a polynucleotide described in Tables IVa and IVb, or a sequence complementary thereto, wherein said polynucleotide is selected individually or in any combination from the polynucleotides described in Tables IVa and IVb. In particular, the present invention encompasses isolated, purified, or recombinant vertebrate nucleic acids which comprise, consist of, or consist essentially of a polynucleotide described in Tables IVa and IVb, or a sequence complementary thereto, wherein said polynucleotide is selected individually or in any combination from the polynucleotides described in Tables IVa and IVb. In particular, the present invention encompasses isolated, purified, or recombinant human nucleic acids which comprise, consist of, or consist essentially of a polynucleotide described in Tables IVa and IVb, or a sequence complementary thereto, wherein said polynucleotide is selected individually or in any combination from the polynucleotides described in Tables IVa and IVb.

The present invention encompasses isolated, purified, or recombinant nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Tables IVa and IVb, or a sequence complementary thereto, wherein said polynucleotide described in Tables IVa and IVb is selected individually or in any combination from the polynucleotides described in Tables IVa and IVb updated. In particular, the present invention encompasses isolated, purified, or recombinant vertebrate nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Tables IVa and IVb, or a sequence complementary thereto, wherein said polynucleotide described in Tables IVa and IVb is selected individually or in any combination from the polynucleotides described in Tables IVa and IVb updated. In particular, the present invention encompasses isolated, purified, or recombinant human nucleic acids which consist of, consist essentially of, or comprise a contiguous span of at least 8, 10, 12, 15, 18, 20, 25, 35, 40, 50, 70, 80, 100, 250, or 500 nucleotides in length, to the extent that a contiguous span of these lengths is consistent with the lengths of the particular polynucleotide, of a polynucleotide described in Tables IVa and IVb, or a sequence complementary thereto, wherein said polynucleotide described in Tables IVa and IVb is selected individually or in any combination from the polynucleotides described in Tables IVa and IVb updated.

The present invention also encompasses isolated, purified, or recombinant nucleic acids which comprise, consist of, or consist essentially of a polynucleotide described in Tables IVa and IVb, or a sequence complementary thereto, wherein said polynucleotide is selected individually or in any combination from the polynucleotides described in Tables IVa and IVb updated. In particular, the present invention encompasses isolated, purified, or recombinant vertebrate nucleic acids which consist of or consist essentially of a polynucleotide described in Tables IVa and IVb, or a sequence complementary thereto, wherein said polynucleotide is selected individually or in any combination from the polynucleotides described in Tables IVa and IVb updated. In particular, the present invention encompasses isolated, purified, or recombinant human nucleic acids which consist of or consist essentially of a polynucleotide described in Tables IVa and IVb, or a sequence complementary thereto, wherein said polynucleotide is selected individually or in any combination from the polynucleotides described in Tables IVa and IVb updated.

III. Evaluation of Spatial and Temporal Expression of mRNAs Corresponding to the 5' ESTs or Extended cDNAs Each of the SEQ ID NOs. 24–3883 and 7744–19335 was also categorized based on the tissue from which its corresponding mRNA was obtained, as described below in Example 15.

EXAMPLE 15

Expression Patterns of mRNAs From Which the 5' ESTs Were Obtained

Table V shows the spatial distribution of each nucleic acid sequence of the invention (SEQ ID NOs. 24–3883 and 7744–19335) referred to by its internal designation in the first column and the number of individual 5' ESTs used to assemble the consensus contigated 5' ESTs per tissue in the second column. A singleton is thus represented by a single 5' EST from a single tissue. Each type of tissue listed in Table V is encoded by a letter. The correspondence between the letter code and the tissue type is given in Table VI. For example, if the first column contains 47 and the second column contains the following list: A:1 C:4 F:3, this means that the consensus contigated 5' EST of SEQ ID NO. 47 was obtained from one 5' EST from brain, four 5' ESTs from fetal kidney, and three 5' ESTs from liver.

The bias in spatial distribution of the sequences of the invention was examined by comparing the relative proportions of the biological 5' ESTs of a given tissue in each cluster using the following statistical analysis. The under- or over-representation of 5' ESTs of a given cluster in a given tissue was performed using the normal approximation of the binomial distribution. When the observed proportion of 5' ESTs of a given tissue in a given consensus had less than 1% chance to occur randomly according to the chi2 test, the frequency bias was reported as "low" or "high". The results are given in Table VII as follows. For each consensus contigated 5' ESTs showing a bias in tissue distribution as referred to by its sequence identification number in the first column, the list of tissues where some 5' ESTs were under-represented is given in the second column entitled "low frequency" and the list of tissues where some 5' ESTs are over-represented is given in the third column entitled "high frequency".

In addition to categorizing the 5' ESTs and consensus contigated 5' ESTs with respect to their tissue of origin, the spatial and temporal expression patterns of the mRNAs corresponding to the 5' ESTs and consensus contigated 5' ESTs, as well as their expression levels, may be determined as described in Example 16 below.

Characterization of the spatial and temporal expression patterns and expression levels of these mRNAs is useful for constructing expression vectors capable of producing a desired level of gene product in a desired spatial or temporal manner, as will be discussed in more detail below.

Furthermore, 5' ESTs and consensus contigated 5' ESTs whose corresponding mRNAs are associated with disease states may also be identified. For example, a particular disease may result from the lack of expression, over expression, or under expression of a mRNA corresponding to a 5' EST or consensus contigated 5' EST. By comparing mRNA expression patterns and quantities in samples taken from healthy individuals with those from individuals suffering from a particular disease, 5' ESTs or consensus contigated 5' ESTs responsible for the disease may be identified.

It will be appreciated that the results of the above characterization procedures for 5' ESTs and consensus contigated 5' ESTs also apply to extended cDNAs (obtainable as described below) which contain sequences adjacent to the 5' ESTs and consensus contigated 5' ESTs. It will also be appreciated that if desired, characterization may be delayed until extended cDNAs have been obtained rather than characterizing the 5' ESTs or consensus contigated 5' ESTs themselves.

EXAMPLE 16

Evaluation of Expression Levels and Patterns of mRNAs Corresponding to EST-Related Nucleic Acids Expression levels and patterns of mRNAs corresponding to EST-related nucleic acids may be analyzed by solution hybridization with long probes as described in International Patent Application No. WO 97/05277, the entire contents of which are hereby incorporated by reference. Briefly, an EST-related nucleic acid, fragment of an EST related nucleic acid, positional segment of an EST-related nucleic acid, or fragment of a positional segment of an EST-related nucleic acid corresponding to the gene encoding the mRNA to be characterized is inserted at a cloning site immediately downstream of a bacteriophage (T3, T7 or SP6) RNA polymerase promoter to produce antisense RNA. Preferably, the EST-related nucleic acid, fragment of an EST related nucleic acid, positional segment of an EST-related nucleic acid, or fragment of a positional segment of an EST-related nucleic acid is 100 or more nucleotides in length. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridizations are performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

The EST-related nucleic acid, fragment of an EST related nucleic acid, positional segment of an EST-related nucleic acid, or fragment of a positional segment of an EST-related nucleic acid may also be tagged with nucleotide sequences for the serial analysis of gene expression (SAGE) as disclosed in UK Patent Application No. 2 305 241 A, the entire contents of which are incorporated by reference. In this method, cDNAs are prepared from a cell, tissue, organism or other source of nucleic acid for which gene expression patterns must be determined. The resulting cDNAs are separated into two pools. The cDNAs in each pool are cleaved with a first restriction endonuclease, called an anchoring enzyme, having a recognition site which is likely to be present at least once in most cDNAs. The fragments which contain the 5' or 3' most region of the cleaved cDNA are isolated by binding to a capture medium such as streptavidin coated beads. A first oligonucleotide linker having a first sequence for hybridization of an amplification primer and an internal restriction site for a so called tagging endonuclease is ligated to the digested cDNAs in the first pool. Digestion with the second endonuclease produces short tag fragments from the cDNAs.

A second oligonucleotide having a second sequence for hybridization of an amplification primer and an internal restriction site is ligated to the digested cDNAs in the second pool. The cDNA fragments in the second pool are also digested with the tagging endonuclease to generate short tag fragments derived from the cDNAs in the second pool. The tags resulting from digestion of the first and second pools with the anchoring enzyme and the tagging endonuclease are ligated to one another to produce so called ditags. In some embodiments, the ditags are concatamerized to produce ligation products containing from 2 to 200 ditags. The tag sequences are then determined and compared to the sequences of the EST-related nucleic acid, fragment of an EST related nucleic acid, positional segment of an EST-related nucleic acid, or fragment of a positional segment of an EST-related nucleic acid to determine which 5' ESTs, consensus contigated 5' ESTs, or extended cDNAs are expressed in the cell, tissue, organism, or other source of nucleic acids from which the tags were derived. In this way, the expression pattern of the 5' ESTs, consensus contigated 5' ESTs, or extended cDNAs in the cell, tissue, organism, or other source of nucleic acids is obtained.

Quantitative analysis of gene expression may also be performed using arrays. As used herein, the term array means a one dimensional, two dimensional, or multidimensional arrangement of EST-related nucleic acids, fragments of EST related nucleic acids, positional segments EST-related nucleic acids, or fragments of positional segments of EST-related nucleic acids. Preferably, the EST-related nucleic acids, fragments of EST related nucleic acids, positional segments EST-related nucleic acids, or fragments of positional segments of EST-related nucleic acids are at least 15 nucleotides in length. More preferably, the EST-related nucleic acids, fragments of EST related nucleic acids, positional segments EST-related nucleic acids, or fragments of positional segments of EST-related nucleic acids are at least 100 nucleotide long. More preferably, the fragments are more than 100 nucleotides in length. In some embodiments, the EST-related nucleic acids, fragments of EST related nucleic acids, positional segments EST-related nucleic acids, or fragments of positional segments of EST-related nucleic acids may be more than 500 nucleotides long.

For example, quantitative analysis of gene expression may be performed with EST-related nucleic acids, fragments of EST related nucleic acids, positional segments EST-related nucleic acids, or fragments of positional segments of EST-related nucleic acids in a complementary DNA microarray as described by Schena et al. (*Science* 270:467–470, 1995; *Proc. Natl. Acad Sci. U.S.A.* 93:10614–10619, 1996). EST-related nucleic acids, fragments of EST related nucleic acids, positional segments EST-related nucleic acids, or fragments of positional segments of EST-related nucleic acids are amplified by PCR and arrayed from 96-well microtiter plates onto sylilated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by a single round of reverse transcription. Probes are hybridized to 1 $cm^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of the expression of genes may also be performed with EST-related nucleic acids, fragments of EST related nucleic acids, positional segments EST-related nucleic acids, or fragments of positional segments of EST-related nucleic acids in complementary DNA arrays as described by Pietu et al. (*Genome Research* 6:492–503, 1996). The EST-related nucleic acids, fragments of EST related nucleic acids, positional segments EST-related nucleic acids, or fragments of positional segments of EST-related nucleic acids thereof are PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis of the EST-related nucleic acids, fragments of EST related nucleic acids, positional segments EST-related nucleic acids, or fragments of positional segments of EST-related nucleic acids can be done through high density nucleotide arrays as described by Lockhart et al. (*Nature Biotechnology* 14: 1675–1680, 1996) and Sosnowsky et al. (*Proc. Natl. Acad. Sci.* 94:1119–1123, 1997). Oligonucleotides of 15–50 nucleotides corresponding to sequences of EST-related nucleic acids, fragments of EST related nucleic acids, positional segments EST-related nucleic acids, or fragments of positional segments of EST-related nucleic acids are synthesized directly on the chip (Lockhart et al., supra) or synthesized and then addressed to the chip (Sosnowsky et al., supra). Preferably, the oligonucleotides are about 20 nucleotides in length.

cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip.

After washing as described in Lockhart et al, supra and application of different electric fields (Sonowsky et al, supra.), the dyes or labeling compounds are detected and quantified. Duplicate hybridizations are performed. Comparative analysis of the intensity of the signal originating from cDNA probes on the same target oligonucleotide in different cDNA samples indicates a differential expression of the mRNA corresponding to the 5' EST, consensus contigated 5' EST or extended cDNA from which the oligonucleotide sequence has been designed.

IV. Use of 5' ESTs or Consensus Contigated 5' ESTs to Clone Extended cDNAs and to Clone the Corresponding Genomic DNAs Once 5' ESTs or consensus contigated 5' ESTs which include the 5' end of the corresponding mRNAs have been selected using the procedures described above, they can be utilized to isolate extended cDNAs which contain sequences adjacent to the 5' ESTs or consensus contigated 5' ESTs. The extended cDNAs may include the entire coding sequence of the protein encoded by the corresponding mRNA, including the authentic translation start site. If the extended cDNA encodes a secreted protein, it may contain the signal sequence, and the sequence encoding the mature protein remaining after cleavage of the signal peptide. Extended cDNAs which include the entire coding sequence of the protein encoded by the corresponding mRNA are referred to herein as "full-length cDNAs." Alternatively, the extended cDNAs may not include the entire coding sequence of the protein encoded by the corresponding mRNA, although they do include sequences adjacent to the 5' ESTs or consensus contigated 5' ESTs. In some embodiments in which the extended cDNAs are derived from an mRNA encoding a secreted protein, the extended cDNAs may include only the sequence encoding the mature protein remaining after cleavage of the signal peptide, or only the sequence encoding the signal peptide.

Example 17 below describes a general PCR based method for obtaining extended cDNAs using 5' ESTs or consensus contigated 5' ESTs. Example 18 describes hybridization based methods to obtain genomic DNAs which encode the mRNAs from which the 5' ESTs or consensus contigated 5' ESTS were derived, mRNAs from which the 5' ESTs or consensus contigated 5' ESTS were derived, or nucleic acids which are homologous to 5' ESTs-related nucleic acids. Example 19 below describes the cloning and sequencing of several extended cDNAs, including extended cDNAs which include the entire coding sequence and authentic 5' end of the corresponding mRNA for several secreted proteins.

The methods of Examples 17 and 18 can also be used to obtain extended cDNAs which encode less than the entire coding sequence of proteins encoded by the genes corresponding to the 5' ESTs or consensus contigated ESTs. In some embodiments, the extended cDNAs isolated using these methods encode at least 5, 10, 15, 20, 25, 30, 35, 40, 50, 75, 100, or 150 consecutive amino acids of one of the proteins encoded by the sequences of SEQ ID NOs. 24–3883 and 7744–19335. In some embodiments, the extended cDNAs isolated using these methods encode at least 5, 10, 15, 20, 25, 30, 35, 40, 50, 75, 100, or 150 consecutive amino acids of one of the proteins encoded by the sequences of SEQ ID NOs. 24–3883.

EXAMPLE 17

Figure 3:
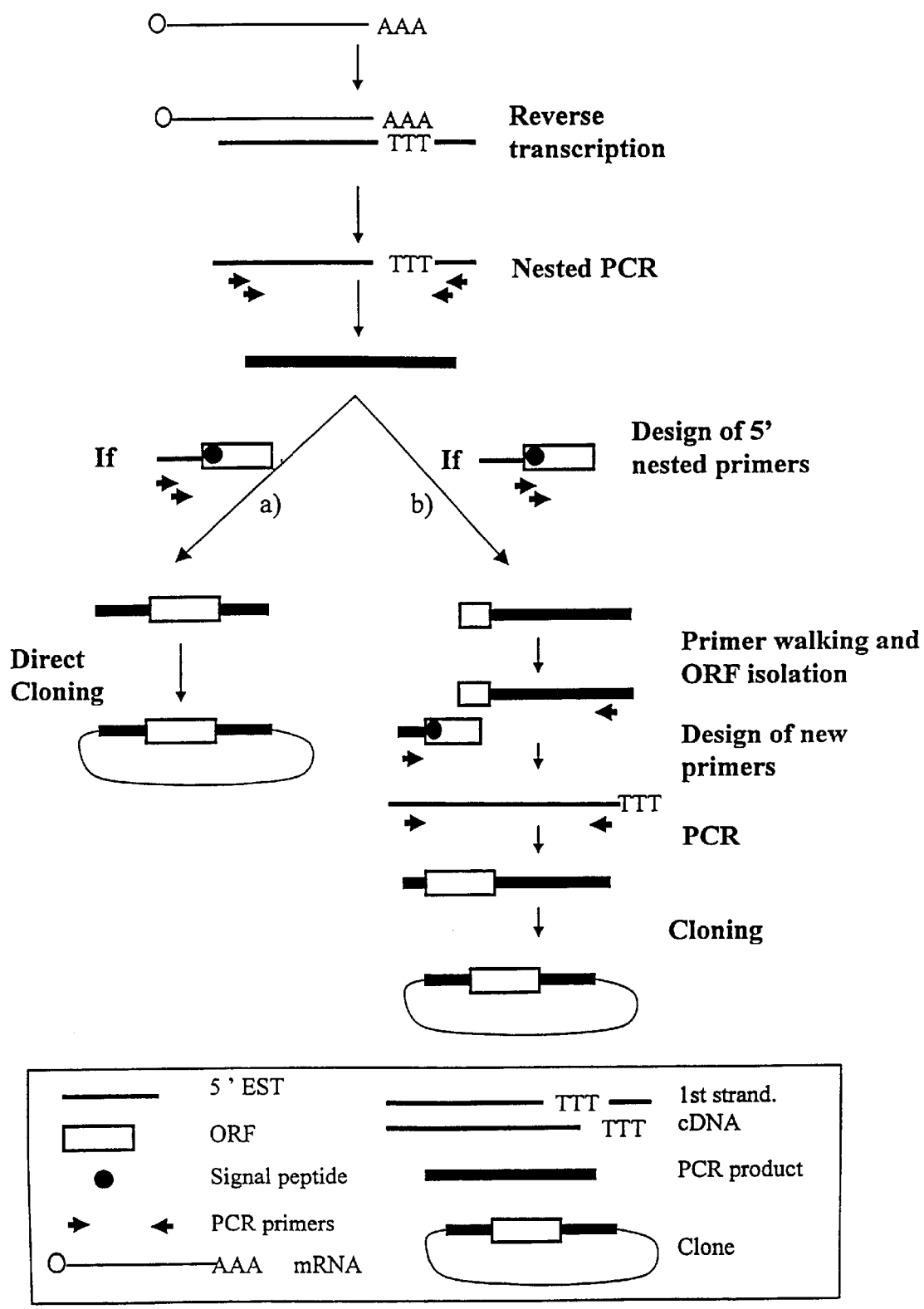
FIG. 3 summarizes a general RT-PCR-based-method used to clone and sequence extended cDNAs containing sequences adjacent to 5' ESTs.

General Method for Using 5' ESTs or Consensus Contigated 5' ESTs to Clone and Sequence Extended cDNAs Which Include the Entire Coding Region and the Authentic 5' End of the Corresponding mRNA The following general method may be used to quickly and efficiently isolate extended cDNAs including sequence adjacent to the sequences of the 5' ESTs or consensus contigated 5' ESTs used to obtain them. This method may be applied to obtain extended cDNAs for any 5' EST or consensus contigated 5' EST of the invention, including those 5' ESTs and consensus contigated 5' ESTs encoding secreted proteins. This method is illustrated in FIG. 3.

1. Obtaining Extended cDNAs

The method takes advantage of the known 5' sequence of the mRNA. A reverse transcription reaction is conducted on purified mRNA with a poly dT primer containing a nucleotide sequence at its 5' end allowing the addition of a known sequence at the end of the cDNA which corresponds to the 3' end of the mRNA. Such a primer and a commercially-available reverse transcriptase enzyme are added to a buffered mRNA sample yielding a reverse transcript anchored at the 3' polyA site of the RNAs. Preferably, a thermostable enzyme is used. Nucleotide monomers are then added to complete the first strand synthesis.

After removal of the mRNA hybridized to the first cDNA strand by alkaline hydrolysis, the products of the alkaline hydrolysis and the residual poly dT primer can be eliminated with an exclusion column.

Subsequently, a pair of nested primers on each end of the cDNA to be amplified is designed based on the known 5' sequence from the 5' EST or consensus contigated 5' EST and the known 3' end added by the poly dT primer used in the first strand synthesis. Software used to design primers are either based on GC content and melting temperatures of oligonucleotides, such as OSP (Illier and Green, *PCR Meth. Appl.* 1:124–128, 1991), or based on the octamer frequency disparity method (Griffais et al., *Nucleic Acids Res.* 19:3887–3891, 1991) such as PC-Rare (see Worldwide Website: bioinformatics.weizmann.ac.il/software/PC-Rare/doc/manuel.litml). Preferably, the nested primers at the 5' end and the nested primers at the 3' end are separated from one another by four to nine bases. These primer sequences may be selected to have melting temperatures and specificities suitable for use in PCR.

A first PCR run is performed using the outer primer from each of the nested pairs. A second PCR run using the inner primer from each of the nested pairs is then performed on a small sample of the first PCR product. Thereafter, the primers and remaining nucleotide monomers are removed.

It will be appreciated that a simple PCR reaction using a primer on each end of the cDNA to be amplified may also be performed rather than using a couple of primers for in a nested PCR procedure. However because of the possibility of PCR artifacts in this method, a nested PCR protocol is preferred.

2. Sequencing Extended cDNAs or Fragments Thereof

Due to the lack of position constraints on the design of 5' nested primers compatible for PCR use using the OSP software, amplicons of two types are obtained. Preferably, the second 5' primer is located upstream of the translation initiation codon thus yielding a nested PCR product containing the entire coding sequence. Such an extended cDNA may be used in a direct cloning procedure as described in section a below. However, in some cases, the second 5' primer is located downstream of the translation initiation codon, thereby yielding a PCR product containing only part of the ORF. Such incomplete PCR products are submitted to a modified procedure described in section b below.

a) Nested PCR Products Containing Complete ORFs

When the resulting nested PCR product contains the complete coding sequence, as predicted from the 5' EST or consensus contigated 5' EST sequence, it is directly cloned in an appropriate vector as described in section 3.

b) Nested PCR Products Containing Incomplete ORFs

When the amplicon does not contain the complete coding sequence, intermediate steps are necessary to obtain both the complete coding sequence and a PCR product containing the full coding sequence. The complete coding sequence can be assembled from several partial sequences determined directly from different PCR products.

Once the full coding sequence has been completely determined, new primers compatible for PCR use are then designed to obtain amplicons containing the whole coding region. However, in such cases, 3' primers compatible for PCR use are located inside the 3' UTR of the corresponding mRNA, thus yielding amplicons which lack part of this region, i.e. the polyA tract and sometimes the polyadenylation signal, as illustrated in FIG. 3. Such extended cDNAs are then cloned into an appropriate vector as described in section 3.

c) Sequencing Extended cDNAs

Sequencing of extended cDNAs can be performed using a Dye Terminator approach with the AmpliTaq DNA polymerase FS kit available from Perkin Elmer.

In order to sequence long PCR fragments, primer walking is performed using software such as OSP to choose primers and automated computer software such as ASMG (Sutton et al., *Genome Science Technol.* 1: 9–19, 1995) to construct contigs of walking sequences including the initial 5' tag. Preferably, primer walking is performed until the sequences of full length cDNAs are obtained.

Completion of the sequencing of a given extended cDNA fragment may be assessed by comparing the sequence length to the size of the corresponding nested PCR product. When Northern blot data are available, the size of the mRNA detected for a given PCR product may also be used to finally assess that the sequence is complete. Sequences which do not fulfill these criteria are discarded and will undergo a new isolation procedure.

3. Cloning Extended cDNAs

The PCR product containing the full coding sequence is then cloned in an appropriate vector. For example, the extended cDNAs can be cloned into any expression vector known in the art, such as pED6dpc2 for extended cDNA encoding potentially secreted proteins (DiscoverEase, Genetics Institute, Cambridge, Mass.).

Cloned PCR products are then entirely sequenced in order to obtain at least two sequences per clone. Preferably, the sequences are obtained from both sense and antisense strands according to the aforementioned procedure with the following modifications. First, both 5' and 3' ends of cloned PCR products are sequenced in order to confirm the identity of the clone. Second, primer walking is performed if the full coding region has not been obtained yet. Contigation is then performed using primer walking sequences for cloned products as well as walking sequences that have already contigated for uncloned PCR products. The sequence is considered complete when the resulting contigs include the whole coding region as well as overlapping sequences with vector DNA on both ends. All the contigated sequences for each cloned amplicon are then used to obtain a consensus sequence.

4. Selection of Cloned Full Length Sequences a) Computer Analysis of Extended cDNAs Following identification of contaminants and masking of repeats, structural features, e.g. polyA tail and polyadenylation signal, of the sequences of extended cDNAs are subsequently determined using methods known to those skilled in the art. For example, the algorithm, parameters and criteria defined in FIG. 10 may be used. Briefly, a polyA tail is defined as a homopolymeric stretch of at least 11 A with at most one alternative base within it. The polyA tail search is restricted to the last 20 nucleotides of the sequence and limited to stretches of 11 consecutive A's because sequencing reactions are often not readable after such a polyA stretch. To search for a polyadenylation signal, the polyA tail is clipped from the full-length sequence. The 50 nucleotides preceding the polyA tail are searched for the canonic polyadenylation AAUAAA signal allowing one mismatch to account for possible sequencing errors as well as known variation in the canonical sequence of the polyadenylation signal.

Functional features, e.g. ORFs and signal sequences, of the sequences of extended cDNAs are subsequently determined as follows. The 3 upper strand frames of extended cDNAs are searched for ORFs defined as the maximum length fragments beginning with a translation initiation codon and ending with a stop codon. ORFs encoding at least 80 amino acids are preferred. If extended cDNAs encoding secreted proteins are desired, each identified ORF is then scanned for the presence of a signal peptide using the matrix method described in Example 11.

Sequences of extended cDNAs are then compared, on a nucleotidic or proteic basis, to public sequences available at the time of filing.

b) Selection of Full-length cDNAs of Interest

A negative selection may then be performed in order to eliminate unwanted cloned sequences resulting from either contaminants or PCR artifacts as follows. Sequences matching contaminant sequences such as vector DNA, tRNA, mtRNA, rRNA sequences are discarded as well as those encoding ORF sequences exhibiting extensive homology to repeats. Sequences obtained by direct cloning (section 1a) but lacking polyA tail may be discarded. Only ORFs ending either before the polyA tail (section 1a) or before the end of the cloned 3' UTR (section 1b) may be selected. If extended cDNAs encoding secreted proteins are desired, ORFs containing a signal peptide are considered. In addition, ORFs containing unlikely mature proteins such as mature proteins which size is less than 20 amino acids or less than 25% of the immature protein size may be eliminated if necessary.

Then, for each remaining full length cDNA containing several ORFs, a preselection of ORFs may be performed using the following criteria. The longest ORF is preferred. If extended cDNAs encoding secreted proteins are desired and if the ORF sizes are similar, the chosen ORF is the one which signal peptide has the highest score according to Von Heijne method.

Sequences of full length cDNA clones may then be compared pairwise after masking of the repeat sequences. Full-length cDNA sequences exhibiting extensive homology may be clustered in the same class. Each cluster may then be subjected to a cluster analysis that detects sequences resulting from internal priming or from alternative splicing, identical sequences or sequences with several frameshifts. A selection may be operated between clones belonging to the same class in order to detect clones encoding homologous but distinct ORFs which may be both selected if they both contain sequences of interest.

Selection of full-length cDNA clones encoding sequences of interest may subsequently be performed using the following criteria. Structural parameters (initial tag, polyadenylation site and signal) are first checked. Then, homologies with known nucleic acids and proteins are examined in order to determine whether the clone sequence match a known nucleotide/protein sequence and, in the latter case, its covering rate and the date at which the sequence became public.

If there is no extensive match with sequences other than ESTs or genomic DNA, or if the clone sequence provides substantial new information, such as encoding a protein resulting from alternative splicing of an mRNA coding for an already known protein, the sequence is kept. Examples of such cloned full-length cDNAs containing sequences of interest are described in Example 19. Sequences resulting from chimera or double inserts or located on chromosome breaking points as assessed by homology to other sequences may be discarded during this procedure.

Extended cDNAs prepared as described above may be subsequently engineered to obtain nucleic acids which include desired portions of the extended cDNA using conventional techniques such as subcloning, PCR, or in vitro oligonucleotide synthesis. For example, nucleic acids which include only the full coding sequences may be obtained using techniques known to those skilled in the art. Alternatively, conventional techniques may be applied to obtain nucleic acids which contain only part of the coding sequences. In the case of nucleic acids encoding secreted proteins, nucleic acids containing only the coding sequence for the mature protein remaining after the signal peptide is cleaved off or nucleic acids which contain only the coding sequences for the signal peptides may be obtained.

Similarly, nucleic acids containing any other desired portion of the coding sequences for the encoded protein may be obtained. For example, the nucleic acid may contain at least 10, 15, 18, 20, 25, 28, 30, 35, 40, 50, 75, 100, 150, 200, 300, 400, 500, 1000 or 2000 consecutive bases of an extended cDNA.

Once an extended cDNA has been obtained, it can be sequenced to determine the amino acid sequence it encodes. Once the encoded amino acid sequence has been determined, one can create and identify any of the many conceivable cDNAs that will encode that protein by simply using the degeneracy of the genetic code. For example, allelic variants or other homologous nucleic acids can be identified as described below. Alternatively, nucleic acids encoding the desired amino acid sequence can be synthesized in vitro.

In a preferred embodiment, the coding sequence may be selected using the known codon or codon pair preferences for the host organism in which the cDNA is to be expressed.

In addition to PCR based methods for obtaining cDNAs which include the authentic 5' end of the corresponding mRNA as well as the complete protein coding sequence of the corresponding mRNA, traditional hybridization based methods may also be employed. These methods may also be used to obtain the genomic DNAs which encode the mRNAs from which the 5' ESTs or consensus contigated 5' ESTS were derived, mRNAs from which the 5' ESTs or consensus contigated 5' ESTS were derived, or nucleic acids which are homologous to EST-related nucleic acids. In particular, such methods may be used to obtain extended cDNAs which include the entire coding region of the mRNAs from which the 5' EST or consensus contigated 5' ESTs was derived. Example 18 below provides examples of such methods.

EXAMPLE 18

Methods for Obtaining Extended cDNAs Which Include the Entire Coding Region and the Authentic 5' End of the Corresponding mRNA or Nucleic Acids Homologous to Extended cDNAs 5' ESTs or Consensus Contigated 5' ESTs A full-length cDNA library can be made using the strategies described in Examples 1–5. Alternatively, a cDNA library or genomic DNA library may be obtained from a commercial source or made using techniques familiar to those skilled in the art.

Such cDNA or genomic DNA libraries may be used to isolate extended cDNAs obtained from 5' ESTs or consensus contigated 5' ESTs or nucleic acids homologous to extended cDNAs, 5' ESTs, or consensus contigated 5' ESTs as follows. The cDNA library or genomic DNA library is hybridized to a detectable probe. The detectable probe may comprise at least 10, 15, 18, 20, 25, 28, 30, 35, 40, 50, 75, 100, 150, 200, 300, 400 or 500 consecutive nucleotides of the 5' EST, consensus contigated 5' EST, or extended cDNA. Techniques for identifying cDNA clones in a cDNA library which hybridize to a given probe sequence are disclosed in Sambrook et al., *Molecular Cloning: A Laboratory Manual* 2d Ed., Cold Spring Harbor Laboratory Press, 1989, the disclosure of which is incorporated herein by reference. The same techniques may be used to isolate genomic DNAs.

Briefly, cDNA or genomic DNA clones which hybridize to the detectable probe are identified and isolated for further manipulation as follows. The detectable probe described in the preceding paragraph is labeled with a detectable label such as a radioisotope or a fluorescent molecule. Techniques for labeling the probe are well known and include phosphorylation with polynucleotide kinase, nick translation, in vitro transcription, and non radioactive techniques. The cDNAs or genomic DNAs in the library are transferred to a nitrocellulose or nylon filter and denatured. After blocking of non specific sites, the filter is incubated with the labeled probe for an amount of time sufficient to allow binding of the probe to cDNAs or genomic DNAs containing a sequence capable of hybridizing thereto.

By varying the stringency of the hybridization conditions used to identify cDNAs or genomic DNAs which hybridize to the detectable probe, cDNAs or genomic DNAs having different levels of homology to the probe can be identified and isolated as described below.

1. Identification of cDNA or Genomic DNA Sequences Having a High Degree of Homology to the Labeled Probe To identify cDNAs or genomic DNAs having a high degree of homology to the probe sequence, the melting temperature of the probe may be calculated using the following formulas:

For probes between 14 and 70 nucleotides in length the melting temperature (Tm) is calculated using the formula: $Tm=81.5+16.6(\log(Na+))+0.41(\text{fraction } G+C)-(600/N)$ where N is the length of the probe.

If the hybridization is carried out in a solution containing formamide, the melting temperature may be calculated using the equation $Tm=81.5+16.6(\log(Na+))+0.41(\text{fraction } G+C)-(0.63\% \text{ formamide})-(600/N)$ where N is the length of the probe.

Prehybridization may be carried out in 6×SSC, 5×Denhardt's reagent, 0.5% SDS, 100 g denatured fragmented salmon sperm DNA or 6×SSC, 5×Denhardt's reagent, 0.5% SDS, 100 g denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to extended cDNAs or genomic DNAs containing sequences complementary thereto or homologous thereto. For probes over 200 nucleotides in length, the hybridization may be carried out at 15–25° C. below the Tm. For shorter probes, such as oligonucleotide probes, the hybridization may be conducted at 15–25° C. below the Tm. Preferably, for hybridizations in 6×SSC, the hybridization is conducted at approximately 68° C. Preferably, for hybridizations in 50% formamide containing solutions, the hybridization is conducted at approximately 42° C.

All of the foregoing hybridizations would be considered to be under "stringent" conditions.

Following hybridization, the filter is washed in 2×SSC, 0.1% SDS at room temperature for 15 minutes. The filter is then washed with 0.1×SSC, 0.5% SDS at room temperature for 30 minutes to 1 hour. Thereafter, the solution is washed at the hybridization temperature in 0.1×SSC, 0.5% SDS. A final wash is conducted in 0.1×SSC at room temperature.

cDNAs or genomic DNAs which have hybridized to the probe are identified by autoradiography or other conventional techniques.

2. Obtaining cDNA or Genomic DNA Sequences Having Lower Degrees of Homology to the Labeled Probe The above procedure may be modified to identify cDNAs or genomic DNAs having decreasing levels of homology to the probe sequence. For example, to obtain cDNAs or genomic DNAs of decreasing homology to the detectable probe, less stringent conditions may be used. For example, the hybridization temperature may be decreased in increments of 5° C. from 68° C. to 42° C. in a hybridization buffer having a sodium concentration of approximately 1M. Following hybridization, the filter may be washed with 2×SSC, 0.5% SDS at the temperature of hybridization. These conditions are considered to be "moderate" conditions above 50° C. and "low" conditions below 50° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide.

cDNAs or genomic DNAs which have hybridized to the probe are identified by autoradiography.

3. Determination of the Degree of Homology Between the Obtained cDNAs or Genomic DNAs and 5' ESTs, Consensus Contigated 5' ESTs or Extended cDNAs or Between the Polypeptides Encoded by the Obtained cDNAs or Genomic DNAs and the Polypeptides Encoded by the 5' ESTs Consensus Contigated 5' ESTs or Extended cDNAs To determine the level of homology between the hybridized cDNA or genomic DNA and the 5' EST, consensus contigated 5' EST or extended cDNA from which the probe was derived, the nucleotide sequences of the hybridized nucleic acid and the 5' EST, consensus contigated 5' EST or extended cDNA from which the probe was derived are compared. The sequences of the 5' EST, consensus contigated 5' EST or extended cDNA from which the probe was derived and the sequences of the cDNA or genomic DNA which hybridized to the detectable probe may be stored on a computer readable medium as described below and compared to one another using any of a variety of algorithms familiar to those skilled in the art, those described below.

To determine the level of homology between the polypeptide encoded by the hybridizing cDNA or genomic DNA and the polypeptide encoded by the 5' EST, consensus contigated 5' EST or extended cDNA from which the probe was derived, the polypeptide sequence encoded by the hybridized nucleic acid and the polypeptide sequence encoded by the 5' EST, consensus contigated 5' EST or extended cDNA from which the probe was derived are compared. The sequences of the polypeptide encoded by the 5' EST, consensus contigated 5' EST or extended cDNA from which the probe was derived and the polypeptide sequence encoded by the cDNA or genomic DNA which hybridized to the detectable probe may be stored on a computer readable medium as described below and compared to one another using any of a variety of algorithms familiar to those skilled in the art, those described below.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215(3):403–410; Thompson et al., 1994, *Nucleic Acids Res.* 22(2):4673–4680; Higgins et al., 1996, *Methods Enzymol.* 266:383–402; Altschul et al., 1990, *J. Mol. Biol.* 215(3):403–410; Altschul et al., 1993, *Nature Genetics* 3:266–272).

In a particularly preferred embodiment, protein and nucleic acid sequence homologies are evaluated using the Basic Local Alignment Search Tool ("BLAST") which is well known in the art (see, e.g., Karlin and Altschul, 1990, *Proc. Natl. Acad Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443–1445; Henikoff and Henikoff, 1993, *Proteins* 17:49–61). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation)

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267–2268).

The parameters used with the above algorithms may be adapted depending on the sequence length and degree of homology studied. In some embodiments, the parameters may be the default parameters used by the algorithms in the absence of instructions from the user.

In some embodiments, the level of homology between the hybridized nucleic acid and the extended cDNA, 5' EST, or 5' consensus contigated EST from which the probe was derived may be determined using the FASTDB algorithm described in Brutlag et al. *Comp. App. Biosci.* 6:237–245, 1990. In such analyses the parameters may be selected as follows: Matrix=Unitary, k-tuple=4, Mismatch Penalty=1, Joining Penalty=30, Randomization Group Length=0, Cutoff Score=1, Gap Penalty=5, Gap Size Penalty=0.05, Window Size=500 or the length of the sequence which hybridizes to the probe, whichever is shorter. Because the FASTDB program does not consider 5' or 3' truncations when calculating homology levels, if the sequence which hybridizes to the probe is truncated relative to the sequence of the extended cDNA, 5' EST, or consensus contigated 5' EST from which the probe was derived the homology level is manually adjusted by calculating the number of nucleotides of the extended cDNA, 5' EST, or consensus contigated 5' EST which are not matched or aligned with the hybridizing sequence, determining the percentage of total nucleotides of the hybridizing sequence which the non-matched or non-aligned nucleotides represent, and subtracting this percentage from the homology level. For example, if the hybridizing sequence is 700 nucleotides in length and the extended cDNA, 5' EST, or consensus contigated 5' EST sequence is 1000 nucleotides in length wherein the first 300 bases at the 5' end of the extended cDNA, 5' EST, or consensus contigated 5' EST are absent from the hybridizing sequence, and wherein the overlapping 700 nucleotides are identical, the homology level would be adjusted as follows. The non-matched, non-aligned 300 bases represent 30% of the length of the extended cDNA, 5' EST, or consensus contigated 5' EST. If the overlapping 700 nucleotides are 100% identical, the adjusted homology level would be 100−30=70% homology. It should be noted that the preceding adjustments are only made when the non-matched or non-aligned nucleotides are at the 5' or 3' ends. No adjustments are made if the non-matched or non-aligned sequences are internal or under any other conditions.

For example, using the above methods, nucleic acids having at least 95% nucleic acid homology, at least 96% nucleic acid homology, at least 97% nucleic acid homology, at least 98% nucleic acid homology, at least 99% nucleic acid homology, or more than 99% nucleic acid homology to the extended cDNA, 5' EST, or consensus contigated 5' EST from which the probe was derived may be obtained and identified. Such nucleic acids may be allelic variants or related nucleic acids from other species. Similarly, by using progressively less stringent hybridization conditions one can obtain and identify nucleic acids having at least 90%, at least 85%, at least 80% or at least 75% homology to the extended cDNA, 5' EST, or consensus contigated 5' EST from which the probe was derived.

Using the above methods and algorithms such as FASTA with parameters depending on the sequence length and degree of homology studied, for example the default parameters used by the algorithms in the absence of instructions from the user, one can obtain nucleic acids encoding proteins having at least 99%, at least 98%, at least 97%, at least 96%, at least 95%, at least 90%, at least 85%, at least 80% or at least 75% homology to the protein encoded by the extended cDNA, 5' EST, or consensus contigated 5' EST from which the probe was derived. In some embodiments, the homology levels can be determined using the "default" opening penalty and the "default" gap penalty, and a scoring matrix such as PAM 250 (a standard scoring matrix; see Dayhoff et al., in: Atlas of Protein Sequence and Structure, Vol. 5, Supp. 3 (1978)).

Alternatively, the level of polypeptide homology may be determined using the FASTDB algorithm described by Brutlag et al. Comp. App. Biosci. 6:237–245, 1990. In such analyses the parameters may be selected as follows: Matrix=PAM 0, k-tuple=2, Mismatch Penalty=1, Joining Penalty=20, Randomization Group Length=0, Cutoff Score=1, Window Size=Sequence Length, Gap Penalty=5, Gap Size Penalty=0.05, Window Size=500 or the length of the homologous sequence, whichever is shorter. If the homologous amino acid sequence is shorter than the amino acid sequence encoded by the extended cDNA, 5' EST, or consensus contigated 5' EST as a result of an N terminal and/or C terminal deletion the results may be manually corrected as follows. First, the number of amino acid residues of the amino acid sequence encoded by the extended cDNA, 5' EST, or consensus contigated 5' EST which are not matched or aligned with the homologous sequence is determined. Then, the percentage of the length of the sequence encoded by the extended cDNA, 5' EST, or consensus contigated 5' EST which the non-matched or non-aligned amino acids represent is calculated. This percentage is subtracted from the homology level. For example wherein the amino acid sequence encoded by the extended cDNA, 5' EST, or consensus contigated 5' EST is 100 amino acids in length and the length of the homologous sequence is 80 amino acids and wherein the amino acid sequence encoded by the extended cDNA or 5' EST is truncated at the N terminal end with respect to the homologous sequence, the homology level is calculated as follows. In the preceding scenario there are 20 non-matched, non-aligned amino acids in the sequence encoded by the extended cDNA, 5' EST, or consensus contigated 5' EST. This represents 20% of the length of the amino acid sequence encoded by the extended cDNA, 5' EST, or consensus contigated 5' EST. If the remaining amino acids are 1005 identical between the two sequences, the homology level would be 100%−20%=80% homology. No adjustments are made if the non-matched or non-aligned sequences are internal or under any other conditions.

In addition to the above described methods, other protocols are available to obtain extended cDNAs using 5' ESTs or consensus contigated 5' ESTs as outlined in the following paragraphs.

Extended cDNAs may be prepared by obtaining mRNA from the tissue, cell, or organism of interest using mRNA preparation procedures utilizing polyA selection procedures or other techniques known to those skilled in the art. A first primer capable of hybridizing to the polyA tail of the mRNA is hybridized to the mRNA and a reverse transcription reaction is performed to generate a first cDNA strand.

The first cDNA strand is hybridized to a second primer containing at least 10 consecutive nucleotides of the sequences of SEQ ID NOs 24–3883 and 7744–19335. Preferably, the primer comprises at least 10, 12, 15, 17, 18, 20, 23, 25, or 28 consecutive nucleotides from the sequences of SEQ ID NOs 24–3883 and 7744–19335. In some embodiments, the primer comprises more than 30 nucleotides from the sequences of SEQ ID NOs 24–3883 and 7744–19335. If it is desired to obtain extended cDNAs containing the full protein coding sequence, including the authentic translation initiation site, the second primer used contains sequences located upstream of the translation initiation site. The second primer is extended to generate a second cDNA strand complementary to the first cDNA strand. Alternatively, RT-PCR may be performed as described above using primers from both ends of the cDNA to be obtained.

Extended cDNAs containing 5' fragments of the mRNA may be prepared by hybridizing an mRNA comprising the sequences of SEQ ID NOs. 24–3883 and 7744–19335 with a primer comprising a complementary to a fragment of an EST-related nucleic acid hybridizing the primer to the mRNAs, and reverse transcribing the hybridized primer to make a first cDNA strand from the mRNAs. Preferably, the primer comprises at least 10, 12, 15, 17, 18, 20, 23, 25, or 28 consecutive nucleotides of the sequences complementary to SEQ ID NOs. 24–3883 and 7744–19335.

Thereafter, a second cDNA strand complementary to the first cDNA strand is synthesized. The second cDNA strand may be made by hybridizing a primer complementary to sequences in the first cDNA strand to the first cDNA strand and extending the primer to generate the second cDNA strand.

The double stranded extended cDNAs made using the methods described above are isolated and cloned. The extended cDNAs may be cloned into vectors such as plasmids or viral vectors capable of replicating in an appropriate host cell. For example, the host cell may be a bacterial, mammalian, avian, or insect cell.

Techniques for isolating mRNA, reverse transcribing a primer hybridized to mRNA to generate a first cDNA strand, extending a primer to make a second cDNA strand complementary to the first cDNA strand, isolating the double stranded cDNA and cloning the double stranded cDNA are well known to those skilled in the art and are described in *Current Protocols in Molecular Biology*, John Wiley & Sons, Inc. 1997 and Sambrook et al., Molecular Cloning: A Laboratory Manual, Second Edition, Cold Spring Harbor Laboratory Press, 1989, the entire disclosures of which are incorporated herein by reference.

Alternatively, other procedures may be used for obtaining fill-length cDNAs or extended cDNAs. In one approach, full-length or extended cDNAs are prepared from mRNA and cloned into double stranded phagemids as follows. The cDNA library in the double stranded phagemids is then rendered single stranded by treatment with an endonuclease, such as the Gene II product of the phage F1 and an exonuclease (Chang et al., *Gene* 127:95–8, 1993). A biotinylated oligonucleotide comprising the sequence of a fragment of an EST-related nucleic acid is hybridized to the single stranded phagemids. Preferably, the fragment comprises at least 10, 12, 15, 17, 18, 20, 23, 25, or 28 consecutive nucleotides of the sequences of SEQ ID NOs. 24–3883 and 7744–19335.

Hybrids between the biotinylated oligonucleotide and phagemids are isolated by incubating the hybrids with streptavidin coated paramagnetic beads and retrieving the beads with a magnet (Fry et al., *Biotechniques*, 13: 124–131, 1992). Thereafter, the resulting phagemids are released from the beads and converted into double stranded DNA using a primer specific for the 5' EST or consensus contigated 5' EST sequence used to design the biotinylated oligonucleotide. Alternatively, protocols such as the Gene Trapper kit (Gibco BRL) may be used. The resulting double stranded DNA is transformed into bacteria. Extended cDNAs or full length cDNAs containing the 5' EST or consensus contigated 5' EST sequence are identified by colony PCR or colony hybridization.

EXAMPLE 19

Extended cDNAs and Full Length cDNAs

The procedure described in Example 17 was used to obtain extended cDNAs or full length cDNAs derived from 5' ESTs in a variety of tissues. The following list provides a few examples of thus obtained cDNAs.

Using this procedure, the full length cDNA of SEQ ID NO.1 (internal identification number 58-34-2-E7-FL2) was obtained. This cDNA encodes the signal peptide MWWFQQGLSFLPSALVIWTSA(SEQ ID NO.2) having a von Heijne score of 5.5.

Using this approach, the full length cDNA of SEQ ID NO.3 (internal identification number 48-19-3-G1-FL1) was obtained. This cDNA encodes the signal peptide MKKV-LLLITAILAVAVG (SEQ ID NO. 4) having a von Heijne score of 8.2.

The full length cDNA of SEQ ID NO.5 (internal identification number 58-35-2-F10-FL2) was also obtained using this procedure. This cDNA encodes a signal peptide LWLL-FFLVTAIHA (SEQ ID NO.6) having a von Heijne score of 10.7.

Furthermore, the polypeptides encoded by the extended or full-length cDNAs may be screened for the presence of known structural or functional motifs or for the presence of signatures, small amino acid sequences which are well conserved amongst the members of a protein family. The results obtained for the polypeptides encoded by a few full-length cDNAs derived from 5' ESTs that were screened for the presence of known protein signatures and motifs using the Proscan software from the GCG package and the Prosite 15.0 database are provided below.

The protein of SEQ ID NO. 8 encoded by the full-length cDNA SEQ ID NO. 7 (internal designation 78-8-3-E6-CL0_1C) and expressed in adult prostate belong to the phosphatidylethanolamine-binding protein from which it exhibits the characteristic PROSITE signature. Proteins from this widespread family, from nematodes to fly, yeast, rodent and primate species, bind hydrophobic ligands such as phospholipids and nucleotides. They are mostly expressed in brain and in testis and are thought to play a role in cell growth and/or maturation, in regulation of the sperm maturation, motility and in membrane remodeling. They may act either through signal transduction or through oxidoreduction reactions (for a review see Schoentgen and Jollès, *FEBS Letters*, 369:22–26 (1995)). Taken together, these data suggest that the protein of SEQ ID NO. 8 may play a role in cell growth, maturation and in membrane remodeling and/or may be related to male fertility. Thus, these protein may be useful in diagnosing and/or treating cancer, neurodegenerative diseases, and/or disorders related to male fertility and sterility.

The protein of SEQ ID NOs. 10 encoded by the extended cDNA SEQ ID NO. 9 (internal designation 59-9-2-E6-FL0_1C) belong to the stomatin or band 7 family. The human stomatin is an integral membrane phosphoprotein thought to regulate the cation. conductance by interacting with other proteins of the junctional complex of the membrane skeleton (Gallagher and Forget, *J. Biol. Chem.*, 270:26358–26363 (1995)). The protein of SEQ ID NO. 10 exhibits the PROSITE signature typical for the band 7 family signature. Taken together, these data suggest that the protein of SEQ ID NO. 10 plays a role in the regulation of ion transport, hence in the control of cellular volume. This protein may find applications in diagnosing and/or treating stomatocytosis and/or cryohydrocytosis.

The protein of SEQ ID NO. 12 encoded by the extended cDNA SEQ ID NO. 11 (internal designation 19-10-1-C2-CL1 3) shows homology with the bovine subunit B14.5B of the NADH-ubiquinone oxidureductase complex (Arizmendi et al., *FEBS Left.*, 313:80–84 (1992) and Swissprot accession number Q02827). This complex is the first of four complexes located in the inner mitochondrial membrane which make up the mitochondrial electron transport chain. Complex I is involved in the dehydrogenation of NADH and the transportation of electrons to coenzyme Q. It is composed of 7 subunits encoded by the mitochondrial genome and 34 subunits encoded by the nuclear genome. It is also thought to play a role in the regulation of apoptosis and necrosis. Mitochondriocytopathies due to complex I deficiency are frequently encountered and affect tissues with a high energy demand such as brain (mental retardation, convulsions, movement disorders), heart (cardiomyopathy, conduction disorders), kidney (Fanconi syndrome), skeletal muscle (exercise intolerance, muscle weakness, hypotonia) and/or eye (opthmaloplegia, ptosis, cataract and retinopathy). For a review on complex I see Smeitink et al., *Hum. Mol. Gent.*, 7:1573–1579 (1998). Taken together, these data suggest that the protein of SEQ ID NO. 12 may be part of the mitochondrial energy-generating system, probably as a subunit of the NADH-ubiquinone oxidoreductase complex. Thus, this protein or part therein, may find applications in diagnosing and/or treating several disorders including, but not limited to, brain disorders (mental retardation, convulsions, movement disorders), heart disorders (cardiomyopathy, conduction disorders), kidney disorders (Fanconi syndrome), skeletal muscle disorders (exercise intolerance, muscle weakness, hypotonia) and/or eye disorders opthmalmoplegia, ptosis, cataract and retinopathy).

The protein of SEQ ID NO. 14 encoded by the extended cDNA SEQ ID NO. 13 (internal designation 77-13-1-C11-FL2__2C) exhibits an extensive homology with a murine protein named MP1 for MEK binding partner 1 (Genbank accession number AF082526). MP1 was shown to enhance enzymatic activation of mitogen-activated protein (MAP) kinase cascade. The MAP kinase pathway is one of the important enzymatic cascade that is conserved among all eukaryotes from yeast to human. This kind of pathway is involved in vital functions such as the regulation of growth, differentiation and apoptosis. MP1 probably acts by facilitating the interaction of the two sequentially acting kinases MEK1 and ERK1 (Schaffer et al., *Science*, 281:1668–1671 (1998)). Taken together, these data suggest that the protein of SEQ ID NO. 14 may be involved in regulating protein-protein interaction in the signal transduction pathways. Thus, this protein may be useful in diagnosing and/or treating several types of disorders including, but not limited to, cancer, neurodegenerative diseases, cardiovascular disorders, hypertension, renal injury and repair and septic shock.

Bacterial clones containing plasmids containing the full length cDNAs described above are presently stored in the inventor's laboratories under the internal identification numbers provided above. The inserts may be recovered from the deposited materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the EST insertion. The PCR product which corresponds to the 5' EST can then be manipulated using standard cloning techniques familiar to those skilled in the art.

Using any of the above described methods in section IV, a plurality of extended cDNAs containing full-length protein coding sequences or portions of the protein coding sequences may be provided as cDNA libraries for subsequent evaluation of the encoded proteins or use in diagnostic assays as described below.

V. Expression of Proteins Encoded by EST-related Nucleic Acids

EST-related nucleic acids, fragments of EST-related nucleic acids, positional segments of EST-related nucleic acids, and fragments of positional segments of EST-related nucleic acids may be used to express the polypeptides which they encode. In particular, they may be used to express EST-related polypeptides, fragments of EST-related polypeptides, positional segments of EST-related polypeptides, or fragments of positional segments of EST-related polypeptides. In some embodiments, the EST-related nucleic acids, positional segments of EST-related nucleic acids, and fragments of positional segments of EST-related nucleic acids may be used to express the full polypeptide (i.e. the signal peptide and the mature polypeptide) of a secreted protein, the mature protein (i.e. the polypeptide generated after cleavage of the signal peptide), or the signal peptide of a secreted protein. If desired, nucleic acids encoding the signal peptide may be used to facilitate secretion of the expressed protein. It will be appreciated that a plurality of EST-related nucleic acids, fragments of EST-related nucleic acids, positional segments of EST-related nucleic acids, or fragments of positional segments of EST-related nucleic acids may be simultaneously cloned into expression vectors to create an expression library for analysis of the encoded proteins as described below.

EXAMPLE 20

Expression of the Proteins Encoded by the Genes Corresponding to the 5' ESTs or Consensus Contigated 5' ESTs To express their encoded proteins the EST-related nucleic acids, fragments of EST-related nucleic acids, positional segments of EST-related nucleic acids, or fragments of positional segments of EST-related nucleic acids are cloned into a suitable expression vector. In some instances, nucleic acids encoding EST-related polypeptides, fragments of EST-related polypeptides, positional segments of EST-related polypeptides or fragments of positional segments of EST-related polypeptides may be cloned into a suitable expression vector.

In some embodiments, the nucleic acids inserted into the expression vector may comprise the coding sequence of a sequence selected from the group consisting of 24–3883. In other embodiments, the nucleic acids inserted into the expression vector may comprise may comprise the full coding sequence (i.e. the nucleotides encoding the signal peptide and the mature polypeptide) of one of SEQ ID NOs.

1339–2059. In some embodiments, the nucleic acid inserted into the expression vector may comprise the nucleotides of one of the sequences of SEQ ID NOs. 1339–2059 which encode the mature polypeptide (i.e. the nucleotides encoding the polypeptide generated after cleavage of the signal peptide). In further embodiments, the nucleic acids inserted into the expression vector may comprise the nucleotides of SEQ ID NOs. 24–383 and 1339–2059 which encode the signal peptide to facilitate secretion of the expressed protein. The nucleic acids inserted into the expression vectors may also contain sequences upstream of the sequences encoding the signal peptide, such as sequences which regulate expression levels or sequences which confer tissue specific expression.

The nucleic acid inserted into the expression vector may encode a polypeptide comprising the one of the sequences of SEQ ID NOs. 3884–7743. In some embodiments, the nucleic acid inserted into the expression vector may encode the full polypeptide sequence (i.e. the signal peptide and the mature polypeptide) included in one of SEQ ID NOs. 5199–5919. In other embodiments, the nucleic acid inserted into the expression vector may encode the mature polypeptide (i.e. the polypeptide generated after cleavage of the signal peptide) included in one of the sequences of SEQ ID NOs. 5199–5919. In further embodiments, the nucleic acids inserted into the expression vector may encode the signal peptide included in one of the sequences of 3884–4243 and 5199–5919.

The nucleic acid encoding the protein or polypeptide to be expressed is operably linked to a promoter in an expression vector using conventional cloning technology. The expression vector may be any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism in which the expression vector is introduced, as explained by Hatfield, et al., U.S. Pat. No. 5,082,767, incorporated herein by this reference.

The following is provided as one exemplary method to express the proteins encoded by the nucleic acids described above. In some instances the nucleic acid encoding the protein or polypeptide to be expressed includes a methionine initiation codon and a poly A signal. If the nucleic acid encoding the polypeptide to be expressed lacks a methionine to serve as the initiation site, an initiating methionine can be introduced next to the first codon of the nucleic acid using conventional techniques. Similarly, if the nucleic acid encoding the protein or polypeptide to be expressed lacks a polyA signal, this sequence can be added to the construct by, for example, splicing out the polyA signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex thymidine kinase promoter and the selectable neomycin gene. The nucleic acid encoding the polypeptide to be expressed is obtained by PCR from the bacterial vector using oligonucleotide primers complementary to the nucleic acid encoding the protein or polypeptide to be expressed and containing restriction endonuclease sequences for PstI incorporated into the 5' primer and BglII at the 5' end of 3' primer, taking care to ensure that the nucleic acid encoding the protein or polypeptide to be expressed is correctly positioned with respect to the poly A signal. The purified fragment obtained from the resulting PCR reaction is digested with PstI, blunt ended with an exonuclease, digested with BglII, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 g/ml G418 (Sigma, St. Louis, Mo.).

Alternatively, the nucleic acid encoding the protein or polypeptide to be expressed may be cloned into pED6dpc2 as described above. The resulting pED6dpc2 constructs may be transfected into a suitable host cell, such as COS 1 cells. Methotrexate resistant cells are selected and expanded. The expressed protein or polypeptide may be isolated, purified, or enriched as described above.

To confirm expression of the desired protein or polypeptide, the proteins or polypeptides produced by cells containing a vector with a nucleic acid insert encoding the protein or polypeptide are compared to those lacking such an insert. The expressed proteins are detected using techniques familiar to those skilled in the art such as Coomassie blue or silver staining or using antibodies against the protein or polypeptide encoded by the nucleic acid insert. Antibodies capable of specifically recognizing the protein of interest may be generated using synthetic 15-mer peptides having a sequence encoded by the appropriate nucleic acid. The synthetic peptides are injected into mice to generate antibody to the polypeptide encoded by the nucleic acid.

If the proteins or polypeptides encoded by the nucleic acid inserts are secreted, medium prepared from the host cells or organisms containing an expression vector which contains a nucleic acid insert encoding the desired protein or polypeptide is compared to medium prepared from the control cells or organism. The presence of a band in medium from the cells containing the nucleic acid insert which is absent from preparations from the control cells indicates that the protein or polypeptide encoded by the nucleic acid insert is being expressed and secreted. Generally, the band corresponding to the protein encoded by the nucleic acid insert will have a mobility near that expected based on the number of amino acids in the open reading frame of the nucleic acid insert. However, the band may have a mobility different than that expected as a result of modifications such as glycosylation, ubiquitination, or enzymatic cleavage.

Alternatively, if the protein expressed from the above expression vectors does not contain sequences directing its secretion, the proteins expressed from host cells containing an expression vector with an insert encoding a secreted protein or portion thereof can be compared to the proteins expressed in control host cells containing the expression vector without an insert. The presence of a band in samples from cells containing the expression vector with an insert which is absent in samples from cells containing the expression vector without an insert indicates that the desired protein or portion thereof is being expressed. Generally, the band will have the mobility expected for the secreted protein or portion thereof. However, the band may have a mobility different than that expected as a result of modifications such as glycosylation, ubiquitination,or enzymatic cleavage.

The expressed protein or polypeptide may be purified, isolated or enriched using a variety of methods. In some methods, the protein or polypeptide may be secreted into the culture medium via a native signal peptide or a heterologous signal peptide operably linked thereto. In some methods, the protein or polypeptide may be linked to a heterologous polypeptide which facilitates its isolation, purification, or enrichment such as a nickel binding polypeptide. The protein or polypeptide may also be obtained by gel electrophoresis, ion exchange chromatography, size chromatography, hplc, salt precipitation, immunoprecipitation, a combination of any of the preceding methods, or any of the isolation, purification, or enrichment techniques familiar to those skilled in the art.

The protein encoded by the nucleic acid insert may also be purified using standard immunochromatography techniques using immunoaffinity chromatography with antibodies directed against the encoded protein or polypeptide as described in more detail below. If antibody production is not possible, the nucleic acid insert encoding the desired protein or polypeptide may be incorporated into expression vectors designed for use in purification schemes employing chimeric polypeptides. In such strategies, the coding sequence of the nucleic acid insert is ligated in frame with the gene encoding the other half of the chimera. The other half of the chimera may be -globin or a nickel binding polypeptide. A chromatography matrix having antibody to -globin or nickel attached thereto is then used to purify the chimeric protein. Protease cleavage sites may be engineered between the β-globin gene or the nickel binding polypeptide and the extended cDNA or portion thereof. Thus, the two polypeptides of the chimera may be separated from one another by protease digestion.

One useful expression vector for generating -globin chimerics is pSG5 (Stratagene), which encodes rabbit -globin. Intron II of the rabbit -globin gene facilitates splicing of the expressed transcript, and the polyadenylation signal incorporated into the construct increases the level of expression. These techniques as described are well known to those skilled in the art of molecular biology. Standard methods are published in methods texts such as Davis et al., (*Basic Methods in Molecular Biolog*, L. G. Davis, M. D. Dibner, and J. F. Battey, ed., Elsevier Press, N.Y., 1986) and many of the methods are available from Stratagene, Life Technologies, Inc., or Promega. Polypeptide may additionally be produced from the construct using in vitro translation systems such as the In vitro Express™ Translation Kit (Stratagene).

Following expression and purification of the proteins or polypeptides encoded by the nucleic acid inserts, the purified proteins may be tested for the ability to bind to the surface of various cell types as described in Example 21 below. It will be appreciated that a plurality of proteins expressed from these nucleic acid inserts may be included in a panel of proteins to be simultaneously evaluated for the activities specifically described below, as well as other biological roles for which assays for determining activity are available.

EXAMPLE 21

Analysis of Secreted Proteins or Polypeptides to Determine Whether They Bind to the Cell Surface The EST-related nucleic acids, fragments of EST-related nucleic acids, positional segments of EST-related nucleic acids, fragments of positional segments of EST-related nucleic acids, nucleic acids encoding the EST-related polypeptides, nucleic acids encoding fragments of the EST-related polypeptides, nucleic acids encoding positional segments of EST-related polypeptides, or nucleic acids encoding fragments of positional segments of EST-related polypeptides are cloned into expression vectors such as those described in Example 20. The encoded proteins or polypeptides are purified, isolated, or enriched as described above. Following purification, isolation, or enrichment, the proteins or polypeptides are labeled using techniques known to those skilled in the art. The labeled proteins or polypeptides are incubated with cells or cell lines derived from a variety of organs or tissues to allow the proteins to bind to any receptor present on the cell surface. Following the incubation, the cells are washed to remove non-specifically bound proteins or polypeptides. The specifically bound labeled proteins or polypeptides are detected by autoradiography. Alternatively, unlabeled proteins or polypeptides may be incubated with the cells and detected with antibodies having a detectable label, such as a fluorescent molecule, attached thereto.

Specificity of cell surface binding may be analyzed by conducting a competition analysis in which various amounts of unlabeled protein or polypeptide are incubated along with the labeled protein or polypeptide. The amount of labeled protein or polypeptide bound to the cell surface decreases as the amount of competitive unlabeled protein or polypeptide increases. As a control, various amounts of an unlabeled protein or polypeptide unrelated to the labeled protein or polypeptide is included in some binding reactions. The amount of labeled protein or polypeptide bound to the cell surface does not decrease in binding reactions containing increasing amounts of unrelated unlabeled protein, indicating that the protein or polypeptide encoded by the nucleic acid binds specifically to the cell surface.

As discussed above, human proteins have been shown to have a number of important physiological effects and, consequently, represent a valuable therapeutic resource. The human proteins or polypeptides made as described above may be evaluated to determine their physiological activities as described below.

EXAMPLE 22

Assaying the Expressed Proteins or Polypeptides for Cytokine Cell Proliferation or Cell Differentiation Activity As discussed above, some human proteins act as cytokines or may affect cellular proliferation or differentiation. Many protein factors discovered to date, including all known cytokines, have exhibited activity in one or more factor dependent cell proliferation assays, and hence the assays serve as a convenient confirmation of cytokine activity. The activity of a protein or polypeptide of the present invention is evidenced by any one of a number of routine factor dependent cell proliferation assays for cell lines including, without limitation, 32D, DA2, DA1G, T10, B9, B9/11, BaF3, MC9/G, M$^+$ (preB M$^+$), 2E8, RB5, DA1, 123, T1165, HT2, CTLL2, TF-1, Mo7c and CMK. The proteins or polypeptides prepared as described above may be evaluated for their ability to regulate T cell or thymocyte proliferation in assays such as those described above or in the following references, which are incorporated herein by reference: *Current Protocols in Immunology*, Ed. by J. E. Coligan et al., Greene Publishing Associates and Wiley-Interscience; Takai et al. *J. Immunol.* 137:3494–3500, 1986, Bertagnolli et al. *J. Immunol.*145:1706–1712, 1990, Bertagnolli et al., *Cellular Immunology* 133:327–341, 1991. Bertagnolli, et al. *J. Immunol.* 149:3778–3783, 1992; Bowman et al. *J. Immunol.* 152:1756–1761, 1994.

In addition, numerous assays for cytokine production and/or the proliferation of spleen cells, lymph node cells and thymocytes are known. These include the techniques disclosed in *Current Protocols in Immunology.* J. E. Coligan et al. Eds., 1:3.12.1–3.12.14, John Wiley and Sons, Toronto. 1994; and Schreiber, R. D. In *Current Protocols in Immunology., supra* 1: 6.8.1–6.8.8.

The proteins or polypeptides prepared as described above may also be assayed for the ability to regulate the proliferation and differentiation of hematopoietic or lymphopoietic cells. Many assays for such activity are familiar to those skilled in the art, including the assays in the following references, which are incorporated herein by reference: Bottomly et al., In *Current Protocols in Immunology., supra.* 1:6.3.1–6.3.12,; deVries et al., *J. Exp. Med.* 173:1205–1211, 1991; Moreau et al., *Nature* 36:690–692, 1988; Greenberger et al. *Proc. Natl. Acad. Sci. USA.* 80:2931–2938, 1983; Nordan, R., In *Current Protocols in Immunology., supra.* 1:6.6.1–6.6.5; Smith et al., *Proc. Nat. Acad. Sci. USA.* 83:1857–1861, 1986; Bennett et al. in *Current Protocols in Immunology supra.* 1: 6.15.1; Ciarletta et al. In *Current Protocols in Immunology. supra* 1:6.13.1.

The proteins or polypeptides prepared as described above may also be assayed for their ability to regulate T-cell responses to antigens. Many assays for such activity are familiar to those skilled in the art, including the assays described in the following references, which are incorporated herein by reference: Chapter 3 (In vitro Assays for Mouse Lymphocyte Function), Chapter 6 (Cytokines and Their Cellular Receptors) and Chapter 7, (Immunologic Studies in Humans) in *Current Protocols in Immunology supra*; Weinberger et al., *Proc. Natl Acad. Sci. USA* 77:6091–6095, 1980; Weinberger et al., *Eur. J. Immun.* 11:405–411, 1981; Takai et al., *J. Immunol.* 137:3494–3500, 1986; Takai et al., *J. Immunol.* 140:508–512, 1988.

Those proteins or polypeptides which exhibit cytokine, cell proliferation, or cell differentiation activity may then be formulated as pharmaceuticals and used to treat clinical conditions in which induction of cell proliferation or differentiation is beneficial.

Alternatively, as described in more detail below, nucleic acids encoding these proteins or polypeptides or nucleic acids regulating the expression of these proteins or polypeptides may be introduced into appropriate host cells to increase or decrease the expression of the proteins or polypeptides as desired.

EXAMPLE 23

Assaying the Expressed Proteins or Polypeptides for Activity as Immune System Regulators The proteins or polypeptides prepared as described above may also be evaluated for their effects as immune regulators. For example, the proteins or polypeptides may be evaluated for their activity to influence thymocyte or splenocyte cytotoxicity. Numerous assays for such activity are familiar to those skilled in the art including the assays described in the following references, which are incorporated herein by reference: Chapter 3 (In vitro Assays for Mouse Lymphocyte Function 3.1–3.19) and Chapter 7 (Immunologic studies in Humans) in *Current Protocols in Immunology*, J. E. Coligan et al. Eds, Greene Publishing Associates and Wiley-Interscience; Herrmann et al., *Proc. Natl. Acad Sci. USA* 78:2488–2492, 1981; Herrmann et al., *J. Immunol.* 128:1968–1974, 1982; Handa et al., *J. Immunol.* 135:1564–1572, 1985; Takai et al., *J. Immunol.* 137:3494–3500, 1986; Takai et al., *J. Immunol.* 140:508–512, 1988; Bowman et al., *J. Virology* 61:1992–1998; Bertagnolli et al. *Cell. Immunol.* 133:327–341, 1991; Brown et al., *J. Immunol.* 153:3079–3092, 1994.

The proteins or polypeptides prepared as described above may also be evaluated for their effects on T-cell dependent immunoglobulin responses and isotype switching. Numerous assays for such activity are familiar to those skilled in the art, including the assays disclosed in the following references, which are incorporated herein by reference: Maliszewski, *J. Immunol.* 144:3028–3033, 1990; Mond et al. in *Current Protocols in Immunology*, 1:3.8.1–3.8.16, supra.

The proteins or polypeptides prepared as described above may also be evaluated for their effect on immune effector cells, including their effect on Th1 cells and cytotoxic lymphocytes. Numerous assays for such activity are familiar to those skilled in the art, including the assays disclosed in the following references, which are incorporated herein by reference: Chapter 3 (In vitro Assays for Mouse Lymphocyte Function 3.1–3.19) and Chapter 7 (Immunologic Studies in Humans) in *Current Protocols in Immunology, supra*; Takai et al., *J. Immunol.* 137:3494–3500, 1986; Takai et al.; *J. Immunol.* 140:508–512, 1988; Bertagnolli et al., *J. Immunol.* 149:3778–3783, 1992.

The proteins or polypeptides prepared as described above may also be evaluated for their effect on dendritic cell mediated activation of naive T-cells. Numerous assays for such activity are familiar to those skilled in the art, including the assays disclosed in the following references, which are incorporated herein by reference: Guery et al., *J. Immunol.* 134:536–544, 1995; Inaba et al., *J. Exp. Med.* 173:549–559, 1991; Macatonia et al., *J. Immunol.* 154:5071–5079, 1995; Porgador et al., *J. Exp. Med.* 182:255–260, 1995; Nair et al., *J. Virol.* 67:4062–4069, 1993; Huang et al., *Science* 264:961–965, 1994; Macatonia et al., *J. Exp. Med* 169:1255–1264, 1989; Bhardwaj et al., *Journal of Clinical Investigation* 94:797–807, 1994; and Inaba et al., *J. Exp. Med* 172:631–640, 1990.

The proteins or polypeptides prepared as described above may also be evaluated for their influence on the lifetime of lymphocytes. Numerous assays for such activity are familiar to those skilled in the art, including the assays disclosed in the following references, which are incorporated herein by reference: Darzynkiewicz et al., *Cytometry* 13:795–808, 1992; Gorczyca et al., *Leukemia* 7:659–670, 1993; Gorczyca et al., *Cancer Res.* 53:1945–1951, 1993; Itoh et al., *Cell* 66:233–243, 1991; Zacharchuk, *J. Immunol.* 145:4037–4045, 1990; Zamai et al., *Cytometry* 14:891–897, 1993; Gorczyca et al., *Int. J. Oncol.* 1:639–648, 1992.

The proteins or polypeptides prepared as described above may also be evaluated for their influence on early steps of T-cell commitment and development. Numerous assays for such activity are familiar to those skilled in the art, including without limitation the assays disclosed in the following references, which are incorporated herein by references: Antica et al., *Blood* 84:111–117, 1994; Fine et al., *Cell. Immunol.* 155:111–122, 1994; Galy et al., *Blood* 85:2770–2778, 1995; Toki et al., *Proc. Nat. Acad Sci. USA* 88:7548–7551, 1991.

Those proteins or polypeptides which exhibit activity as immune system regulators activity may then be formulated as pharmaceuticals and used to treat clinical conditions in which regulation of immune activity is beneficial. For example, the protein or polypeptide may be useful in the treatment of various immune deficiencies and disorders (including severe combined immunodeficiency), e.g., in regulating (up or down) growth and proliferation of T and/or B lymphocytes, as well as effecting the cytolytic activity of NK cells and other cell populations. These immune deficiencies may be genetic or be caused by viral (e.g., HIV) as well as bacterial or fungal infections, or may result from autoimmune disorders. More specifically, infectious diseases caused by viral, bacterial, fungal or other infection may be treatable using the protein or polypeptide including infections by HIV, hepatitis viruses, herpesviruses, mycobacteria, Leishmania spp., plamodium and various fungal infections such as candidiasis. Of course, in this regard, a protein or polypeptide may also be useful where a boost to the immune system generally may be desirable, i.e., in the treatment of cancer.

Alternatively, the proteins or polypeptides prepared as described above may be used in treatment of autoimmune disorders including, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitis, myasthenia gravis, graft-versus-host disease and autoimmune inflammatory eye disease. Such a protein or polypeptide may also to be useful in the treatment of allergic reactions and conditions, such as asthma (particularly allergic asthma) or other respiratory problems. Other conditions, in which immune suppression is desired (including, for example, organ transplantation), may also be treatable using the protein or polypeptide.

Using the proteins or polypeptides of the invention it may also be possible to regulate immune responses either up or down. Down regulation may involve inhibiting or blocking an immune response already in progress or may involve preventing the induction of an immune response. The functions of activated T-cells may be inhibited by suppressing T cell responses or by inducing specific tolerance in T cells, or both. Immunosuppression of T cell responses is generally an active non-antigen-specificprocess which requires continuous exposure of the T cells to the suppressive agent. Tolerance, which involves inducing non-responsiveness or anergy in T cells, is distinguishable from immunosuppression in that it is generally antigen-specific and persists after the end of exposure to the tolerizing agent. Operationally, tolerance can be demonstrated by the lack of a T cell response upon reexposure to specific antigen in the absence of the tolerizing agent.

Down regulating or preventing one or more antigen functions (including without limitation B lymphocyte antigen functions, such as, for example, B7 costimulation), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a molecule which inhibits or blocks interaction of a B7 lymphocyte antigen with its natural ligand(s) on immune cells (such as a soluble, monomeric form of a peptide having B7-2 activity alone or in conjunction with a monomeric form of a peptide having an activity of another B lymphocyte antigen (e.g., B7-1, B7-3) or blocking antibody), prior to transplantation, can lead to the binding of the molecule to the natural ligand(s) on the immune cells without transmitting the corresponding costimulatory signal. Blocking B lymphocyte antigen function in this matter prevents cytokine synthesis by immune cells, such as T cells, and thus acts as an immunosuppressant. Moreover, the lack of costimulation may also be sufficient to anergize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular blocking reagents in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA4Ig fusion proteins in vivo as described in Lenschow et al. *Science* 257:789–792 (1992)and Turka et al., *Proc. Natl. Acad. Sci USA*, 89:11102–11105 (1992). In addition, murine models of GVHD (see Paul ed., *Fundamental Immunology*, Raven Press, New York, 1989, pp. 846–847) can be used to determine the effect of blocking B lymphocyte antigen function in vivo on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block costimulation of T cells by disrupting receptor/ligand interactions of B lymphocyte antigens can be used to inhibit T cell activation and prevent production of autoantibodies or T cell-derived cytokines which potentially involved in the disease process. Additionally, blocking reagents may induce antigen-specifictolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/pr/pr mice or NZB hybrid mice, murine autoimmuno collagen arthritis, diabetes mellitus in OD mice and BB rats, and murine experimental myasthenia gravis (see Paul ed., Fundamental Immunology, Raven Press, New York, 1989, pp. 840–856).

Upregulation of an antigen function (preferably a B lymphocyte antigen function), as a means of up regulating immune responses, may also be useful in therapy. Upregulation of immune responses may involve either enhancing an existing immune response or eliciting an initial immune response as shown by the following examples. For instance, enhancing an immune response through stimulating B lymphocyte antigen function may be useful in cases of viral infection. In addition, systemic viral diseases such as influenza, the common cold, and encephalitis might be alleviated by the administration of stimulatory form of B lymphocyte antigens systemically.

Alternatively, antiviral immune responses may be enhanced in an infected patient by removing T cells from the patient, costimulating the T cells in vitro with viral antigen-pulsed APCs either expressing the proteins or polypeptides described above or together with a stimulatory form of the protein or polypeptide and reintroducing the in vitro primed T cells into the patient. The infected cells would now be capable of delivering a costimulatory signal to T cells in vivo, thereby activating the T cells.

In another application, upregulation or enhancement of antigen function (preferably B lymphocyte antigen function) may be useful in the induction of tumor immunity. Tumor cells (e.g., sarcoma, melanoma, lymphoma, leukemia, neuroblastoma, carcinoma) transfected with one of the above-described nucleic acids encoding a protein or polypeptide can be administered to a subject to overcome tumor-specific tolerance in the subject. If desired, the tumor cell can be transfected to express a combination of peptides. For example, tumor cells obtained from a patient can be transfected ex vivo with an expression vector directing the expression of a peptide having B7-2-like activity alone, or in conjunction with a peptide having B7-1-like activity and/or B7-3-like activity. The transfected tumor cells are returned to the patient to result in expression of the peptides on the surface of the transfected cell. Alternatively, gene therapy techniques can be used to target a tumor cell for transfection in vivo.

The presence of the protein or polypeptide encoded by the nucleic acids described above having the activity of a B lymphocyte antigen(s) on the surface of the tumor cell provides the necessary costimulation signal to T cells to induce a T cell mediated immune response against the transfected tumor cells. In addition, tumor cells which lack or which fail to reexpress sufficient amounts of MHC class I or MHC class II molecules can be transfected with nucleic acids encoding all or a portion of (e.g., a cytoplasmic-domain truncated portion) of an MHC class I chain and microglobulin or an MHC class II α chain and an MHC class II chain to thereby express MHC class I or MHC class II proteins on the cell surface, respectively. Expression of the appropriate MHC class I or class II molecules in conjunction with a peptide having the activity of a B lymphocyte antigen (e.g., B7-1, B7-2, B7-3) induces a T cell mediated immune response against the transfected tumor cell. Optionally, a nucleic acid encoding an antisense construct which blocks expression of an MHC class II associated protein, such as the invariant chain, can also be cotransfected with a DNA encoding a protein or polypeptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject. Alternatively, as described in more detail below, nucleic acids encoding these immune system regulator proteins or polypeptides or nucleic acids regulating the expression of such proteins or polypeptides may be introduced into appropriate host cells to increase or decrease the expression of the proteins as desired.

EXAMPLE 24

Assaying the Expressed Proteins or Polypeptides for Hematopoiesis Regulating Activity The proteins or polypeptides encoded by the nucleic acids described above may also be evaluated for their hematopoiesis regulating activity. For example, the effect of the proteins or polypeptides on embryonic stem cell differentiation may be evaluated. Numerous assays for such activity are familiar to those skilled in the art, including the assays disclosed in the following references, which are incorporated herein by reference: Johansson et al. Cell. Biol. 15:141–151, 1995; Keller et al., Mol. Cell. Biol. 13:473–486, 1993; McClanahan et al., Blood 81:2903–2915, 1993.

The proteins or polypeptides encoded by the nucleic acids described above may also be evaluated for their influence on the lifetime of stem cells and stem cell differentiation. Numerous assays for such activity are familiar to those skilled in the art, including the assays disclosed in the following references, which are incorporated herein by reference: Freshney, M. G. Methylcellulose Colony Forming Assays, in Culture of Hematopoietic Cells. R. I. Freshney, et al. Eds. pp. 265–268, Wiley-Liss, Inc., New York, N.Y. 1994; Hirayama et al., Proc. Natl. Acad. Sci. USA 89:5907–5911, 1992; McNiece, I. K. and Briddell, R. A. Primitive Hematopoietic Colony Forming Cells with High Proliferative Potential, in Culture of Hematopoietic Cells. R. I. Freshney, et al. eds. Vol pp. 23–39, Wiley-Liss, Inc., New York, N.Y. 1994; Neben et al., Experimental Hematology 22:353–359, 1994; Ploemacher, R. E. Cobblestone Area Forming Cell Assay, In Culture of Hematopoietic Cells. R. I. Freshney, et al. Eds. pp. 1–21, Wiley-Liss, Inc., New York, N.Y. 1994; Spooncer, E., Dexter, M. and Allen, T. Long Term Bone Marrow Cultures in the Presence of Stromal Cells, in Culture of Hematopoietic Cells. R. I. Freshney, et al. Eds. pp. 163–179, Wiley-Liss, Inc., New York, N.Y. 1994; and Sutherland, H. J. Long Term Culture Initiating Cell Assay, in Culture of Hematopoietic Cells. R. I. Freshney, et al. Eds. pp. 139–162, Wiley-Liss, Inc., New York, N.Y. 1994.

Those proteins or polypeptides which exhibit hematopoiesis regulatory activity may then be formulated as pharmaceuticals and used to treat clinical conditions in which regulation of hematopoeisis is beneficial. For example, a protein or polypeptide of the present invention may be useful in regulation of hematopoiesis and, consequently, in the treatment of myeloid or lymphoid cell deficiencies. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelosuppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantion, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy. Alternatively, as described in more detail below, nucleic acids encoding these proteins or polypeptides or nucleic acids regulating the expression of these proteins or polypeptides may be introduced into appropriate host cells to increase or decrease the expression of the proteins as desired.

EXAMPLE 25

Assaying the Expressed Proteins or Polypeptides for Regulation of Tissue Growth The proteins or polypeptides encoded by the nucleic acids described above may also be evaluated for their effect on tissue growth. Numerous assays for such activity are familiar to those skilled in the art, including the assays disclosed in International Patent Publication No. WO95/16035, International Patent Publication No. WO95/05846 and International Patent Publication No. WO91/07491, which are incorporated herein by reference.

Assays for wound healing activity include, without limitation, those described in: Winter, *Epidermal Wound Healing*, pps. 71–112 (Maibach, H1 and Rovee, D T, eds.), Year Book Medical Publishers, Inc., Chicago, as modified by Eaglstein and Mertz, J. Invest. Dermatol 71:382–84 (1978) which are incorporated herein by reference.

Those proteins or polypeptides which are involved in the regulation of tissue growth may then be formulated as pharmaceuticals and used to treat clinical conditions in which regulation of tissue growth is beneficial. For example, a protein or polypeptide may have utility in compositions used for bone, cartilage, tendon, ligament and/or nerve tissue growth or regeneration, as well as for wound healing and tissue repair and replacement, and in the treatment of burns, incisions and ulcers.

A protein or polypeptide encoded by the nucleic acids described above which induces cartilage and/or bone growth in circumstances where bone is not normally formed, has application in the healing of bone fractures and cartilage damage or defects in humans and other animals. Such a preparation employing a protein or polypeptide of the invention may have prophylactic use in closed as well as open fracture reduction and also in the improved fixation of artificial joints. De novo bone synthesis induced by an osteogenic agent contributes to the repair of congenital, trauma induced, or oncologic resection induced craniofacial defects, and also is useful in cosmetic plastic surgery.

A protein or polypeptide of this invention may also be used in the treatment of periodontal disease, and in other tooth repair processes. Such agents may provide an environment to attract bone-forming cells, stimulate growth of bone-forming cells or induce differentiation of progenitors of bone-forming cells. A protein of the invention may also be useful in the treatment of osteoporosis or osteoarthritis, such as through stimulation of bone and/or cartilage repair or by blocking inflammation or processes of tissue destruction (collagenase activity, osteoclast activity, etc.) mediated by inflammatory processes.

Another category of tissue regeneration activity that may be attributable to the proteins or polypeptides encoded by the nucleic acids described above is tendon/ligament formation. A protein or polypeptide encoded by the nucleic acids described above, which induces tendon/ligament-liketissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-liketissue formation induced by a protein or polypeptide of the present invention contributes to the repair of tendon or ligaments defects of congenital, traumatic or other origin and is also useful in cosmetic plastic surgery for attachment or repair of tendons or ligaments. The proteins or polypeptides of the present invention may provide an environment to attract tendon- or ligament-forming cells, stimulate growth of tendon- or ligament-forming cells, induce differentiation of progenitors of tendon- or ligament-forming cells, or induce growth of tendon/ligamentcells or progenitors ex vivo for return in vivo to effect tissue repair. The proteins or polypeptides of the invention may also be useful in the treatment of tendinitis, carpal tunnel syndrome and other tendon or ligament defects. The therapeutic compositions may also include an appropriate matrix and/or sequestering agent as a carrier as is well known in the art.

The proteins or polypeptides of the present invention may also be useful for proliferation of neural cells and for regeneration of nerve and brain tissue, i.e., for the treatment of central and peripheral nervous system diseases and neuropathies, as well as mechanical and traumatic disorders, which involve degeneration, death or trauma to neural cells or nerve tissue. More specifically, a protein or polypeptide may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovasculardiseases such as stroke. Peripheral neuropathies resulting from chemotherapy or other medical therapies may also be treatable using a protein or polypeptide of the invention.

Proteins or polypeptides of the invention may also be useful to promote better or faster closure of non-healing wounds, including without limitation pressure ulcers, ulcers associated with vascular insufficiency, surgical and traumatic wounds, and the like.

It is expected that a protein or polypeptide of the present invention may also exhibit activity for generation or regeneration of other tissues, such as organs (including, for example, pancreas, liver, intestine, kidney, skin, endothelium) muscle (smooth, skeletal or cardiac) and vascular (including vascular endothelium) tissue, or for promoting the growth of cells comprising such tissues. Part of the desired effects may be by inhibition or modulation of fibrotic scarring to allow normal tissue to generate. A protein or polypeptide of the invention may also exhibit angiogenic activity.

A protein or polypeptide of the present invention may also be useful for gut protection or regeneration and treatment of lung or liver fibrosis, reperfusion injury in various tissues, and conditions resulting from systemic cytokine damage.

A protein or polypeptide of the present invention may also be useful for promoting or inhibiting differentiation of tissues described above from precursor tissues or cells; or for inhibiting the growth of tissues described above.

Alternatively, as described in more detail below, nucleic acids encoding tissue growth regulating activity proteins or polypeptides or nucleic acids regulating the expression of such proteins or polypeptides may be introduced into appropriate host cells to increase or decrease the expression of the proteins as desired.

EXAMPLE 26

Assaying the Expressed Proteins or Polypeptides for Regulation of Reproductive Hormones The proteins or polypeptides of the present invention may also be evaluated for their ability to regulate reproductive hormones, such as follicle stimulating hormone. Numerous assays for such activity are familiar to those skilled in the art, including the assays disclosed in the following references, which are incorporated herein by reference: Vale et al., *Endocrinol.* 91:562–572, 1972; Ling et al., *Nature* 321:779–782, 1986; Vale et al., *Nature* 321:776–779, 1986; Mason et al., *Nature* 318:659–663, 1985; Forage et al., *Proc. Natl. Acad. Sci. USA* 83:3091–3095, 1986. Chapter 6.12 in *Current Protocols in Immunology*, J. E. Coligan et al. Eds. Greene Publishing Associates and Wiley-Intersciece; Taub et al. *J. Clin. Invest.* 95:1370–1376, 1995; Lind et al. *APMIS* 103:140–146, 1995; Muller et al., *Eur. J. Immunol.* 25:1744–1748; Gruber et al. *J. Immunol.* 152:5860–5867, 1994; Johnston et al. *J Immunol.* 153:1762–1768, 1994.

Those proteins or polypeptides which exhibit activity as reproductive hormones or regulators of cell movement may then be formulated as pharmaceuticals and used to treat clinical conditions in which regulation of reproductive hormones are beneficial. For example, a protein or polypeptide may exhibit activin- or inhibin-related activities. Inhibins are characterized by their ability to inhibit the release of follicle stimulating hormone (FSH), while activins are characterized by their ability to stimulate the release of FSH. Thus, a protein or polypeptide of the present invention, alone or in heterodimers with a member of the inhibin a family, may be useful as a contraceptive based on the ability of inhibins to decrease fertility in female mammals and decrease spermatogenesis in male mammals. Administration of sufficient amounts of other inhibins can induce infertility in these mammals. Alternatively, the protein or polypeptide of the invention, as a homodimer or as a heterodimer with other protein subunits of the inhibin-B group, may be useful as a fertility inducing therapeutic, based upon the ability of activin molecules in stimulating FSH release from cells of the anterior pituitary. See, for example, U.S. Pat. No. 4,798, 885, the disclosure of which is incorporated herein by reference. A protein or polypeptide of the invention may also be useful for advancement of the onset of fertility in sexually immature mammals, so as to increase the lifetime reproductive performance of domestic animals such as cows, sheep and pigs.

Alternatively, as described in more detail below, nucleic acids encoding reproductive hormone regulating activity proteins or polypeptides or nucleic acids regulating the expression of such proteins or polypeptides may be introduced into appropriate host cells to increase or decrease the expression of the proteins or polypeptides as desired.

EXAMPLE 27

Assaying the Expressed Proteins or Polypeptides For Chemotactic/Chemokinetic Activity The proteins or polypeptides of the present invention may also be evaluated for chemoatactic/chemokinetic acitivity. For example, a protein or polypeptide of the present invention may have chemotactic or chemokinetic activity (e.g., act as a chemokine) for mammalian cells, including, for example, monocytes, fibroblasts, neutrophils, T-cells, mast cells eosinophils, epithelial and/or endothelial cells. Chemotactic and chemokinetic proteins or polypeptides can be used to mobilize or attract a desired cell population to a desired site of action. Chemotactic or chemokinetic proteins or polypeptides provide particular advantages in treatment of wounds and other trauma to tissues, as well as in treatment of localized infections. For example, attraction of lymphocytes, monocytes or neutrophils to tumors or sites of infection may result in improved immune response against the tumor or infecting agent.

A protein or polypeptide has chemotactic activity for a particular cell population if it can stimulate, directly or indirectly, the directed orientation or movement of such cell population. Preferably, the protein or polypeptide has the ability to directly stimulate directed movement of cells. Whether a particular protein or polypeptide has chemotactic activity for a population of cells can be readily determined by employing such protein or polypeptide in any known assay for cells chemotaxis.

The activity of a protein or polypeptide of the invention may, among other means, be measured by the following methods:

Assays for chemotactic activity (which will identify proteins or polypeptides that induce or prevent chemotaxis) consist of assays that measure the ability of a protein or polypeptide to induce the migration of cells across a membrane as well as the ability of a protein or polypeptide to induce the adhesion of one cell population to another cell population. Suitable assays for movement and adhesion include, without limitation, those described in: *Current Protocols in Immunology*, Ed by J. E. Coligan, A. M. Kruisbeek, D. H. Margulies, E. M. Shevach, W. Strober, Pub. Greene Publishing Associates and Wiley-Interscience, Chapter 6.12: 6.12.1–6.12.28; Taub et al. *J. Clin. Invest.* 95:1370–1376, 1995; Lind et al. *APMIS* 103:140–146, 1995; Mueller et al., *Eur. J. Immunol.* 25:1744–1748; Gruber et al. *J. Immunol.* 152:5860–5867, 1994; Johnston et al. *J. Immunol.*, 153:1762–1768, 1994.

EXAMPLE 28

Assaying the Expressed Proteins or Polypeptides for Regulation of Blood Clotting The proteins or polypeptides of the present invention may also be evaluated for their effects on blood clotting. Numerous assays for such activity are familiar to those skilled in the art, including the assays disclosed in the following references, which are incorporated herein by reference: Linet et al., *J. Clin. Pharmacol.* 26:131–140, 1986; Burdick et al., *Thrombosis Res.* 45:413–419, 1987; Humphrey et al, *Fibrinolysis* 5:71–79 (1991); Schaub, *Prostaglandins* 35:467–474, 1988.

Those proteins or polypeptides which are involved in the regulation of blood clotting may then be formulated as pharmaceuticals and used to treat clinical conditions in which regulation of blood clotting is beneficial. For example, a protein or polypeptide of the invention may also exhibit hemostatic or thrombolytic activity. As a result, such a protein or polypeptide is expected to be useful in treatment of various coagulations disorders (including hereditary disorders, such as hemophilias) or to enhance coagulation and other hemostatic events in treating wounds resulting from trauma, surgery or other causes. A protein or polypeptide of the invention may also be useful for dissolving or inhibiting formation of thromboses and for treatment and prevention of conditions resulting therefrom (such as infarction of cardiac and central nervous system vessels (e.g., stroke)). Alternatively, as described in more detail below, nucleic acids encoding blood clotting activity proteins or polypeptides or nucleic acids regulating the expression of such proteins or polypeptides may be introduced into appropriate host cells to increase or decrease the expression of the proteins or polypeptides as desired.

EXAMPLE 29

Assaying the Expressed Proteins or Polypeptides for Involvement in Receptor/Ligand Interactions The proteins or polypeptides of the present invention may also be evaluated for their involvement in receptor/ligand interactions. Numerous assays for such involvement are familiar to those skilled in the art, including the assays disclosed in the following references, which are incorporated herein by reference: Chapter 7. 7.28.1–7.28.22) in *Current Protocols in Immunology*, J. E. Coligan et al. Eds. Greene Publishing Associates and Wiley-Interscience; Takai et al., *Proc. Natl. Acad. Sci. USA* 84:6864–6868, 1987; Bierer et al., *J. Exp. Med.* 168:1145–1156, 1988; Rosensteinet al., *J. Exp. Med.* 169:149–160, 1989; Stoltenborg et al., *J. Immunol. Methods* 175:59–68, 1994; Stitt el al., *Cell* 80:661–670, 1995; Gyuris et al., *Cell* 75:791–803, 1993.

For example, the proteins or polypeptides of the present invention may also demonstrate activity as receptors, receptor ligands or inhibitors or agonists of receptor/ligand interactions. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selectins, integrins and their ligands) and receptor/ligand pairs involved in antigen presentation, antigen recognition and development of cellular and humoral immune responses). Receptors and ligands are also useful for screening of potential peptide or small molecule inhibitors of the relevant receptor/ligand interaction. A protein or polypeptide of the present invention (including, without limitation, fragments of receptors and ligands) may be useful as inhibitors of receptor/ligand interactions. Alternatively, as described in more detail below, nucleic acids encoding proteins or polypeptides involved in receptor/ligand interactions or nucleic acids regulating the expression of such proteins or polypeptides may be introduced into appropriate host cells to increase or decrease the expression of the proteins or polypeptides as desired.

EXAMPLE 30

Assaying the Proteins or Polypeptides for Anti-Inflammatory Activity

The proteins or polypeptides of the present invention may also be evaluated for anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Proteins or polypeptides exhibiting such activities can be used to treat inflammatory conditions including chronic or acute conditions, including without limitation inflammation associated with infection (such as septic shock, sepsis or systemic inflammatory response syndrome), ischemia-reperfusioninury, endotoxin lethality, arthritis, complement-mediated hyperacute rejection, nephritis, cytokine- or chemokine-induced lung injury, inflammatory bowel disease, Crohn's disease or resulting from over production of cytokines such as TNF or IL-1. Proteins or polypeptides of the invention may also be useful to treat anaphylaxis and hypersensitivity to an antigenic substance or material. Alternatively, as described in more detail below, nucleic acids encoding anti-inflammatory activity proteins or polypeptides or nucleic acids regulating the expression of such proteins or polypeptides may be introduced into appropriate host cells to increase or decrease the expression of the proteins or polypeptides as desired.

EXAMPLE 31

Assaying the Expressed Proteins or Polypeptides for Tumor Inhibition Activity

The proteins or polypeptides of the present invention may also be evaluated for tumor inhibition activity. In addition to the activities described above for immunological treatment or prevention of tumors, a protein or polypeptide of the invention may exhibit other anti-tumor activities. A protein or polypeptide may inhibit tumor growth directly or indirectly (such as, for example, via ADCC). A protein or polypeptide may exhibit its tumor inhibitory activity by acting on tumor tissue or tumor precursor tissue, by inhibiting formation of tissues necessary to support tumor growth (such as, for example, by inhibiting angiogenesis), by causing production of other factors, agents or cell types which inhibit tumor growth, or by suppressing, eliminating or inhibiting factors, agents or cell types which promote tumor growth. Alternatively, as described in more detail below, nucleic acids encoding proteins or polypeptides with tumor inhibition activity or nucleic acids regulating the expression of such proteins or polypeptides may be introduced into appropriate host cells to increase or decrease the expression of the proteins or polypeptides as desired.

A protein or polypeptide of the invention may also exhibit one or more of the following additional activities or effects: inhibiting the growth, infection or function of, or killing, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, cofactors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein. Alternatively, as described in more detail below, nucleic acids encoding proteins or polypeptides involved in any of the above mentioned activities or nucleic acids regulating the expression of such proteins may be introduced into appropriate host cells to increase or decrease the expression of the proteins or polypeptides as desired.

EXAMPLE 32

Identification of Proteins or Polypeptides Which Interact With Proteins or Polypeptides of the Present Invention Proteins or polypeptides which interact with the proteins or polypeptides of the present invention, such as receptor proteins, may be identified using two hybrid systems such as the Matchmaker Two Hybrid System 2 (Catalog No. K1604-1, Clontech). As described in the manual accompanying the kit which is incorporated herein by reference, nucleic acids encoding the proteins or polypeptides of the present invention, are inserted into an expression vector such that they are in frame with DNA encoding the DNA binding domain of the yeast transcriptional activator GAL4. cDNAs in a CDNA library which encode proteins or polypeptides which might interact with the proteins or polypeptides of the present invention are inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain plasmids encoding proteins or polypeptides which interact with the proteins or polypeptides of the present invention.

Alternatively, the system described in Lustig et al., *Methods in Enzymology* 283: 83–99 (1997), the disclosure of which is incorporated herein by reference, may be used for identifying molecules which interact with the proteins or polypeptides of the present invention. In such systems, in vitro transcription reactions are performed on a pool of vectors containing nucleic acid inserts which encode the proteins or polypeptides of the present invention. The nucleic acid inserts are cloned downstream of a promoter which drives in vitro transcription. The resulting pools of mRNAs are introduced into *Xenopus laevis* oocytes. The oocytes are then assayed for a desired activity.

Alternatively, the pooled in vitro transcription products produced as described above may be translated in vitro. The pooled in vitro translation products can be assayed for a desired activity or for interaction with a known protein or polypeptide.

Proteins, polypeptides or other molecules interacting with proteins or polypeptides of the present invention can be found by a variety of additional techniques. In one method, affinity columns containing the protein or polypeptide of the present invention can be constructed. In some versions, of this method the affinity column contains chimeric proteins in which the protein or polypeptide of the present invention is fused to glutathione S-transferase. A mixture of cellular proteins or pool of expressed proteins as described above and is applied to the affinity column. Molecules interacting with the protein or polypeptide attached to the column can then be isolated and analyzed on 2-D electrophoresis gel as described in Ramunsen et al. *Electrophoresis*, 18, 588–598 (1997), the disclosure of which is incorporated herein by reference. Alternatively, the molecules retained on the affinity column can be purified by electrophoresis based methods and sequenced. The same method can be used to isolate antibodies, to screen phage display products, or to screen phage display human antibodies.

Molecules interacting with the proteins or polypeptides of the present invention can also be screened by using an Optical Biosensor as described in Edwards & Leatherbarrow, *Analytical Biochemistry*, 246, 1–6 (1997), the disclosure of which is incorporated herein by reference. The main advantage of the method is that it allows the determination of the association rate between the protein or polypeptide and other interacting molecules. Thus, it is possible to specifically select interacting molecules with a high or low association rate. Typically a target molecule is linked to the sensor surface (through a carboxymethl dextran matrix) and a sample of test molecules is placed in contact with the target molecules. The binding of a test molecule to the target molecule causes a change in the refractive index and/or thickness. This change is detected by the Biosensor provided it occurs in the evanescent field (which extend a few hundred nanometers from the sensor surface). In these screening assays, the target molecule can be one of the proteins or polypeptides of the present invention and the test sample can be a collection of proteins, polypeptides or other molecules extracted from tissues or cells, a pool of expressed proteins, combinatorial peptide and/or chemical libraries, or phage displayed peptides. The tissues or cells from which the test molecules are extracted can originate from any species.

In other methods, a target protein or polypeptide is immobilized and the test population is a collection of unique proteins or polypeptides of the present invention.

To study the interaction of the proteins or polypeptides of the present invention with drugs, the microdialysis coupled to HPLC method described by Wang et al., *Chromatographia*, 44, 205–208(1997) or the affinity capillary electrophoresis method described by Busch et al., *J. Chromatogr*. 777:311–328 (1997), the disclosures of which are incorporated herein by reference can be used.

The system described in U.S. Pat. No. 5,654,150, the disclosure of which is incorporated herein by reference, may also be used to identify molecules which interact with the proteins or polypeptides of the present invention. In this system, pools of nucleic acids encoding the proteins or polypeptides of the present invention are transcribed and translated in vitro and the reaction products are assayed for interaction with a known polypeptide or antibody.

It will be appreciated by those skilled in the art that the proteins or polypeptides of the present invention may be assayed for numerous activities in addition to those specifically enumerated above. For example, the expressed proteins or polypeptides may be evaluated for applications involving control and regulation of inflammation, tumor proliferation or metastasis, infection, or other clinical conditions. In addition, the proteins or polypeptides may be useful as nutritional agents or cosmetic agents.

Epitopes and Antibody Fusions

A preferred embodiment of the present invention is directed to eiptope-bearing polypeptides and epitope-bearing polypeptide fragments. These epitopes may be "antigenic epitopes" or both an "antigenic epitope" and an "immunogenic epitope". An "immunogenic epitope" is defined as a part of a protein that elicits an antibody response in vivo when the polypeptide is the immunogen. On the other hand, a region of polypeptide to which an antibody binds is defined as an "antigenic determinant" or "antigenic epitope." The number of immunogenic epitopes of a protein generally is less than the number of antigenic epitopes. See, e.g., Geysen, et al. (1983) Proc. Natl. Acad. Sci. USA 81:39984002. It is particularly noted that although a particular epitope may not be immunogenic, it is nonetheless useful since antibodies can be made in vitro to any epitope.

An epitope can comprise as few as 3 amino acids in a spatial conformation which is unique to the epitope. Generally an epitope consists of at least 6 such amino acids, and more often at least 8–10 such amino acids. In preferred embodiment, antigenic epitopes comprise a number of amino acids that is any integer between 3 and 50. Fragments which function as epitopes may be produced by any conventional means. See, e.g., Houghten, R. A., Proc. Natl. Acad. Sci. USA 82:5131–5135 (1985), further described in U.S. Pat. No. 4,631,211, the disclosures of which are incorporated herein by reference in their entireties. Methods for determining the amino acids which make up an immunogenic epitope include x-ray crystallography, 2-dimensional nuclear magnetic resonance, and epitope mapping, e.g., the Pepscan method described by H. Mario Geysen et al. (1984); Proc. Natl. Acad. Sci. U.S.A. 81:3998–4002; PCT Publication No. WO 84/03564; and PCT Publication No. WO 84/03506, the disclosures of which are incorporated herein by reference in their entireties. Another example is the algorithm of Jameson and Wolf, Comp. Appl. Biosci. 4:181–186 (1988) (said references incorporated by reference in their entireties). The Jameson-Wolf antigenic analysis, for example, may be performed using the computer program PROTEAN, using default parameters (Version 4.0 Windows, DNASTAR, Inc., 1228 South Park Street Madison, Wis.

The epitope-bearing fragments of the present invention preferably comprises 6 to 50 amino acids (i.e. any integer between 6 and 50, inclusive) of a polypeptide of the present invention. Also, included in the present invention are antigenic fragments between the integers of 6 and the full length sequence of the sequence listing. All combinations of sequences between the integers of 6 and the full-length sequence of a polypeptide of the present invention are included. The epitope-bearing fragments may be specified by either the number of contiguous amino acid residues (as a sub-genus) or by specific N-terminal and C-terminal positions (as species) as described above for the polypeptide fragments of the present invention. Any number of epitope-bearing fragments of the present invention may also be excluded in the same manner.

Antigenic epitopes are useful, for example, to raise antibodies, including monoclonal antibodies that specifically bind the epitope (See, Wilson et al., 1984; and Sutcliffe, J. G. et al., 1983). The antibodies are then used in various techniques such as diagnostic and tissue/cell identification techniques, as described herein, and in purification methods.

Similarly, immunogenic epitopes can be used to induce antibodies according to methods well known in the art (See, Sutcliffe et al., supra; Wilson et al., supra; Chow, M. et al.; (1985) and Bittle, F. J. et al., (1985). A preferred immunogenic epitope includes the polypeptides of the sequence listing. The immunogenic epitopes may be presented together with a carrier protein, such as an albumin, to an animal system (such as rabbit or mouse) or, if it is long enough (at least about 25 amino acids), without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting.).

Epitope-bearing polypeptides of the present invention are used to induce antibodies according to methods well known in the art including, but not limited to, in vivo immunization, in vitro immunization, and phage display methods (See, e.g., Sutcliffe, et al., supra; Wilson, et al., supra, and Bittle, et al., 1985). If in vivo immunization is used, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine residues may be coupled to a carrier using a linker such as—maleimidobenzoyl-N-hydroxysuccinimide ester (MBS), while other peptides may be coupled to carriers using a more general linking agent such as glutaraldehyde. Animals such as rabbits, rats and mice are immunized with either free or carrier-coupled peptides, for instance, by intraperitoneal and/or intradermal injection of emulsions containing about 100 $\mu$gs of peptide or carrier protein and Freund's adjuvant. Several booster injections may be needed, for instance, at intervals of about two weeks, to provide a useful titer of anti-peptide antibody, which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

As one of skill in the art will appreciate, and discussed above, the polypeptides of the present invention comprising an immunogenic or antigenic epitope can be fused to heterologous polypeptide sequences. For example, the polypeptides of the present invention may be fused with the constant domain of immunoglobulins (IgA, IgE, IgG, IgM), or portions thereof (CH1, CH2, CH3, any combination thereof including both entire domains and portions thereof) resulting in chimeric polypeptides. These fusion proteins facilitate purification, and show an increased half-life in vivo. This has been shown, e.g., for chimeric proteins consisting of the first two domains of the human CD4-polypeptide and various domains of the constant regions of the heavy or light chains of mammalian immunoglobulins (See, e.g., EPA 0,394,827; and Traunecker et al., 1988). Fusion proteins that have a disulfide-linked dimeric structure due to the IgG portion can also be more efficient in binding and neutralizing other molecules than monomeric polypeptides or fragments thereof alone (See, e.g., Fountoulakis et al., 1995). Nucleic acids encoding the above epitopes can also be recombined with a gene of interest as an epitope tag to aid in detection and purification of the expressed polypeptide.

Additonal fusion proteins of the invention may be generated through the techniques of gene-shuffling, motif-shuffling, exon-shuffling, or codon-shuffling (collectively referred to as "DNA shuffling"). DNA shuffling may be employed to modulate the activities of polypeptides of the present invention thereby effectively generating agonists and antagonists of the polypeptides. See, for example, U.S. Pat. Nos.: 5,605,793; 5,811,238; 5,834,252; 5,837,458; and Patten, P. A., et al., (1997); Harayama, S., (1998); Hansson, L. O., et al (1999); and Lorenzo, M. M. and Blasco, R., (1998). (Each of these documents are hereby incorporated by reference). In one embodiment, one or more components, motifs, sections, parts, domains, fragments, etc., of coding polynucleotides of the invention, or the polypeptides encoded thereby may be recombined with one or more components, motifs, sections, parts, domains, fragments, etc. of one or more heterologous molecules.

Antibodies

The present invention further relates to antibodies and T-cell antigen receptors (TCR) which specifically bind the polypeptides of the present invention. The antibodies of the present invention include IgG (including IgG1, IgG2, IgG3, and IgG4), IgA (including IgA1 and IgA2), IgD, IgE, or IgM, and IgY. As used herein, the term "antibody" (Ab) is meant to include whole antibodies, including single-chain whole antibodies, and antigen-binding fragments thereof. In a preferred embodiment the antibodies are human antigen binding antibody fragments of the present invention include, but are not limited to, Fab, Fab' F(ab)2 and F(ab')2, Fd, single-chain Fvs (scFv), single-chain antibodies, disulfide-linked Fvs (sdFv) and fragments comprising either a $V_L$ or $V_H$ domain. The antibodies may be from any animal origin including birds and mammals. Preferably, the antibodies are human, murine, rabbit, goat, guinea pig, camel, horse, or chicken.

Antigen-binding antibody fragments, including single-chain antibodies, may comprise the variable region(s) alone or in combination with the entire or partial regions of the following: hinge region, CH1, CH2, and CH3 domains. Also included in the invention are any combinations of variable region(s) and hinge region, CH1, CH2, and CH3 domains. The present invention further includes chimeric, humanized, and human monoclonal and polyclonal antibodies which specifically bind the polypeptides of the present invention. The present invention further includes antibodies which are anti-idiotypic to the antibodies of the present invention.

The antibodies of the present invention may be monospecific, bispecific, trispecific or of greater multispecificity. Multispecific antibodies may be specific for different epitopes of a polypeptide of the present invention or may be specific for both a polypeptide of the present invention as well as for heterologous compositions, such as a heterologous polypeptide or solid support material. See, e.g., WO 93/17715; WO 92/08802; WO 91/00360; WO 92/05793; Tutt, A. et al. (1991) J. Immunol. 147:60–69; U.S. Pat. Nos. 5,573,920, 4,474,893, 5,601,819, 4,714,681, 4,925,648; Kostelny, S. A. et al. (1992) J. Immunol. 148:1547–1553, the disclosures of which are incorporated herein by reference in their entireties.

In some embodiments, the antibodies may be capable of specifically binding to a protein or polypeptide encoded by EST-related nucleic acids, fragments of EST-related nucleic acids, positional segments of EST-related nucleic acids or fragments of positional segments of EST-related nucleic acids. In some embodiments, the antibody may be capable of binding an antigenic determinant or an epitope in a protein or polypeptide encoded by EST-related nucleic acids, fragments of EST-related nucleic acids, positional segments of EST-related nucleic acids or fragments of positional segments of EST-related nucleic acids.

In other embodiments, the antibodies may be capable of specifically binding to an EST-related polypeptide, fragment of an EST-related polypeptide, positional segment of an EST-related polypeptide or fragment of a positional segment of an EST-related polypeptide. In some embodiments, the antibody may be capable of binding an antigenic determinant or an epitope in an EST-related polypeptide, fragment of an EST-related polypeptide, positional segment of an EST-related polypeptide or fragment of a positional segment of an EST-related polypeptide.

Antibodies of the present invention may be described or specified in terms of the epitope(s) or portion(s) of a polypeptide of the present invention which are recognized or specifically bound by the antibody.

In the case of secreted proteins, the antibodies may specifically bind a full-length protein encoded by a nucleic acid of the present invention, a mature protein (i.e. the protein generated by cleavage of the signal peptide) encoded by a nucleic acid of the present invention, or a signal peptide encoded by a nucleic acid of the present invention. Moreover, the epitope(s) or polypeptide portion(s) may be specified as described herein, e.g., by N-terminal and C-terminal positions, by size in contiguous amino acid residues, or listed in the Tables and sequence listing. Antibodies which specifically bind any epitope or polypeptide of the present invention may also be excluded. Therefore, the present invention includes antibodies that specifically bind polypeptides of the present invention, and allows for the exclusion of the same.

Antibodies of the present invention may also be described or specified in terms of their cross-reactivity. Antibodies that do not bind any other analog, ortholog, or homolog of the polypeptides of the present invention are included. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. Further included in the present invention are antibodies which only bind polypeptides encoded by polynucleotides which hybridize to a polynucleotide of the present invention under stringent hybridization conditions (as described herein). Antibodies of the present invention may also be described or specified in terms of their binding affinity. Preferred binding affinities include those with a dissociation constant or Kd less than $5\times10^{-6}$M, $10^{-6}$M, $5\times10^{-7}$M, $10^{-7}$M, $5\times10^{-8}$M, $10^{-8}$M, $5\times10^{-9}$M, $10^{-9}$M, $5\times10^{-10}$M, $10^{-10}$M, $5\times10^{-11}$M, $10^{-11}$M, $5\times10^{-12}$M, $10^{-12}$M, $5\times10^{-13}$M, $10^{-13}$M, $5\times10^{-14}$M, $10^{-14}$M, $5\times10^{-15}$M, and $10^{-15}$M.

Antibodies of the present invention have uses that include, but are not limited to, methods known in the art to purify, detect, and target the polypeptides of the present invention including both in vitro and in vivo diagnostic and therapeutic methods. For example, the antibodies have use in immunoassays for qualitatively and quantitatively measuring levels of the polypeptides of the present invention in biological samples. See, e.g., Harlow et al., *ANTIBODIES: A LABORATORY MANUAL*, (Cold Spring Harbor Laboratory Press, 2nd ed. 1988) (incorporated by reference in the entirety).

The antibodies of the present invention may be used either alone or in combination with other compositions. The antibodies may further be recombinantly fused to a heterologous polypeptide at the N- or C-terminus or chemically conjugated (including covalent and non-covalent conjugations) to polypeptides or other compositions. For example, antibodies of the present invention may be recombinantly fused or conjugated to molecules useful as labels in detection assays and effector molecules such as heterologous polypeptides, drugs, or toxins. See, e.g., WO 92/08495; WO 91/14438; WO 89/12624; U.S. Pat. No. 5,314,995; and EP 0 396 387, the disclosures of which are incorporated herein by reference in their entireties.

The antibodies of the present invention may be prepared by any suitable method known in the art. For example, a polypeptide of the present invention or an antigenic fragment thereof can be administered to an animal in order to induce the production of sera containing polyclonal antibodies. The term "monoclonal antibody" is not limited to antibodies produced through hybridoma technology. The term "antibody" refers to a polypeptide or group of polypeptides which are comprised of at least one binding domain, where a binding domain is formed from the folding of variable domains of an antibody molecule to form three-dimensional binding spaces with an internal surface shape and charge distribution complementary to the features of an antigenic determinant of an antigen., which allows an immunological reaction with the antigen. The term "monoclonal antibody" refers to an antibody that is derived from a single clone, including eukaryotic, prokaryotic, or phage clone, and not the method by which it is produced. Monoclonal antibodies can be prepared using a wide variety of techniques known in the art including the use of hybridoma, recombinant, and phage display technology.

Hybridoma techniques include those known in the art (See, e.g., Harlow et al., ANTIBODIES: A LABORATORY MANUAL, (Cold Spring Harbor Laboratory Press, 2nd ed. 1988); Hammerling, et al., in: MONOCLONAL ANTIBODIES AND T-CELL HYBRIDOMAS 563–681 (Elsevier, N.Y., 1981) (said references incorporated by reference in their entireties). Fab and F(ab')2 fragments may be produced, for example, from hybridoma-produced antibodies by proteolytic cleavage, using enzymes such as papain (to produce Fab fragments) or pepsin (to produce F(ab')2 fragments).

Alternatively, antibodies of the present invention can be produced through the application of recombinant DNA technology or through synthetic chemistry using methods known in the art. For example, the antibodies of the present invention can be prepared using various phage display methods known in the art. In phage display methods, functional antibody domains are displayed on the surface of a phage particle which carries polynucleotide sequences encoding them. Phage with a desired binding property are selected from a repertoire or combinatorial antibody library (e.g. human or murine) by selecting directly with antigen, typically antigen bound or captured to a solid surface or bead. Phage used in these methods are typically filamentous phage including fd and M13 with Fab, Fv or disulfide stabilized Fv antibody domains recombinantly fused to either the phage gene III or gene VIII protein. Examples of phage display methods that can be used to make the antibodies of the present invention include those disclosed in Brinkman U. et al. (1995) J. Immunol. Methods 182:41–50; Ames, R. S. et al. (1995) J. Immunol. Methods 184:177–186; Kettleborough, C. A. et al. (1994) Eur. J. Immunol. 24:952–958; Persic, L. et al. (1997) Gene 187 9–18; Burton, D. R. et al. (1994) Advances in Immunology 57:191–280; PCT/GB91/01134; WO 90/02809; WO91/10737; WO 92/01047; WO 92/18619; WO 93/11236; WO 95/15982; WO 95/20401; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727 and 5,733,743 (said references incorporated by reference in their entireties).

As described in the above references, after phage selection, the antibody coding regions from the phage can be isolated and used to generate whole antibodies, including human antibodies, or any other desired antigen binding fragment, and expressed in any desired host including mammalian cells, insect cells, plant cells, yeast, and bacteria. For example, techniques to recombinantly produce Fab, Fab' F(ab)2 and F(ab')2 fragments can also be employed using methods known in the art such as those disclosed in WO 92/22324; Mullinax, R. L. et al. (1992) BioTechniques 12(6):864–869; and Sawai, H. et al. (1995) AJRI 34:26–34; and Better, M. et al. (1988) Science 240:1041–1043 (said references incorporated by reference in their entireties).

Examples of techniques which can be used to produce single-chain Fvs and antibodies include those described in U.S. Pat. Nos. 4,946,778 and 5,258,498; Huston et al. (1991) Methods in Enzymology 203:46–88; Shu, L. et al. (1993) PNAS 90:7995–7999; and Skerra, A. et al. (1988) Science 240:1038–1040, the disclosures of which are incorporated herein by reference in their entireties. For some uses, including in vivo use of antibodies in humans and in vitro detection assays, it may be preferable to use chimeric, humanized, or human antibodies. Methods for producing chimeric antibodies are known in the art. See e.g., Morrison, Science 229:1202 (1985); Oi et al., BioTechniques 4:214 (1986); Gillies, S. D. et al. (1989) J. Immunol. Methods 125:191–202; and U.S. Pat. No. 5,807,715. Antibodies can be humanized using a variety of techniques including CDR-grafting (EP 0 239 400; WO 91/09967; U.S. Pat. No. 5,530,101; and 5,585,089), veneering or resurfacing (EP 0 592 106; EP 0 519 596; Padlan E. A., (1991) Molecular Immunology 28(4/5):489–498; Studnicka G. M. et al. (1994) Protein Engineering 7(6):805–814; Roguska M. A. et al. (1994) PNAS 91:969–973), and chain shuffling (U.S. Pat. No. 5,565,332). Human antibodies can be made by a variety of methods known in the art including phage display methods described above. See also, U.S. Pat. Nos. 4,444,887, 4,716,111, 5,545,806, and 5,814,318; WO 98/46645; WO 98/50433; WO 98/24893; WO 96/34096; WO 96/33735; and WO 91/10741 (said references incorporated by reference in their entireties).

Further included in the present invention are antibodies recombinantly fused or chemically conjugated (including both covalently and non-covalently conjugations) to a polypeptide of the present invention. The antibodies may be specific for antigens other than polypeptides of the present invention. For example, antibodies may be used to target the polypeptides of the present invention to particular cell types, either in vitro or in vivo, by fusing or conjugating the polypeptides of the present invention to antibodies specific for particular cell surface receptors. Antibodies fused or conjugated to the polypeptides of the present invention may also be used in in vitro immunoassays and purification methods using methods known in the art. See e.g., Harbor et al. supra and WO 93/21232; EP 0 439 095; Naramura, M. et al. (1994) Immunol. Lett. 39:91–99; U.S. Pat. No. 5,474,981; Gillies, S. O. et al. (1992) PNAS 89:1428–1432; Fell, H. P. et al. (1991) J. Immunol. 146:2446–2452 (said references incorporated by reference in their entireties).

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the hinge region, CH1 domain, CH2 domain, and CH3 domain or any combination of whole domains or portions thereof. The polypeptides of the present invention may be fused or conjugated to the above antibody portions to increase the in vivo half life of the polypeptides or for use in immunoassays using methods known in the art. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See e.g., U.S. Pat. Nos. 5,336,603, 5,622,929, 5,359,046, 5,349,053, 5,447,851, 5,112,946; EP 0 307 434, EP 0 367 166; WO 96/04388, WO 91/06570; Ashkenazi, A. et al. (1991) PNAS 88:10535–10539; Zheng, X. X. et al. (1995) J. Immunol. 154:5590–5600; and Vil, H. et al. (1992) PNAS 89:11337–11341 (said references incorporated by reference in their entireties).

The invention further relates to antibodies which act as agonists or antagonists of the polypeptides of the present invention. For example, the present invention includes antibodies which disrupt the receptor/ligand interactions with the polypeptides of the invention either partially or fully.

Included are both receptor-specific antibodies and ligand-specific antibodies. Included are receptor-specific antibodies which do not prevent ligand binding but prevent receptor activation. Receptor activation (i.e., signaling) may be determined by techniques described herein or otherwise known in the art. Also include are receptor-specific antibodies which both prevent ligand binding and receptor activation. Likewise, included are neutralizing antibodies which bind the ligand and prevent binding of the ligand to the receptor, as well as antibodies which bind the ligand, thereby preventing receptor activation, but do not prevent the ligand from binding the receptor. Further included are antibodies which activate the receptor. These antibodies may act as agonists for either all or less than all of the biological activities affected by ligand-mediated receptor activation. The antibodies may be specified as agonists or antagonists for biological activities comprising specific activities disclosed herein. The above antibody agonists can be made using methods known in the art. See e.g., WO 96/40281; U.S. Pat. No. 5,811,097; Deng, B. et al. (1998) Blood 92(6):1981–1988; Chen, Z. et al. (1998) Cancer Res. 58(16):3668–3678; Harrop, J. A. et al. (1998) J. Immunol. 161(4):1786–1794; Zhu, Z. et al. (1998) Cancer Res. 58(15):3209–3214; Yoon, D. Y. et al. (1998) J. Immunol. 60(7):3170–3179; Prat, M. et al. (1998) J. Cell. Sci. 111 (Pt2):237–247; Pitard, V. et al. (1997) J. Immunol. Methods 205(2):177–190; Liautard, J. et al. (1997) Cytokinde 9(4):233–241; Carlson, N. G. et al. (1997) J. Biol. Chem. 272(17):11295–11301; Taryman, R. E. et al. (1995) Neuron 14(4):755–762; Muller, Y. A. et al. (1998) Structure 6(9):1153–1167; Bartunek, P. et al. (1996) Cytokine 8(1):14–20 (said references incorporated by reference in their entireties).

As discussed above, antibodies of the polypeptides of the invention can, in turn, be utilized to generate anti-idiotypic antibodies that "mimic" polypeptides of the invention using techniques well known to those skilled in the art. See, e.g. Greenspan and Bona, FASEB J. 7(5):437–444 (1989); Nissinoff, J. Immunol. 147(8):2429–2438 (1991), the disclosures of which are incorporated herein by reference in their entireties. For example, antibodies which bind to and competitively inhibit polypeptide multimerization or binding of a polypeptide of the invention to ligand can be used to generate anti-idiotypes that "mimic" the polypeptide multimerization or binding domain and, as a consequence, bind to and neutralize polypeptide or its ligand. Such neutralization anti-idiotypic antibodies can be used to bind a polypeptide of the invention or to bind its ligands/receptors, and therby block its biological activity.

EXAMPLE 33

Production of an Antibody to a Human Polyleptide or Protein

The above described EST-related nucleic acids, fragments of EST-related nucleic acids, positional segments of EST-related nucleic acids or fragments of positional segments of EST-related nucleic acids or nucleic acids encoding EST-related polypeptides, fragments of EST-related polypeptides, positional segments of EST-related polypeptides or fragments of positional segments of EST-related polypeptides are operably linked to promoters and introduced into cells as described above.

In the case of secreted proteins, nucleic acids encoding the full protein (i.e. the mature protein and the signal peptide), nucleic acids encoding the mature protein (i.e. the protein generated by cleavage of the signal peptide), or nucleic acids encoding the signal peptide are operably linked to promoters and introduced into cells as described above.

The encoded proteins or polypeptides are then substantially purified or isolated as described above. The concentration of protein in the final preparation is adjusted, for example, by concentration on an Amicon filter device, to the level of a few g/ml. Monoclonal or polyclonal antibody to the protein or polypeptide can then be prepared as follows:

1. Monoclonal Antibody Production by Hybridoma Fusion

Monoclonal antibody to epitopes of any of the proteins or polypeptides identified and isolated as described can be prepared from murine hybridomas according to the classical method of Kohler, and Milstein, Nature 256:495 (1975) or derivative methods thereof. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as Elisa, as originally described by Engvall, Meth. Enzymol 70:419 (1980), the disclosure of which is incorporated herein by reference and derivative methods thereof. Selected positive clones can be expanded and their monoclonal antibody product harvested for use. Detailed procedures for monoclonal antibody production are described in Davis, L. et al. in Basic Methods in Molecular Biology Elsevier, New York. Section 21-2, the disclosure of which is incorporated herein by reference.

2. Polyclonal Antibody Production by Immunization

Polyclonal antiserum containing antibodies to heterogenous epitopes of a single protein or polypeptide can be prepared by immunizing suitable animals with the expressed protein or peptides derived therefrom, which can be unmodified or modified to enhance immunogenicity. Effective polyclonal antibody production is affected by many factors related both to the antigen and the host species. For example, small molecules tend to be less immunogenic than others and may require the use of carriers and adjuvant. Also, host animals response vary depending on site of inoculations and doses, with both inadequate or excessive doses of antigen resulting in low titer antisera. Small doses (ng level) of antigen administered at multiple intradermal sites appears to be most reliable. An effective immunization protocol for rabbits can be found in Vaitukaitis. et al. J. Clin. Endocrinol. Metab. 33:988–991 (1971), the disclosure of which is incorporated herein by reference.

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, et al., Chap. 19 in: Handbook of Experimental Immunology D. Wier (ed) Blackwell (1973), the disclosure of which is incorporated herein by reference. Plateau concentration of antibody is usually in the range of 0.1 to 0.2 mg/ml of serum (about 12 M). Affinity of the antisera for the antigen is determined by preparing competitive binding curves, as described, for example, by Fisher, D., Chap. 42 in: Manual of Clinical Immunology, 2d Ed. (Rose and Friedman, Eds. ) Amer. Soc. For Microbiol., Washington, D.C. (1980), the disclosure of which is incorporated herein by reference.

Antibody preparations prepared according to either of the above protocols are useful in a variety of contexts. In particular, the antibodies may be used in immunoaffinity chromatography techniques such as those described below to facilitate large scale isolation, purification, or enrichment of the proteins or polypeptides encoded by EST-related nucleic acids, positional segments of EST-related nucleic acids or fragments of positional segments of EST-related nucleic acids or for the isolation, purification or enrichment of EST-related polypeptides, fragments of EST-related polypeptides, positional segments of EST-related polypeptides or fragments of positional segments of EST-related polypeptides.

In the case of secreted proteins, the antibodies may be used for the isolation, purification, or enrichment of the full protein (i.e. the mature protein and the signal peptide), the mature protein (i.e. the protein generated by cleavage of the signal peptide), or the signal peptide are operably linked to promoters and introduced into cells as described above.

Additionally, the antibodies may be used in immunoaffinity chromatography techniques such as those described below to isolate, purify, or enrich polypeptides which have been linked to the proteins or polypeptides encoded by EST-related nucleic acids, positional segments of EST-related nucleic acids or fragments of positional segments of EST-related nucleic acids or to isolate, purify, or enrich EST-related polypeptides, fragments of EST-related polypeptides, positional segments of EST-related polypeptides or fragments of positional segments of EST-related polypeptides.

The antibodies may also be used to determine the cellular localization of polypeptides encoded by the proteins or polypeptides encoded by EST-related nucleic acids, positional segments of EST-related nucleic acids or fragments of positional segments of EST-related nucleic acids or the cellular localization of EST-related polypeptides, fragments of EST-related polypeptides, position EST-related polypeptides or fragments of positional segments of EST-related polypeptides.

In addition, the antibodies may also be used to determine the cellular localization of polypeptides which have been linked to the proteins or polypeptides encoded by EST-related nucleic acids, positional segments of EST-related nucleic acids or fragments of positional segments of EST-related nucleic acids or polypeptides which have been linked EST-related polypeptides, fragments of EST-related polypeptides, positional segments of EST-related polypeptides or fragments of positional segments of EST-related polypeptides.

The antibodies may also be used in quantitative immunoassays which determine concentrations of antigen-bearing substances in biological samples; they may also used semi-quantitatively or qualitatively to identify the presence of antigen in a biological sample or to identify the type of tissue present in a biological sample. The antibodies may also be used in therapeutic compositions for killing cells expressing the protein or reducing the levels of the protein in the body.

VI. Use of 5' ESTs and Consensus Contigated 5' ESTs or Sequences Obtainable Therefrom or Portions Thereof as Reagents The EST-related nucleic acids, positional segments of EST-related nucleic acids or fragments of positional segments of EST-related nucleic acids may be used as reagents in isolation procedures, diagnostic assays, and forensic procedures. For example, sequences from the EST-related nucleic acids, positional segments of EST-related nucleic acids or fragments of positional segments of EST-related nucleic acids, may be detectably labeled and used as probes to isolate other sequences capable of hybridizing to them. In addition, the he EST-related nucleic acids, positional segments of EST-related nucleic acids or fragments of positional segments of EST-related nucleic acids may be used to design PCR primers to be used in isolation, diagnostic, or forensic procedures.

1. Use of EST-related Nucleic Acids Positional Segments of EST-related Nucleic Acids or Fragments of Positional Segments of EST-related Nucleic Acids in Isolation, Diagnostic and Forensic Procedures

EXAMPLE 34

Preparation of PCR Primers and Amplification of DNA

The EST-related nucleic acids, positional segments of EST-related nucleic acids or fragments of positional segments of EST-related nucleic acids may be used to prepare PCR primers for a variety of applications, including isolation procedures for cloning nucleic acids capable of hybridizing to such sequences, diagnostic techniques and forensic techniques. In some embodiments, the PCR primers at least 10, 15, 18, 20, 23, 25, 28, 30, 40, or 50 nucleotides in length. In some embodiments, the PCR primers may be more than 30 bases in length. It is preferred that the primer pairs have approximately the same G/C ratio, so that melting temperatures are approximately the same. A variety of PCR techniques are familiar to those skilled in the art. For a review of PCR technology, see Molecular Cloning to Genetic Engineering White, B. A. Ed. in *Methods in Molecular Biology* 67: Humana Press, Totowa 1997, the disclosure of which is incorporated herein by reference. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites.

EXAMPLE 35

Use of the EST-related Nucleic Acids Positional Segments of EST-related Nucleic Acids or Fragments of Positional Segments of EST-related Nucleic Acids as Probes Probes derived from EST-related nucleic acids, positional segments of EST-related nucleic acids or fragments of positional segments of EST-related nucleic acids may be labeled with detectable labels familiar to those skilled in the art, including radioisotopes and non-radioactive labels, to provide a detectable probe. The detectable probe may be single stranded or double stranded and may be made using techniques known in the art, including in vitro transcription, nick translation, or kinase reactions. A nucleic acid sample containing a sequence capable of hybridizing to the labeled probe is contacted with the labeled probe. If the nucleic acid in the sample is double stranded, it may be denatured prior to contacting the probe. In some applications, the nucleic acid sample may be immobilized on a surface such as a nitrocellulose or nylon membrane. The nucleic acid sample may comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting, Northern blotting, dot blotting, colony hybridization, and plaque hybridization. In some applications, the nucleic acid capable of hybridizing to the labeled probe may be cloned into vectors such as expression vectors, sequencing vectors, or in vitro transcription vectors to facilitate the characterization and expression of the hybridizing nucleic acids in the sample. For example, such techniques may be used to isolate and clone sequences in a genomic library or cDNA library which are capable of hybridizing to the detectable probe as described in Example 18 above.

PCR primers made as described in Example 34 above may be used in forensic analyses, such as the DNA fingerprinting techniques described in Examples 36–40 below. Such analyses may utilize detectable probes or primers based on the sequences of the EST-related nucleic acids, positional segments of EST-related nucleic acids or fragments of positional segments of EST-related nucleic acids.

EXAMPLE 36

Forensic Matching by DNA Sequencing

In one exemplary method, DNA samples are isolated from forensic specimens of, for example, hair, semen, blood or skin cells by conventional methods. A panel of PCR primers based on a number of the EST-related nucleic acids, positional segments of EST-related nucleic acids or fragments of positional segments of EST-related nucleic acids is then utilized in accordance with Example 34 to amplify DNA of approximately 100–200 bases in length from the forensic specimen. Corresponding sequences are obtained from a test subject. Each of these identification DNAs is then sequenced using standard techniques, and a simple database comparison determines the differences, if any, between the sequences from the subject and those from the sample. Statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 50 statistically identical sequences of 100 bases in length are used to prove identity between the suspect and the sample.

EXAMPLE 37

Positive Identification by DNA Sequencing

The technique outlined in the previous example may also be used on a larger scale to provide a unique fingerprint-type identification of any individual. In this technique, primers are prepared from a large number of EST-related nucleic acids, positional segments of EST-related nucleic acids or fragments of positional segments of EST-related nucleic acids. Preferably, 20 to 50 different primers are used. These primers are used to obtain a corresponding number of PCR-generated DNA segments from the individual in question in accordance with Example 34. Each of these DNA segments is sequenced, using the methods set forth in Example 36. The database of sequences generated through this procedure uniquely identifies the individual from whom the sequences were obtained. The same panel of primers may then be used at any later time to absolutely correlate tissue or other biological specimen with that individual.

EXAMPLE 38

Southern Blot Forensic Identification

The procedure of Example 37 is repeated to obtain a panel of at least 10 amplified sequences from an individual and a specimen. Preferably, the panel contains at least 50 amplified sequences. More preferably, the panel contains 100 amplified sequences. In some embodiments, the panel contains 200 amplified sequences. This PCR-generated DNA is then digested with one or a combination of, preferably, four base specific restriction enzymes. Such enzymes are commercially available and known to those of skill in the art. After digestion, the resultant gene fragments are size separated in multiple duplicate wells on an agarose gel and transferred to nitrocellulose using Southern blotting techniques well known to those with skill in the art. For a review of Southern blotting see Davis et al. (Basic Methods in Molecular Biology, 1986, Elsevier Press. pp 62–65), the disclosure of which is incorporated herein by reference.

A panel of probes based on the sequences of the EST-related nucleic acids, positional segments of EST-related nucleic acids or fragments of positional segments of EST-related nucleic acids are radioactively or calorimetrically labeled using methods known in the art, such as nick translation or end labeling, and hybridized to the Southern blot using techniques known in the art (Davis et al., supra). Preferably, the probe is at least 10, 12, 15, 18, 20, 25, 28, 30, 35, 40, 50, 75, 100, 150, 200, 300, 400 or 500 nucleotides in length. Preferably, the probes are at least 10, 12, 15, 18, 20, 25, 28, 30, 35, 40, 50, 75, 100, 150, 200, 300, 400 or 500 nucleotides in length. In some embodiments, the probes are oligonucleotides which are 40 nucleotides in length or less.

Preferably, at least 5 to 10 of these labeled probes are used, and more preferably at least about 20 or 30 are used to provide a unique pattern. The resultant bands appearing from the hybridization of a large sample of EST-related nucleic acids, positional segments of EST-related nucleic acids or fragments of positional segments of EST-related nucleic acids will be a unique identifier. Since the restriction enzyme cleavage will be different for every individual, the band pattern on the Southern blot will also be unique. Increasing the number of probes will provide a statistically higher level of confidence in the identification since there will be an increased number of sets of bands used for identification.

EXAMPLE 39

Dot Blot Identification Procedure

Another technique for identifying individuals using the EST-related nucleic acids, positional segments of EST-related nucleic acids or fragments of positional segments of EST-related nucleic acids disclosed herein utilizes a dot blot hybridization technique.

Genomic DNA is isolated from nuclei of subject to be identified. Probes are prepared that correspond to at least 10, preferably 50 sequences from the EST-related nucleic acids, positional segments of EST-related nucleic acids or fragments of positional segments of EST-related nucleic acids. The probes are used to hybridize to the genomic DNA through conditions known to those in the art. The oligonucleotides are end labeled with $P^{32}$ using polynucleotide kinase (Pharmacia). Dot Blots are created by spotting the genomic DNA onto nitrocellulose or the like using a vacuum dot blot manifold (BioRad, Richmond Calif.). The nitrocellulose filter containing the genomic sequences is baked or UV linked to the filter, prehybridized and hybridized with labeled probe using techniques known in the art (Davis et al., supra). The $^{32}$P labeled DNA fragments are sequentially hybridized with successively stringent conditions to detect minimal differences between the 30 bp sequence and the DNA. Tetramethylammoniumchloride is useful for identifying clones containing small numbers of nucleotide mismatches (Wood et al., Proc. Natl. Acad. Sci. USA 82(6):1585–1588 (1985)) which is hereby incorporated by reference. A unique pattern of dots distinguishes one individual from another individual.

EST-related nucleic acids, positional segments of EST-related nucleic acids or fragments of positional segments of EST-related nucleic acids can be used as probes in the following alternative fingerprinting technique. In some embodiments, the probes are oligonucleotides which are 40 nucleotides in length or less.

Preferably, a plurality of probes having sequences from different EST-related nucleic acids, positional segments of EST-related nucleic acids or fragments of positional segments of EST-related nucleic acids are used in the alternative fingerprinting technique. Example 40 below provides a representative alternative fingerprinting procedure in which the probes are derived from EST-related nucleic acids, positional segments of EST-related nucleic acids or fragments of positional segments of EST-related nucleic acids.

EXAMPLE 40

Alternative "Fingerprint" Identification Technique

Oligonucleotides are prepared from a large number, e.g. 50, 100, or 200, EST-related nucleic acids, positional segments of EST-related nucleic acids or fragments of positional segments of EST-related nucleic acids using commercially available oligonucleotide services such as Genset, Paris, France. Preferably, the oligonucleotides are at least 10, 15, 18, 20, 23, 25 28, or 30 nucleotides in length. However, in some embodiments, the oligonucleotides may be more than 30 nucleotides in length.

Cell samples from the test subject are processed for DNA using techniques well known to those with skill in the art. The nucleic acid is digested with restriction enzymes such as EcoRI and XbaI. Following digestion, samples are applied to wells for electrophoresis. The procedure, as known in the art, may be modified to accommodate polyacrylamide electrophoresis, however in this example, samples containing 5 ug of DNA are loaded into wells and separated on 0.8% agarose gels. The gels are transferred onto nitrocellulose using standard Southern blotting techniques.

10 ng of each of the oligonucleotides are pooled and end-labeled with $P^{32}$. The nitrocellulose is prehybridized with blocking solution and hybridized with the labeled probes. Following hybridization and washing, the nitrocellulose filter is exposed to X-Omat AR X-ray film. The resulting hybridization pattern will be unique for each individual.

It is additionally contemplated within this example that the number of probe sequences used can be varied for additional accuracy or clarity.

In addition to their applications in forensics and identification, EST-related nucleic acids, positional segments of EST-related nucleic acids or fragments of positional segments of EST-related nucleic acids may be mapped to their chromosomal locations. Example 41 below describes radiation hybrid (RH) mapping of human chromosomal regions using EST-related nucleic acids, positional segments of EST-related nucleic acids or fragments of positional segments of EST-related nucleic acids. Example 42 below describes a representative procedure for mapping EST-related nucleic acids, positional segments of EST-related nucleic acids or fragments of positional segments of EST-related nucleic acids to their locations on human chromosomes. Example 43 below describes mapping of EST-related nucleic acids, positional segments of EST-related nucleic acids or fragments of positional segments of EST-related nucleic acids on metaphase chromosomes by Fluorescence In Situ Hybridization (FISH).

2. Use of EST-related Nucleic Acids Positional Segments of EST-related Nucleic Acids or Fragments of Positional Segments of EST-related Nucleic Acids in Chromosome Mapping

EXAMPLE 41

Radiation Hybrid Mapping of EST-related Nucleic Acids, Positional Segments of EST-related Nucleic Acids or Fragments of Positional Segments of EST-related Nucleic Acids to the Human Genome Radiation hybrid (RH) mapping is a somatic cell genetic approach that can be used for high resolution mapping of the human genome. In this approach, cell lines containing one or more human chromosomes are lethally irradiated, breaking each chromosome into fragments whose size depends on the radiation dose. These fragments are rescued by fusion with cultured rodent cells, yielding subclones containing different portions of the human genome. This technique is described by Benham et al. (Genomics 4:509–517, 1989) and Cox et al, (Science 250:245–250, 1990), the entire contents of which are hereby incorporated by reference. The random and independent nature of the subclones permits efficient mapping of any human genome marker. Human DNA isolated from a panel of 80–100 cell lines provides a mapping reagent for ordering EST-related nucleic acids, positional segments of EST-related nucleic acids or fragments of positional segments of EST-related nucleic acids. In this approach, the frequency of breakage between markers is used to measure distance, allowing construction of fine resolution maps as has been done using conventional ESTs (Schuler et al, Science 274:540–546, 1996, hereby incorporated by reference).

RH mapping has been used to generate a high-resolution whole genome radiation hybrid map of human chromosome 17q22-q25.3 across the genes for growth hormone (GH) and thymidine kinase (TK) (Foster et al, Genomics 33:185–192, 1996), the region surrounding the Gorlin syndrome gene (Obermayr et al, Eur. J. Hum. Genet. 4:242–245, 1996), 60 loci covering the entire short arm of chromosome 12 (Raeymaekers et al, Genomics 29:170–178, 1995), the region of human chromosome 22 containing the neurofibromatosis type 2 locus (Frazer et al, Genomics 14:574–584, 1992) and 13 loci on the long arm of chromosome 5 (Warrington et al., Genomics 11:701–708, 1991).

EXAMPLE 42

Mapping of EST-related Nucleic Acids, Positional Segments of EST-related Nucleic Acids or Fragments of Positional Segments of EST-related Nucleic Acids to Human Chromosomes Using PCR Techniques EST-related nucleic acids, positional segments of EST-related nucleic acids or fragments of positional segments of EST-related nucleic acids may be assigned to human chromosomes using PCR based methodologies. In such approaches, oligonucleotide primer pairs are designed from EST-related nucleic acids, positional segments of EST-related nucleic acids or fragments of positional segments of EST-related nucleic acids to minimize the chance of amplifying through an intron. Preferably, the oligonucleotide primers are 18–23 bp in length and are designed for PCR amplification. The creation of PCR primers from known sequences is well known to those with skill in the art. For a review of PCR technology see Erlich. in PCR Technology; Principles and Applications for DNA Amplification. 1992. W.H. Freeman and Co., New York, the disclosure of which is incorporated herein by reference.

The primers are used in polymerase chain reactions (PCR) to amplify templates from total human genomic DNA. PCR conditions are as follows: 60 ng of genomic DNA is used as a template for PCR with 80 ng of each oligonucleotide primer, 0.6 unit of Taq polymerase, and 1 Cu of a $^{33}$P-labeled deoxycytidine triphosphate. The PCR is performed in a microplate thermocycler (Techne) under the following conditions: 30 cycles of 94° C., 1.4 min; 55° C., 2 min; and 72° C., 2 min; with a final extension at 72° C. for 10 min. The amplified products are analyzed on a 6% polyacrylamide sequencing gel and visualized by autoradiography. If the length of the resulting PCR product is identical to the distance between the ends of the primer sequences in the 5' EST from which the primers are derived, then the PCR reaction is repeated with DNA templates from two panels of human-rodent somatic cell hybrids, BIOS PCRable DNA (BIOS Corporation) and NIGMS Human-Rodent Somatic Cell Hybrid Mapping Panel Number 1 (NIGMS, Camden, N.J.).

PCR is used to screen a series of somatic cell hybrid cell lines containing defined sets of human chromosomes for the presence of a given 5' EST. DNA is isolated from the somatic hybrids and used as starting templates for PCR-reactions using the primer pairs from the EST-related nucleic acids, positional segments of EST-related nucleic acids or fragments of positional segments of EST-related nucleic acids. Only those somatic cell hybrids with chromosomes containing the human gene corresponding to the EST-related nucleic acids, positional segments of EST-related nucleic acids or fragments of positional segments of EST-related nucleic acids will yield an amplified fragment. The 5' ESTs are assigned to a chromosome by analysis of the segregation pattern of PCR products from the somatic hybrid DNA templates. The single human chromosome present in all cell hybrids that give rise to an amplified fragment is the chromosome containing that EST-related nucleic acids, positional segments of EST-related nucleic acids or fragments of positional segments of EST-related nucleic acids. For a review of techniques and analysis of results from somatic cell gene mapping experiments. (See Ledbetter et al., Genomics 6:475–481 (1990)., the disclosure of which is incorporated herein by reference.)

Alternatively, the EST-related nucleic acids, positional segments of EST-related nucleic acids or fragments of positional segments of EST-related nucleic acids may be mapped to individual chromosomes using FISH as described in Example 43 below.

EXAMPLE 43

Mapping of EST-related Nucleic Acids, Positional Segments of EST-related Nucleic Acids or Fragments of Positional Segments of EST-related Nucleic Acids to Chromosomes Using Fluorescence In Situ Hybridization Fluorescence in situ hybridization allows the EST-related nucleic acids, positional segments of EST-related nucleic acids or fragments of positional segments of EST-related nucleic acids to be mapped to a particular location on a given chromosome. The chromosomes to be used for fluorescence in situ hybridization techniques may be obtained from a variety of sources including cell cultures, tissues, or whole blood.

In a preferred embodiment, chromosomal localization of EST-related nucleic acids, positional segments of EST-related nucleic acids or fragments of positional segments of EST-related nucleic acids are obtained by FISH as described by Cherif et al. (*Proc. Natl. Acad. Sci. U.S.A.*, 87:6639–6643, 1990), the disclosure of which is incorporated herein by reference. Metaphase chromosomes are prepared from phytohemagglutinin (PHA)-stimulated blood cell donors. PHA-stimulated lymphocytes from healthy males are cultured for 72 h in RPMI-1640 medium. For synchronization, methotrexate (10 M) is added for 17 h, followed by addition of 5-bromodeoxyuridine (5-BrdU, 0.1 mM) for 6 h. Colcemid (1 g/ml) is added for the last 15 min before harvesting the cells. Cells are collected, washed in RPMI, incubated with a hypotonic solution of KCl (75 mM) at 37° C. for 15 min and fixed in three changes of methanol:aceticacid (3:1). The cell suspension is dropped onto a glass slide and air dried. The EST-related nucleic acids, positional segments of EST-related nucleic acids or fragments of positional segments of EST-related nucleic acids is labeled with biotin-16 dUTP by nick translation according to the manufacturer's instructions (Bethesda Research Laboratories, Bethesda, Md.), purified using a Sephadex G-50 column (Pharmacia, Upsala, Sweden) and precipitated. Just prior to hybridization, the DNA pellet is dissolved in hybridization buffer (50% formamide, 2×SSC, 10% dextran sulfate, 1 mg/ml sonicated salmon sperm DNA, pH 7) and the probe is denatured at 70° C. for 5–10 min.

Slides kept at −20° C. are treated for 1 h at 37° C. with RNase A (100 g/ml), rinsed three times in 2×SSC and dehydrated in an ethanol series. Chromosome preparations are denatured in 70% formamide, 2×SSC for 2 min at 70° C., then dehydrated at 4° C. The slides are treated with proteinase K (10 g/100 ml in 20 mM Tris-HCl, 2 mM CaCl) at 37° C. for 8 min and dehydrated. The hybridization mixture containing the probe is placed on the slide, covered with a coverslip, sealed with rubber cement and incubated overnight in a humid chamber at 37° C. After hybridization and post-hybridization washes, the biotinylated probe is detected by avidin-FITC and amplified with additional layers of biotinylated goat anti-avidin and avidin-FITC. For chromosomal localization, fluorescent R-bands are obtained as previously described (Cherif et al., supra.). The slides are observed under a LEICA fluorescence microscope (DMRXA). Chromosomes are counterstained with propidium iodide and the fluorescent signal of the probe appears as two symmetrical yellow-green spots on both chromatids of the fluorescent R-band chromosome (red). Thus, a particular EST-related nucleic acids, positional segments of EST-related nucleic acids or fragments of positional segments of EST-related nucleic acids may be localized to a particular cytogenetic R-band on a given chromosome.

Once the EST-related nucleic acids, positional segments of EST-related nucleic acids or fragments of positional segments of EST-related nucleic acids have been assigned to particular chromosomes using the techniques described in Examples 41–43 above, they may be utilized to construct a high resolution map of the chromosomes on which they are located or to identify the chromosomes in a sample.

EXAMPLE 44

Use of EST-related Nucleic Acids Positional Segments of EST-related Nucleic Acids or Fragments of Positional Segments of EST-related Nucleic Acids to Construct or Expand Chromosome Maps Chromosome mapping involves assigning a given unique sequence to a particular chromosome as described above. Once the unique sequence has been mapped to a given chromosome, it is ordered relative to other unique sequences located on the same chromosome. One approach to chromosome mapping utilizes a series of yeast artificial chromosomes (YACs) bearing several thousand long inserts derived from the chromosomes of the organism from which the EST-related nucleic acids, positional segments of EST-related nucleic acids or fragments of positional segments of EST-related nucleic acids are obtained. This approach is described in Ramaiah Nagaraja et al, *Genome Research* 7:210–222, March 1997, the disclosure of which is incorporated herein by reference. Briefly, in this approach each chromosome is broken into overlapping pieces which are inserted into the YAC vector. The YAC inserts are screened using PCR or other methods to determine whether they include the EST-related nucleic acids, positional segments of EST-related nucleic acids or fragments of positional segments of EST-related nucleic acids whose position is to be determined. Once an insert has been found which includes the 5' EST, the insert can be analyzed by PCR or other methods to determine whether the insert also contains other sequences known to be on the chromosome or in the region from which the EST-related nucleic acids, positional segments of EST-related nucleic acids or fragments of positional segments of EST-related nucleic acids was derived. This process can be repeated for each insert in the YAC library to determine the location of each of the EST-related nucleic acids, positional segments of EST-related nucleic acids or fragments of positional segments of EST-related nucleic acids relative to one another and to other known chromosomal markers. In this way, a high resolution map of the distribution of numerous unique markers along each of the organisms chromosomes may be obtained.

As described in Example 45 below EST-related nucleic acids, positional segments of EST-related nucleic acids or fragments of positional segments of EST-related nucleic acids may also be used to identify genes associated with a particular phenotype, such as hereditary disease or drug response.

3. Use of EST-related Nucleic Acids Positional Segments of EST-related Nucleic acids or Fragments of Positional Segments of EST-related Nucleic Acids Gene Identification

EXAMPLE 45

Identification of Genes Associated With Hereditary Diseases or Drug Response This example illustrates an approach useful for the association of EST-related nucleic acids, positional segments of EST-related nucleic acids or fragments of positional segments of EST-related nucleic acids with particular phenotypic characteristics. In this example, a particular EST-related nucleic acids, positional segments of EST-related nucleic acids or fragments of positional segments of EST-related nucleic acids is used as a test probe to associate that EST-related nucleic acids, positional segments of EST-related nucleic acids or fragments of positional segments of EST-related nucleic acids with a particular phenotypic characteristic.

EST-related nucleic acids, positional segments of EST-related nucleic acids or fragments of positional segments of EST-related nucleic acids are mapped to a particular location on a human chromosome using techniques such as those described in Examples 41 and 42 or other techniques known in the art. A search of Mendelian Inheritance in Man (V. McKusick, *Mendelian Inheritance in Man* (available on line through Johns Hopkins University Welch Medical Library) reveals the region of the human chromosome which contains the EST-related nucleic acids, positional segments of EST-related nucleic acids or fragments of positional segments of EST-related nucleic acids to be a very gene rich region containing several known genes and several diseases or phenotypes for which genes have not been identified. The gene corresponding to this EST-related nucleic acids, positional segments of EST-related nucleic acids or fragments of positional segments of EST-related nucleic acids thus becomes an immediate candidate for each of these genetic diseases.

Cells from patients with these diseases or phenotypes are isolated and expanded in culture. PCR primers from the EST-related nucleic acids, positional segments of EST-related nucleic acids or fragments of positional segments of EST-related nucleic acids are used to screen genomic DNA, mRNA or cDNA obtained from the patients. EST-related nucleic acids, positional segments of EST-related nucleic acids or fragments of positional segments of EST-related nucleic acids that are not amplified in the patients can be positively associated with a particular disease by further analysis. Alternatively, the PCR analysis may yield fragments of different lengths when the samples are derived from an individual having the phenotype associated with the disease than when the sample is derived from a healthy individual, indicating that the gene containing the EST-related nucleic acids, positional segments of EST-related nucleic acids or fragments of positional segments of EST-related nucleic acids may be responsible for the genetic disease.

VII. Use of EST-related Nucleic Acids, Positional Segments of EST-related Nucleic Acids or Fragments of Positional Segments of EST-related Nucleic Acids to Construct Vectors and Uses Thereof The present EST-related nucleic acids, positional segments of EST-related nucleic acids or fragments of positional segments of EST-related nucleic acids may also be used to construct secretion vectors capable of directing the secretion of the proteins encoded by genes therein. Such secretion vectors may facilitate the purification or enrichment of the proteins encoded by genes inserted therein by reducing the number of background proteins from which the desired protein must be purified or enriched. Exemplary secretion vectors are described in Example 46 below.

1. Construction of Vectors and Uses Thereof

EXAMPLE 46

Construction of Secretion Vectors

The secretion vectors of the present invention include a promoter capable of directing gene expression in the host cell, tissue, or organism of interest. Such promoters include the Rous Sarcoma Virus promoter, the SV40 promoter, the human cytomegaloviruspromoter, and other promoters familiar to those skilled in the art.

A signal sequence from one of the EST-related nucleic acids, positional segments of EST-related nucleic acids or fragments of positional segments of EST-related nucleic acids is operably linked to the promoter such that the mRNA transcribed from the promoter will direct the translation of the signal peptide. Preferably, the signal sequence is from one of the nucleic acids of SEQ ID NOs.24–3883. The host cell, tissue, or organism may be any cell, tissue, or organism which recognizes the signal peptide encoded by the signal sequence in the EST-related nucleic acids, positional segments of EST-related nucleic acids or fragments of positional segments of EST-related nucleic acids. Suitable hosts include mammalian cells, tissues or organisms, avian cells, tissues, or organisms, insect cells, tissues or organisms, or yeast.

In addition, the secretion vector contains cloning sites for inserting genes encoding the proteins which are to be secreted. The cloning sites facilitate the cloning of the insert gene in frame with the signal sequence such that a fusion protein in which the signal peptide is fused to the protein encoded by the inserted gene is expressed from the mRNA transcribed from the promoter. The signal peptide directs the extracellular secretion of the fusion protein.

The secretion vector may be DNA or RNA and may integrate into the chromosome of the host, be stably maintained as an extrachromosomal replicon in the host, be an artificial chromosome, or be transiently present in the host. Preferably, the secretion vector is maintained in multiple copies in each host cell. As used herein, multiple copies means at least 2, 5, 10, 20, 25, 50 or more than 50 copies per cell. In some embodiments, the multiple copies are maintained extrachromosomally. In other embodiments, the multiple copies result from amplification of a chromosomal sequence.

Many nucleic acid backbones suitable for use as secretion vectors are known to those skilled in the art, including retroviral vectors, SV40 vectors, Bovine Papilloma Virus vectors, yeast integrating plasmids, yeast episomal plasmids, yeast artificial chromosomes, human artificial chromosomes, P element vectors, baculovirus vectors, or bacterial plasmids capable of being transiently introduced into the host.

The secretion vector may also contain a polyA signal such that the polyA signal is located downstream of the gene inserted into the secretion vector.

After the gene encoding the protein for which secretion is desired is inserted into the secretion vector, the secretion vector is introduced into the host cell, tissue, or organism using calcium phosphate precipitation, DEAE-Dextran, electroporation, liposome-mediatedtransfection, viral particles or as naked DNA. The protein encoded by the inserted gene is then purified or enriched from the supernatant using conventional techniques such as ammonium sulfate precipitation, immunoprecipitation, immunoaffinitychromatography, size exclusion chromatography, ion exchange chromatography, and HPLC. Alternatively, the secreted protein may be in a sufficiently enriched or pure state in the supernatant or growth media of the host to permit it to be used for its intended purpose without further enrichment.

The signal sequences may also be inserted into vectors designed for gene therapy. In such vectors, the signal sequence is operably linked to a promoter such that mRNA transcribed from the promoter encodes the signal peptide. A cloning site is located downstream of the signal sequence such that a gene encoding a protein whose secretion is desired may readily be inserted into the vector and fused to the signal sequence. The vector is introduced into an appropriate host cell. The protein expressed from the promoter is secreted extracellularly, thereby producing a therapeutic effect.

EXAMPLE 47

Fusion Vectors

The EST-related nucleic acids, positional segments of EST-related nucleic acids or fragments of positional segments of EST-related nucleic acids may be used to construct fusion vectors for the expression of chimeric polypeptides. The chimeric polypeptides comprise a first polypeptide portion and a second polypeptide portion. In the fusion vectors of the present invention, nucleic acids encoding the first polypeptide portion and the second polypeptide portion are joined in frame with one another so as to generate a nucleic acid encoding the chimeric polypeptide. The nucleic acid encoding the chimeric polypeptide is operably linked to a promoter which directs the expression of an mRNA encoding the chimeric polypeptide. The promoter may be in any of the expression vectors described herein including those described in Examples 20 and 46.

Preferably, the fusion vector is maintained in multiple copies in each host cell. In some embodiments, the multiple copies are maintained extrachromosomally. In other embodiments, the multiple copies result from amplification of a chromosomal sequence.

The first polypeptide portion may comprise any of the polypeptides encoded by the EST-related nucleic acids, positional segments of EST-related nucleic acids or fragments of positional segments of EST-related nucleic acids. In some embodiments, the first polypeptide portion may be one of the EST-related polypeptides, fragments of EST-related polypeptides, positional segments of EST-related polypeptides, or fragments of positional segments of EST-related polypeptides.

The second polypeptide portion may comprise any polypeptide of interest. In some embodiments, the second polypeptide portion may comprise a polypeptide having a detectable enzymatic activity such as green fluorescent protein or β galactosidase. Chimeric polypeptides in which the second polypeptide portion comprises a detectable polypeptide may be used to determine the intracellular localization of the first polypeptide portion. In such procedures, the fusion vector encoding the chimeric polypeptide is introduced into a host cell under conditions which facilitate the expression of the chimeric polypeptide. Where appropriate, the cells are treated with a detection reagent which is visible under the microscope following a catalytic reaction with the detectable polypeptide and the cellular location of the detection reagent is determined. For example, if the polypeptide having a detectable enzymatic activity is β galactosidase, the cells may be treated with Xgal. Alternatively, where the detectable polypeptide is directly detectable without the addition of a detection reagent, the intracellular location of the chimeric polypeptide is determined by performing microscopy under conditions in which the dectable polypeptide is visible. For example, if the detectable polypeptide is green fluorescent protein or a modified version thereof, microscopy is performed by exposing the host cells to light having an appropriate wavelength to cause the green fluorescent protein or modified version thereof to fluoresce.

Alternatively, the second polypeptide portion may comprise a polypeptide whose isolation, purification, or enrichment is desired. In such embodiments, the isolation, purification, or enrichment of the second polypeptide portion may be achieved by performing the immunoaffinity chromatography procedures described below using an immunoaffinity column having an antibody directed against the first polypeptide portion coupled thereto.

The proteins encoded by the EST-related nucleic acids, positional segments of EST-related nucleic acids or fragments of positional segments of EST-related nucleic acids or the EST-related polypeptides, fragments of EST-related polypeptides, positional segments of EST-related polypeptides, or fragments of positional segments of EST-related polypeptides may also be used to generate antibodies as explained in Examples 20 and 33 in order to identify the tissue type or cell species from which a sample is derived as described in Example 48.

EXAMPLE 48

Identification of Tissue Types or Cell Species by Means of Labeled Tissue Specific Antibodies Identification of specific tissues is accomplished by the visualization of tissue specific antigens by means of antibody preparations according to Examples 20 and 33 which are conjugated, directly or indirectly to a detectable marker. Selected labeled antibody species bind to their specific antigen binding partner in tissue sections, cell suspensions, or in extracts of soluble proteins from a tissue sample to provide a pattern for qualitative or semi-qualitative interpretation.

Antisera for these procedures must have a potency exceeding that of the native preparation, and for that reason, antibodies are concentrated to a mg/ml level by isolation of the gamma globulin fraction, for example, by ion-exchange chromatography or by ammonium sulfate fractionation. Also, to provide the most specific antisera, unwanted antibodies, for example to common proteins, must be removed from the gamma globulin fraction, for example by means of insoluble immunoabsorbents, before the antibodies are labeled with the marker. Either monoclonal or heterologous antisera is suitable for either procedure.

1. Immunohistochemical Techniques

Purified, high-titer antibodies, prepared as described above, are conjugated to a detectable marker, as described, for example, by Fudenberg, H., Chap. 26 in: *Basic 503 Clinical Immunology*, $3^{rd}$ Ed. Lange, Los Altos, Calif. (1980) or Rose, et al., Chap. 12 in: *Methods in ImmunodiagNOsis*, 2d Ed. John Wiley and Sons, New York (1980), the disclosures of which are incorporated herein by reference.

A fluorescent marker, either fluorescein or rhodamine, is preferred, but antibodies can also be labeled with an enzyme that supports a color producing reaction with a substrate, such as horseradish peroxidase. Markers can be added to tissue-bound antibody in a second step, as described below. Alternatively, the specific antitissue antibodies can be labeled with ferritin or other electron dense particles, and localization of the ferritin coupled antigen-antibody complexes achieved by means of an electron microscope. In yet another approach, the antibodies are radiolabeled, with, for example $^{125}I$, and detected by overlaying the antibody treated preparation with photographic emulsion.

Preparations to carry out the procedures can comprise monoclonal or polyclonal antibodies to a single protein or peptide identified as specific to a tissue type, for example, brain tissue, or antibody preparations to several antigenically distinct tissue specific antigens can be used in panels, independently or in mixtures, as required.

Tissue sections and cell suspensions are prepared for immunohistochemical examination according to common histological techniques. Multiple cryostat sections (about 4 m, unfixed) of the unknown tissue and known control, are mounted and each slide covered with different dilutions of the antibody preparation. Sections of known and unknown tissues should also be treated with preparations to provide a positive control, a negative control, for example, preimmune sera, and a control for non-specific staining, for example, buffer.

Treated sections are incubated in a humid chamber for 30 min at room temperature, rinsed, then washed in buffer for 30–45 min. Excess fluid is blotted away, and the marker developed.

If the tissue specific antibody was not labeled in the first incubation, it can be labeled at this time in a second antibody-antibody reaction, for example, by adding fluorescein- or enzyme-conjugated antibody against the immunoglobulin class of the antiserum-producing species, for example, fluorescein labeled antibody to mouse IgG. Such labeled sera are commercially available.

The antigen found in the tissues by the above procedure can be quantified by measuring the intensity of color or fluorescence on the tissue section, and calibrating that signal using appropriate standards.

2. Identification of Tissue Specific Soluble Proteins

The visualization of tissue specific proteins and identification of unknown tissues from that procedure is carried out using the labeled antibody reagents and detection strategy as described for immunohistochemistry; however the sample is prepared according to an electrophoretic technique to distribute the proteins extracted from the tissue in an orderly array on the basis of molecular weight for detection.

A tissue sample is homogenized using a Virtis apparatus; cell suspensions are disrupted by Dounce homogenization or osmotic lysis, using detergents in either case as required to disrupt cell membranes, as is the practice in the art. Insoluble cell components such as nuclei, microsomes, and membrane fragments are removed by ultracentrifugation, and the soluble protein-containing fraction concentrated if necessary and reserved for analysis.

A sample of the soluble protein solution is resolved into individual protein species by conventional SDS polyacrylamide electrophoresis as described, for example, by Davis, L. el al., Section 19-2 in: *Basic Methods in Molecular Biology* (P. Leder, ed), Elsevier, New York (1986), the disclosure of which is incorporated herein by reference, using a range of amounts of polyacrylamide in a set of gels to resolve the entire molecular weight range of proteins to be detected in the sample. A size marker is run in parallel for purposes of estimating molecular weights of the constituent proteins. Sample size for analysis is a convenient volume of from 5 to 55 l, and containing from about 1 to 100 g protein. An aliquot of each of the resolved proteins is transferred by blotting to a nitrocellulose filter paper, a process that maintains the pattern of resolution. Multiple copies are prepared. The procedure, known as Western Blot Analysis, is well described in Davis, L. et al., supra Section 19-3. One set of nitrocellulose blots is stained with Coomassie Blue dye to visualize the entire set of proteins for comparison with the antibody bound proteins. The remaining nitrocellulose filters are then incubated with a solution of one or more specific antisera to tissue specific proteins prepared as described in Examples 20 and 33. In this procedure, as in procedure A above, appropriate positive and negative sample and reagent controls are run.

In either procedure described above a detectable label can be attached to the primary tissue antigen-primary antibody complex according to various strategies and permutations thereof. In a straightforward approach, the primary specific antibody can be labeled; alternatively, the unlabeled complex can be bound by a labeled secondary anti-IgG antibody. In other approaches, either the primary or secondary antibody is conjugated to a biotin molecule, which can, in a subsequent step, bind an avidin conjugated marker. According to yet another strategy, enzyme labeled or radioactive protein A, which has the property of binding to any IgG, is bound in a final step to either the primary or secondary antibody.

EXAMPLE 49

Immunohistochemical Localization of Polypeptides

The antibodies prepared as described in Examples 20 and 33 above may be utilized to determine the cellular location of a polypeptide. The polypeptide may be any of the polypeptides encoded by EST-related nucleic acids, positional segments of EST-related nucleic acids or fragments of positional segments of EST-related nucleic acids or the polypeptide may be one of the EST-related polypeptides, fragments of EST-related polypeptides, positional segments of EST-related polypeptides, or fragments of positional segments of EST-related polypeptides. In some embodiments, the polypeptide may be a chimeric polypeptide such as those encoded by the fusion vectors of Example 47.

Cells expressing the polypeptide to be localized are applied to a microscope slide and fixed using any of the procedures typically employed in immunohistochemical localization techniques, including the methods described in *Current Protocols in Molecular Biology*, John Wiley and Sons, Inc. 1997. Following a washing step, the cells are contacted with the antibody. In some embodiments, the antibody is conjugated to a detectable marker as described above to facilitate detection. Alternatively, in some embodiments, after the cells have been contacted with an antibody to the polypeptide to be localized, a secondary antibody which has been conjugated to a detectable marker is placed in contact with the antibody against the polypeptide to be localized.

Thereafter, microscopy is performed under conditions suitable for visualizing the cellular location of the polypeptide.

The visualization of tissue specific antigen binding at levels above those seen in control tissues to one or more tissue specific antibodies, directed against the polypeptides encoded by EST-related nucleic acids, positional segments of EST-related nucleic acids or fragments of positional segments of EST-related nucleic acids or antibodies against the EST-related polypeptides, fragments of EST-related polypeptides, positional segments of EST-related polypeptides, or fragments of positional segments of EST-related polypeptides, can identify tissues of unknown origin, for example, forensic samples, or differentiated tumor tissue that has metastasized to foreign bodily sites.

The antibodies of Example 20 and 33 may also be used in the immunoaffinity chromatography techniques described below to isolate, purify or enrich the polypeptides encoded by the EST-related nucleic acids, positional segments of EST-related nucleic acids or fragments of positional segments of EST-related nucleic acids or to isolate, purify or enrich EST-related polypeptides, fragments of EST-related polypeptides, positional segments of EST-related polypeptides, or fragments of positional segments of EST-related polypeptides. The immunoaffinity chromatography techniques described below may also be used to isolate, purify or enrich polypeptides which have been linked to the polypeptides encoded by the EST-related nucleic acids, positional segments of EST-related nucleic acids or fragments of positional segments of EST-related nucleic acids or to isolate, purify or enrich polypeptides which have been linked to EST-related polypeptides, fragments of EST-related polypeptides, positional segments of EST-related polypeptides, or fragments of positional segments of EST-related polypeptides.

EXAMPLE 50

Immunoaffinity Chromatography

Antibodies prepared as described above are coupled to a support. Preferably, the antibodies are monoclonal antibodies, but polyclonal antibodies may also be used. The support may be any of those typically employed in immunoaffinity chromatography, including Sepharose CL-4B (Pharmacia, Piscataway, N.J.), Sepharose CL-2B (Pharmacia, Piscataway, N.J.), Affi-gel 10 (Biorad, Richmond, Calif.), or glass beads.

The antibodies may be coupled to the support using any of the coupling reagents typically used in immunoaffinity chromatography, including cyanogen bromide. After coupling the antibody to the support, the support is contacted with a sample which contains a target polypeptide whose isolation, purification or enrichment is desired. The target polypeptide may be a polypeptide encoded by the EST-related nucleic acids, positional segments of EST-related nucleic acids or fragments of positional segments of EST-related nucleic acids or the target polypeptide may be one of the EST-related polypeptides, fragments of EST-related polypeptides, positional segments of EST-related polypeptides, or fragments of positional segments of EST-related polypeptides. The target polypeptides may also be polypeptides which have been linked to the polypeptides encoded by the EST-related nucleic acids, positional segments of EST-related nucleic acids or fragments of positional segments of EST-related nucleic acids or the target polypeptides may be polypeptides which have been linked to EST-related polypeptides, fragments of EST-related polypeptides, positional segments of EST-related polypeptides, or fragments of positional segments of EST-related polypeptides using the fusion vectors described above.

Preferably, the sample is placed in contact with the support for a sufficient amount of time and under appropriate conditions to allow at least 50% of the target polypeptide to specifically bind to the antibody coupled to the support.

Thereafter, the support is washed with an appropriate wash solution to remove polypeptides which have non-specifically adhered to the support. The wash solution may be any of those typically employed in immunoaffinity chromatography, including PBS, Tris-lithium chloride buffer (01 M lysine base and 0.5 M lithium chloride, pH 8.0), Tris-hydrochloride buffer (0.05 M Tris-hydrochloride, pH 8.0), or Tris/Triton/NaCl buffer (50 Mm Tris.cl, pH 8.0 or 9.0, 0.1% Triton X1100, and 0.5 MNaCl).

After washing, the specifically bound target polypeptide is eluted from the support using the high pH or low pH elution solutions typically employed in immunoaffinity chromatography. In particular, the elution solutions may contain an eluant such as triethanolamine, diethylamine, calcium chloride, sodium thiocyanate, potasssium bromide, acetic acid, or glycine. In some embodiments, the elution solution may also contain a detergent such as Triton X-100 or octyl-β-D-glucoside.

The EST-related nucleic acids, positional segments of EST-related nucleic acids or fragments of positional segments of EST-related nucleic acids may also be used to clone sequences located upstream of the 5' ESTs which are capable of regulating gene expression, including promoter sequences, enhancer sequences, and other upstream sequences which influence transcription or translation levels. Once identified and cloned, these upstream regulatory sequences may be used in expression vectors designed to direct the expression of an inserted gene in a desired spatial, temporal, developmental, or quantitative fashion. Example 51 describes a method for cloning sequences upstream of the EST-related nucleic acids, positional segments of EST-related nucleic acids or fragments of positional segments of EST-related nucleic acids.

2. Identification of Upstream Sequences With Promoting or Regulatory Activities

EXAMPLE 51

Use of EST-related Nucleic Acids Positional Segments of EST-related Nucleic Acids or Fragments of Positional Segments of EST-related Nucleic Acids to Clone Upstream Sequences From Genomic DNA Sequences derived from EST-related nucleic acids, positional segments of EST-related nucleic acids or fragments of positional segments of EST-related nucleic acids may be used to isolate the promoters of the corresponding genes using chromosome walking techniques. In one chromosome walking technique, which utilizes the Genome Walker kit available from Clontech, five complete genomic DNA samples are each digested with a different restriction enzyme which has a 6 base recognition site and leaves a blunt end. Following digestion, oligonucleotide adapters are ligated to each end of the resulting genomic DNA fragments.

For each of the five genomic DNA libraries, a first PCR reaction is performed according to the manufacturer's instructions (which are incorporated herein by reference) using an outer adapter primer provided in the kit and an outer gene specific primer. The gene specific primer should be selected to be specific for 5' EST of interest and should have a melting temperature, length, and location in the EST-related nucleic acids, positional segments of EST-related nucleic acids or fragments of positional segments of EST-related nucleic acids which is consistent with its use in PCR reactions. Each first PCR reaction contains 5ng of genomic DNA, 5 μl of 10×Tth reaction buffer, 0.2 Mm of each dNTP, 0.2 μM each of outer adapter primer and outer gene specific primer, 1.1 Mm of Mg(OAc)$_2$, and 1 μl of the Tth polymerase 50×mix in a total volume of 50 μl. The reaction cycle for the first PCR reaction is as follows: 1 min at 94° C./2 sec at 94° C., 3 min at 72° C. (7 cycles)/2 sec at 94° C., 3 min at 67° C. (32 cycles)/5 min at 67° C.

The product of the first PCR reaction is diluted and used as a template for a second PCR reaction according to the manufacturer's instructions using a pair of nested primers which are located internally on the amplicon resulting from the first PCR reaction. For example, 5 μl of the reaction product of the first PCR reaction mixture may be diluted 180 times. Reactions are made in a 50 μl volume having a composition identical to that of the first PCR reaction except the nested primers are used. The first nested primer is specific for the adapter, and is provided with the Genome Walker kit. The second nested primer is specific for the particular EST-related nucleic acids, positional segments of EST-related nucleic acids or fragments of positional segments of EST-related nucleic acids for which the promoter is to be cloned and should have a melting temperature, length, and location in the EST-related nucleic acids, positional segments of EST-related nucleic acids or fragments of positional segments of EST-related nucleic acids which is consistent with its use in PCR reactions. The reaction parameters of the second PCR reaction are as follows: 1 min at 94° C./2 sec at 94° C., 3 min at 72° C. (6 cycles)/2 sec at 94° C., 3 min at 67° C. (25 cycles)/5 min at –67° C. The product of the second PCR reaction is purified, cloned, and sequenced using standard techniques.

Alternatively, two or more human genomic DNA libraries can be constructed by using two or more restriction enzymes. The digested genomic DNA is cloned into vectors which can be converted into single stranded, circular, or linear DNA. A biotinylated oligonucleotide comprising at least 15 nucleotides from the EST-related nucleic acids, positional segments of EST-related nucleic acids or fragments of positional segments of EST-related nucleic acids sequence is hybridized to the single stranded DNA. Hybrids between the biotinylated oligonucleotide and the single stranded DNA containing the EST-related nucleic acids, positional segments of EST-related nucleic acids or fragments of positional segments of EST-related nucleic acids are isolated as described above. Thereafter, the single stranded DNA containing the EST-related nucleic acids, positional segments of EST-related nucleic acids or fragments of positional segments of EST-related nucleic acids is released from the beads and converted into double stranded DNA using a primer specific for the EST-related nucleic acids, positional segments of EST-related nucleic acids or fragments of positional segments of EST-related nucleic acids or a primer corresponding to a sequence included in the cloning vector. The resulting double stranded DNA is transformed into bacteria. cDNAs containing the EST-related nucleic acids, positional segments of EST-related nucleic acids or fragments of positional segments of EST-related nucleic acids are identified by colony PCR or colony hybridization.

Once the upstream genomic sequences have been cloned and sequenced as described above, prospective promoters and transcription start sites within the upstream sequences may be identified by comparing the sequences upstream of the EST-related nucleic acids, positional segments of EST-related nucleic acids or fragments of positional segments of EST-related nucleic acids with databases containing known transcription start sites, transcription factor binding sites, or promoter sequences.

In addition, promoters in the upstream sequences may be identified using promoter reporter vectors as described in Example 52.

EXAMPLE 52

Identification of Promoters in Cloned Upstream Sequences

The genomic sequences upstream of the EST-related nucleic acids, positional segments of EST-related nucleic acids or fragments of positional segments of EST-related nucleic acids are cloned into a suitable promoter reporter vector, such as the pSEAP-Basic, pSEAP-Enhancer, pβgal-Basic, pβgal-Enhancer, or pEGFP-1 Promoter Reporter vectors available from Clontech. Briefly, each of these promoter reporter vectors include multiple cloning sites positioned upstream of a reporter gene encoding a readily assayable protein such as secreted alkaline phosphatase, β galactosidase, or green fluorescent protein. The sequences upstream of the EST-related nucleic acids, positional segments of EST-related nucleic acids or fragments of positional segments of EST-related nucleic acids are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for augmenting transcription levels from weak promoter sequences. A significant level of expression above that observed with the vector lacking an insert indicates that a promoter sequence is present in the inserted upstream sequence.

Appropriate host cells for the promoter reporter vectors may be chosen based on the results of the above described determination of expression patterns of the EST-related nucleic acids, positional segments of EST-related nucleic acids or fragments of positional segments of EST-related nucleic acids. For example, if the expression pattern analysis indicates that the mRNA corresponding to a particular EST-related nucleic acids, positional segments of EST-related nucleic acids or fragments of positional segments of EST-related nucleic acids is expressed in fibroblasts, the promoter reporter vector may be introduced into a human fibroblast cell line.

Promoter sequences within the upstream genomic DNA may be further defined by constructing nested deletions in the upstream DNA using conventional techniques such as Exonuclease III digestion. The resulting deletion fragments can be inserted into the promoter reporter vector to determine whether the deletion has reduced or obliterated promoter activity. In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into the cloning sites in the promoter reporter vectors.

EXAMPLE 53

Cloning and Identification of Promoters

Using the method described in Example 51 above with 5' ESTs, sequences upstream of several genes were obtained. Using the primer pairs GGG AAG ATG GAG ATA GTA TTG CCT G (SEQ ID NO.15) and CTG CCA TGT ACA TGA TAG AGA GAT TC (SEQ ID NO.16), the promoter having the internal designation p13H2 (SEQ ID NO.17) was obtained.

Using the primer pairs GTA CCA GGGG ACT GTG ACC ATT GC (SEQ ID NO.18) and CTG TGA CCA TTG CTC CCA AGA GAG (SEQ ID NO.19), the promoter having the internal designation P15B4 (SEQ ID NO.20) was obtained.

Using the primer pairs CTG GGA TGG AAG GCA CGG TA (SEQ ID NO.21) and GAG ACC ACA CAG CTA GAC AA (SEQ ID NO.22), the promoter having the internal designation P29B6 (SEQ ID NO.23) was obtained.

Figure 4:
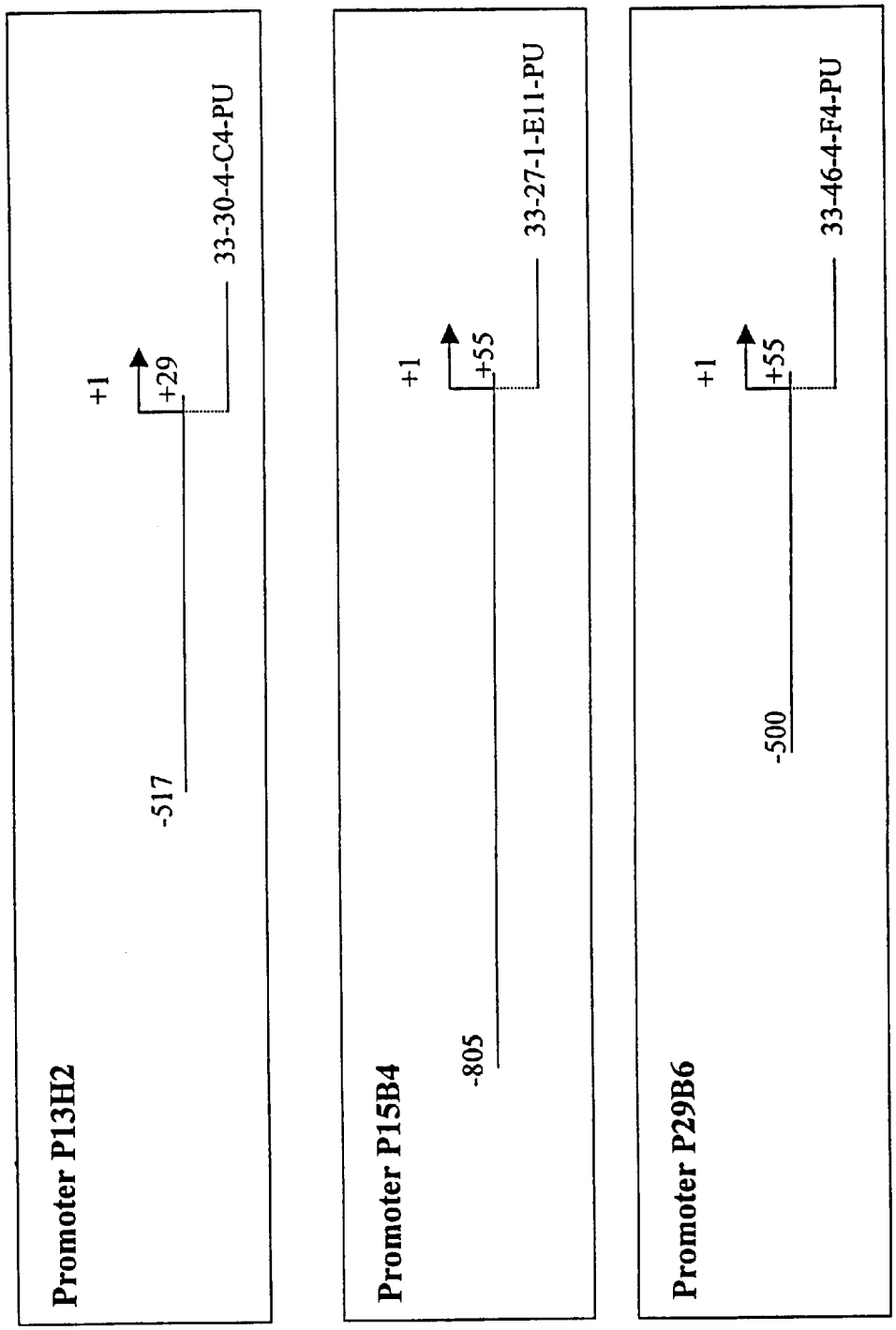
FIG. 4 provides a schematic description of the promoters isolated and the way they are assembled with the corresponding 5' ESTs.

FIG. 4 provides a schematic description of the promoters isolated and the way they are assembled with the corresponding 5'tags. The upstream sequences were screened for the presence of motifs resembling transcription factor binding sites or known transcription start sites using the computer program MatInspector release 2.0, August 1996.

FIG. 5 describes the transcription factor binding sites present in each of these promoters. The columns labeled matrice provides the name of the MatInspector matrix used. The column labeled position provides the 5' position of the promoter site. Numeration of the sequence starts from the transcription site as determined by matching the genomic sequence with the 5' EST sequence. The column labeled "orientation" indicates the DNA strand on which the site is found, with the + strand being the coding strand as determined by matching the genomic sequence with the sequence of the 5' EST. The column labeled "score" provides the MatInspector score found for this site. The column labeled "length" provides the length of the site in nucleotides. The column labeled "sequence" provides the sequence of the site found.

Bacterial clones containing plasmids containing the promoter sequences described above described above are presently stored in the inventor's laboratories under the internal identification numbers provided above. The inserts may be recovered from the deposited materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the inserted EST-related nucleic acids, positional segments of EST-related nucleic acids or fragments of positional segments of EST-related nucleic acids. The PCR product which corresponds to the EST-related nucleic acids, positional segments of EST-related nucleic acids or fragments of positional segments of EST-related nucleic acids can then be manipulated using standard cloning techniques familiar to those skilled in the art.

The promoters and other regulatory sequences located upstream of the EST-related nucleic acids, positional segments of EST-related nucleic acids or fragments of positional segments of EST-related nucleic acids may be used to design expression vectors capable of directing the expression of an inserted gene in a desired spatial, temporal, developmental, or quantitative manner. A promoter capable of directing the desired spatial, temporal, developmental, and quantitative patterns may be selected using the results of the expression analysis described above. For example, if a promoter which confers a high level of expression in muscle is desired, the promoter sequence upstream of EST-related nucleic acids, positional segments of EST-related nucleic acids or fragments of positional segments of EST-related nucleic acids derived from an mRNA which are expressed at a high level in muscle, as determined by the methods above, may be used in the expression vector.

Preferably, the desired promoter is placed near multiple restriction sites to facilitate the cloning of the desired insert downstream of the promoter, such that the promoter is able to drive expression of the inserted gene. The promoter may be inserted in conventional nucleic acid backbones designed for extrachromosomal replication, integration into the host chromosomes or transient expression. Suitable backbones for the present expression vectors include retroviral backbones, backbones from eukaryotic episomes such as SV40 or Bovine Papilloma Virus, backbones from bacterial episomes, or artificial chromosomes.

Preferably, the expression vectors also include a polyA signal downstream of the multiple restriction sites for directing the polyadenylation of mRNA transcribed from the gene inserted into the expression vector.

Following the identification of promoter sequences using the procedures of Examples 51–53, proteins which interact with the promoter may be identified as described in Example 54 below.

EXAMPLE 54

Identification of Proteins Which Interact With Promoter Sequences, Upstream Regulatory Sequences, or mRNA Sequences within the promoter region which are likely to bind transcription factors may be identified by homology to known transcription factor binding sites or through conventional mutagenesis or deletion analyses of reporter plasmids containing the promoter sequence. For example, deletions may be made in a reporter plasmid containing the promoter sequence of interest operably linked to an assayable reporter gene. The reporter plasmids carrying various deletions within the promoter region are transfected into an appropriate host cell and the effects of the deletions on expression levels is assessed. Transcription factor binding sites within the regions in which deletions reduce expression levels may be further localized using site directed mutagenesis, linker scanning analysis, or other techniques familiar to those skilled in the art.

Nucleic acids encoding proteins which interact with sequences in the promoter may be identified using one-hybrid systems such as those described in the manual accompanying the Matchmaker One-Hybrid System kit available from Clontech (Catalog No. K1603–1), the disclosure of which is incorporated herein by reference. Briefly, the Matchmaker One-hybrid system is used as follows. The target sequence for which it is desired to identify binding proteins is cloned upstream of a selectable reporter gene and integrated into the yeast genome. Preferably, multiple copies of the target sequences are inserted into the reporter plasmid in tandem. A library comprised of fusions between cDNAs to be evaluated for the ability to bind to the promoter and the activation domain of a yeast transcription factor, such as GAL4, is transformed into the yeast strain containing the integrated reporter sequence. The yeast are plated on selective media to select cells expressing the selectable marker linked to the promoter sequence. The colonies which grow on the selective media contain genes encoding proteins which bind the target sequence. The inserts in the genes encoding the fusion proteins are further characterized by sequencing. In addition, the inserts may be inserted into expression vectors or in vitro transcription vectors. Binding of the polypeptides encoded by the inserts to the promoter DNA may be confirmed by techniques familiar to those skilled in the art, such as gel shift analysis or DNAse protection analysis.

VIII. Use of EST-related Nucleic Acids, Positional Segments of EST-related Nucleic Acids or Fragments of Positional Segments of EST-related Nucleic Acids in Gene Therapy The present invention also comprises the use of EST-related nucleic acids, positional segments of EST-related nucleic acids or fragments of positional segments of EST-related nucleic acids in gene therapy strategies, including antisense and triple helix strategies as described in Examples 55 and 56 below. In antisense approaches, nucleic acid sequences complementary to an mRNA are hybridized to the mRNA intracellularly, thereby blocking the expression of the protein encoded by the mRNA. The antisense sequences may prevent gene expression through a variety of mechanisms. For example, the antisense sequences may inhibit the ability of ribosomes to translate the mRNA. Alternatively, the antisense sequences may block transport of the mRNA from the nucleus to the cytoplasm, thereby limiting the amount of mRNA available for translation. Another mechanism through which antisense sequences may inhibit gene expression is by interfering with mRNA splicing. In yet another strategy, the antisense nucleic acid may be incorporated in a ribozyme capable of specifically cleaving the target mRNA.

EXAMPLE 55

Preparation and Use of Antisense Oligonucleotides

The antisense nucleic acid molecules to be used in gene therapy may be either DNA or RNA sequences. They may comprise a sequence complementary to the sequence of the EST-related nucleic acids, positional segments of EST-related nucleic acids or fragments of positional segments of EST-related nucleic acids. The antisense nucleic acids should have a length and melting temperature sufficient to permit formation of an intracellular duplex with sufficient stability to inhibit the expression of the mRNA in the duplex. Strategies for designing antisense nucleic acids suitable for use in gene therapy are disclosed in Green et al., *Ann. Rev. Biochem.* 55:569–597 (1986) and Izant and Weintraub, *Cell* 36:1007–1015 (1984), which are hereby incorporated by reference.

In some strategies, antisense molecules are obtained from a nucleotide sequence encoding a protein by reversing the orientation of the coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of the antisense nucleic acids in vivo by operably linking DNA containing the antisense sequence to a promoter in an expression vector.

Alternatively, oligonucleotides which are complementary to the strand normally transcribed in the cell may be synthesized in vitro. Thus, the antisense nucleic acids are complementary to the corresponding mRNA and are capable of hybridizing to the mRNA to create a duplex. In some embodiments, the antisense sequences may contain modified sugar phosphate backbones to increase stability and make them less sensitive to RNase activity. Examples of modifications suitable for use in antisense strategies are described by Rossi et al., *Pharmacol. Ther.* 50(2):245–254, (1991) which is hereby incorporated by reference.

Various types of antisense oligonucleotides complementary to the sequence of the EST-related nucleic acids, positional segments of EST-related nucleic acids or fragments of positional segments of EST-related nucleic acids may be used. In one preferred embodiment, stable and semi-stable antisense oligonucleotides described in International Application No. PCT WO94/23026, hereby incorporated by reference, are used. In these molecules, the 3' end or both the 3' and 5' ends are engaged in intramolecular hydrogen bonding between complementary base pairs. These molecules are better able to withstand exonuclease attacks and exhibit increased stability compared to conventional antisense oligonucleotides.

In another preferred embodiment, the antisense oligodeoxynucleotides against herpes simplex virus types 1 and 2 described in International Application No. WO 95/04141, hereby incorporated by reference, are used.

In yet another preferred embodiment, the covalently cross-linked antisense oligonucleotides described in International Application No. WO 96/31523, hereby incorporated by reference, are used. These double- or single-stranded oligonucleotides comprise one or more, respectively, inter- or intra-oligonucleotidecovalent cross-linkages, wherein the linkage consists of an amide bond between a primary amine group of one strand and a carboxyl group of the other strand or of the same strand, respectively, the primary amine group being directly substituted in the 2' position of the strand nucleotide monosaccharide ring, and the carboxyl group being carried by an aliphatic spacer group substituted on a nucleotide or nucleotide analog of the other strand or the same strand, respectively.

The antisense oligodeoxynucleotides and oligonucleotides disclosed in International Application No. WO 92/18522, incorporated by reference, may also be used. These molecules are stable to degradation and contain at least one transcription control recognition sequence which binds to control proteins and are effective as decoys therefor. These molecules may contain "hairpin" structures, "dumbbell" structures, "modified dumbbell" structures, "cross-linked" decoy structures and "loop" structures.

In another preferred embodiment, the cyclic double-stranded oligonucleotides described in European Patent Application No. 0 572 287 A2, hereby incorporated by reference are used. These ligated oligonucleotide "dumbbells" contain the binding site for a transcription factor and inhibit expression of the gene under control of the transcription factor by sequestering the factor.

Use of the closed antisense oligonucleotides disclosed in International Application No. WO 92/19732, hereby incorporated by reference, is also contemplated. Because these molecules have no free ends, they are more resistant to degradation by exonucleases than are conventional oligonucleotides. These oligonucleotides may be multifunctional, interacting with several regions which are not adjacent to the target mRNA.

The appropriate level of antisense nucleic acids required to inhibit gene expression may be determined using in vitro expression analysis. The antisense molecule may be introduced into the cells by diffusion, injection, infection or transfection using procedures known in the art. For example, the antisense nucleic acids can be introduced into the body as a bare or naked oligonucleotide,oligonucleotide encapsulated in lipid, oligonucleotide sequence encapsidated by viral protein, or as an oligonucleotide operably linked to a promoter contained in an expression vector. The expression vector may be any of a variety of expression vectors known in the art, including retroviral or viral vectors, vectors capable of extrachromosomal replication, or integrating vectors. The vectors may be DNA or RNA.

The anti sense molecules are introduced onto cell samples at a number of different concentrations preferably between $1 \times 10^{-1}$M to $1 \times 10^{4}$M. Once the minimum concentration that can adequately control gene expression is identified, the optimized dose is translated to a dosage suitable for use in vivo. For example, an inhibiting concentration in culture of $1 \times 10^{-7}$ translates into a dose of approximately 0.6 mg/kg bodyweight. Levels of oligonucleotide approaching 100 mg/kg bodyweight or higher may be possible after testing the toxicity of the oligonucleotide in laboratory animals. It is additionally contemplated that cells from the vertebrate are removed, treated with the antisense oligonucleotide, and reintroduced into the vertebrate.

It is further contemplated that the antisense oligonucleotide sequence is incorporated into a ribozyme sequence to enable the antisense to specifically bind and cleave its target mRNA. For technical applications of ribozyme and antisense oligonucleotides see Rossi et al., supra.

In a preferred application of this invention, the polypeptide encoded by the gene is first identified, so that the effectiveness of antisense inhibition on translation can be monitored using techniques that include but are not limited to antibody-mediated tests such as RIAs and ELISA, functional assays, or radiolabeling.

The EST-related nucleic acids, positional segments of EST-related nucleic acids or fragments of positional segments of EST-related nucleic acids may also be used in gene therapy approaches based on intracellular triple helix formation. Triple helix oligonucleotides are used to inhibit transcription from a genome. They are particularly useful for studying alterations in cell activity as it is associated with a particular gene. The EST-related nucleic acids, positional segments of EST-related nucleic acids or fragments of positional segments of EST-related nucleic acids of the present invention or, more preferably, a portion of those sequences, can be used to inhibit gene expression in individuals having diseases associated with expression of a particular gene. Similarly, the EST-related nucleic acids, positional segments of EST-related nucleic acids or fragments of positional segments of EST-related nucleic acids can be used to study the effect of inhibiting transcription of a particular gene within a cell. Traditionally, homopurine sequences were considered the most useful for triple helix strategies. However, homopyrimidine sequences can also inhibit gene expression. Such homopyrimidine ligonucleotides bind to the major groove at homopurine:homopyrimidine sequences. Thus, both types of sequences from the EST-related nucleic acids, positional segments of EST-related nucleic acids or fragments of positional segments of EST-related nucleic acids are contemplated within the scope of this invention.

EXAMPLE 56

Preparation and Use of Triple Helix Probes

The sequences of the EST-related nucleic acids, positional segments of EST-related nucleic acids or fragments of positional segments of EST-related nucleic acids are scanned to identify 10-mer to 20-mer homopyrimidine or homopurine stretches which could be used in triple-helix based strategies for inhibiting gene expression. Following identification of candidate homopyrimidine or homopurine stretches, their efficiency in inhibiting gene expression is assessed by introducing varying amounts of oligonucleotides containing the candidate sequences into tissue culture cells which normally express the target gene. The oligonucleotides may be prepared on an oligonucleotide synthesizer or they may be purchased commercially from a company specializing in custom oligonucleotide synthesis, such as GENSET, Paris, France.

The oligonucleotides may be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced gene expression using techniques such as Northern blotting, RNase protection assays, or PCR based strategies to monitor the transcription levels of the target gene in cells which have been treated with the oligonucleotide. The cell functions to be monitored are predicted based upon the homologies of the target genes corresponding to the EST-related nucleic acids, positional segments of EST-related nucleic acids or fragments of positional segments of EST-related nucleic acids from which the oligonucleotide were derived with known gene sequences that have been associated with a particular function. The cell functions can also be predicted based on the presence of abnormal physiologies within cells derived from individuals with a particular inherited disease, particularly when the EST-related nucleic acids, positional segments of EST-related nucleic acids or fragments of positional segments of EST-related nucleic acids are associated with the disease using techniques described herein.

The oligonucleotides which are effective in inhibiting gene expression in tissue culture cells may then be introduced in vivo using the techniques described above and in Example 55 at a dosage calculated based on the in vitro results, as described in Example 55.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (*Science* 245:967–971 (1989), which is hereby incorporated by this reference).

EXAMPLE 57

Use of EST-related Nucleic Acids, Positional Segments of EST-related Nucleic Acids or Fragments of Positional Segments of EST-related Nucleic Acids to Express an Encoded Protein in a Host Organism The EST-related nucleic acids, positional segments of EST-related nucleic acids or fragments of positional segments of EST-related nucleic acids may also be used to express an encoded protein or polypeptide in a host organism to produce a beneficial effect. In addition, nucleic acids encoding the EST-related polypeptides, positional segments of EST-related polypeptides or fragments of positional segments of EST-related polypeptides may be used to express the encoded protein or polypeptide in a host organism to produce a beneficial effect.

In such procedures, the encoded protein or polypeptide may be transiently expressed in the host organism or stably expressed in the host organism. The encoded protein or polypeptide may have any of the activities described above. The encoded protein or polypeptide may be a protein or polypeptide which the host organism lacks or, alternatively, the encoded protein may augment the existing levels of the protein in the host organism.

In some embodiments in which the protein or polypeptide is secreted, nucleic acids encoding the full length protein (i.e. the signal peptide and the mature protein), or nucleic acids encoding only the mature protein (i.e. the protein generated when the signal peptide is cleaved off) is introduced into the host organism.

The nucleic acids encoding the proteins or polypeptides may be introduced into the host organism using a variety of techniques known to those of skill in the art. For example, the extended cDNA may be injected into the host organism as naked DNA such that the encoded protein is expressed in the host organism, thereby producing a beneficial effect.

Alternatively, the nucleic acids encoding the protein or polypeptide may be cloned into an expression vector downstream of a promoter which is active in the host organism. The expression vector may be any of the expression vectors designed for use in gene therapy, including viral or retroviral vectors. The expression vector may be directly introduced into the host organism such that the encoded protein is expressed in the host organism to produce a beneficial effect. In another approach, the expression vector may be introduced into cells in vitro. Cells containing the expression vector are thereafter selected and introduced into the host organism, where they express the encoded protein or polypeptide to produce a beneficial effect.

EXAMPLE 58

Use of Signal Peptides to Import Proteins Into Cells

The short core hydrophobic region (h) of signal peptides encoded by the sequences of SEQ ID NOs. 24–383 and 1339–2059 may also be used as a carrier to import a peptide or a protein of interest, so-called cargo, into tissue culture cells (Lin et al., *J. Biol. Chem.*, 270: 14225–14258 (1995); Du et al., *J. Peptide Res.*, 51: 235–243 (1998); Rojas et al., *Nature Biotech.*, 16: 370–375 (1998)).

When cell permeable peptides of limited size (approximately up to 25 amino acids) are to be translocated across cell membrane, chemical synthesis may be used in order to add the h region to either the C-terminus or the N-terminus to the cargo peptide of interest. Alternatively, when longer peptides or proteins are to be imported into cells, nucleic acids can be genetically engineered, using techniques familiar to those skilled in the art, in order to link the extended cDNA sequence encoding the h region to the 5' or the 3' end of a DNA sequence coding for a cargo polypeptide. Such genetically engineered nucleic acids are then translated either in vitro or in vivo after transfection into appropriate cells, using conventional techniques to produce the resulting cell permeable polypeptide. Suitable hosts cells are then simply incubated with the cell permeable polypeptide which is then translocated across the membrane.

This method may be applied to study diverse intracellular functions and cellular processes. For instance, it has been used to probe functionally relevant domains of intracellular proteins and to examine protein-protein interactions involved in signal transduction pathways (Lin et al., supra; Lin et al., *J. Biol. Chem.*, 271: 5305–5308 (1996); Rojas et al., *J. Biol. Chem.*, 271: 27456–27461 (1996); Liu et al., *Proc. Natl. Acad. Sci. USA*, 93: 11819–11824 (1996); Rojas et al., *Bioch. Biophys. Res. Commun.*, 234: 675–680 (1997)).

Such techniques may be used in cellular therapy to import proteins producing therapeutic effects. For instance, cells isolated from a patient may be treated with imported therapeutic proteins and then re-introduced into the host organism.

Alternatively, the h region of signal peptides of the present invention could be used in combination with a nuclear localization signal to deliver nucleic acids into cell nucleus. Such oligonucleotides may be antisense oligonucleotides or oligonucleotides designed to form triple helixes, as describedabove, in order to inhibit processing and maturation of a target cellular RNA.

EXAMPLE 59

Computer Embodiments

As used herein the term "cDNA codes of SEQ ID NOs. 24–3883 and 7744–19335" encompasses the nucleotide sequences of SEQ ID NOs. 24–3883 and 7744–19335, fragments of SEQ ID NOs. 24–3883 and 7744–19335, nucleotide sequences homologous to SEQ ID NOs. 24–3883 and 7744–19335 or homologous to fragments of SEQ ID NOs. 24–3883 and 7744–19335, and sequences complementary to all of the preceding sequences. The fragments include fragments of SEQ ID NOs. 24–3883 and 7744–19335 comprising at least 8, 10, 12, 15, 18, 20, 25, 28, 30, 35, 40, 50, 75, 100, 150, 200, 300, 400, 500, 1000 or 2000 consecutive nucleotides of SEQ ID NOs. 24–3883 and 7744–19335. Preferably, the fragments are novel fragments. Preferably the fragments include polynucleotides described in Tables IVa and IVb, polynucleotides described in Tables IVa and IVb updated, or fragments thereof comprising at least 8, 10, 12, 15, 18, 20, 25, 28, 30, 35, 40, 50, 75, 100, 150, 200, 300, 400, 500, 1000 or 2000 consecutive nucleotides of the polynucleotides described in Tables IVa and IVb, or polynucleotides described in Tables IVa and IVb updated. Homologous sequences and fragments of SEQ ID NOs. 24–3883 and 7744–19335 refer to a sequence having at least 99%, 98%, 97%, 96%, 95%, 90%, 85%, 80%, or 75% homology to these sequences. Homology may be determined using any of the computer programs and parameters described in Example 17, including BLAST2N with the default parameters or with any modified parameters. Homologous sequences also include RNA sequences in which uridines replace the thymines in the cDNA codes of SEQ ID NOs. 24–3883 and 7744–19335. The homologous sequences may be obtained using any of the procedures described herein or may result from the correction of a sequencing error as described above. Preferably the homologous sequences and fragments of SEQ ID NOs. 24–3883 and 7744–19335 include polynucleotides described in Tables IVa and IVb, polynucleotides described in Tables IVa and IVb updated, or fragments comprising at least 8, 10, 12, 15, 18, 20, 25, 28, 30, 35, 40, 50, 75, 100, 150, 200, 300, 400, 500, 1000 or 2000 consecutive nucleotides of the polynucleotides described in Tables IVa and IVb, or polynucleotides described in Tables IVa and IVb updated. It will be appreciated that the cDNA codes of SEQ ID NOs. 24–3883 and 7744–19335 can be represented in the traditional single character format (See the inside back cover of Styer, Lubert. *Biochemistry*, $3^{rd}$ edition. W. H Freeman & Co., New York.) or in any other format which records the identity of the nucleotides in a sequence.

As used herein the term "polypeptide codes of SEQ ID NOS. 3884–7743" encompasses the polypeptide sequence of SEQ ID NOs. 3884–7743 which are encoded by the cDNAs of SEQ ID NOs. 24–3883, polypeptide sequences homologous to the polypeptides of SEQ ID NOS. 3884–7743, or fragments of any of the preceding sequences. Homologous polypeptide sequences refer to a polypeptide sequence having at least 99%, 98%, 97%, 96%, 95%, 90%, 85%, 80%, 75% homology to one of the polypeptide sequences of SEQ ID NOS. 3884–7743. Homology may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 5, 8, 10, 12, 15, 20, 25, 30, 35, 40, 50, 60, 75, 100, 150 or 200 consecutive amino acids of the polypeptides of SEQ ID NOS. 3884–7743. Preferably, the fragments are novel fragments. Preferably, the fragments include polypeptides encoded by the polynucleotides described in Tables IVa and IVb, polynucleotides described in Tables IVa and IVb updated, or fragments thereof comprising at least 5, 10, 15, 20, 25, 30, 35, 40, 50, 75, 100, or 150 consecutive amino acids of the polypeptides encoded by the polynucleotides described in Tables IVa and IVb, or polynucleotides described in Tables IVa and IVb updated. It will be appreciated that the polypeptide codes of the SEQ ID NOS. 3884–7743 can be represented in the traditional single character format or three letter format (See the inside back cover of Starrier, Lubert. *Biochemistry*, $3^{rd}$ edition. W. H Freeman & Co., New York.) or in any other format which relates the identity of the polypeptides in a sequence.

It will be appreciated by those skilled in the art that the cDNA codes of SEQ ID NOs. 24–3883 and 7744–19335 and polypeptide codes of SEQ ID NOS. 3884–7743 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the cDNA codes of SEQ ID NOs. 24–3883 and 7744–19335, one or more of the polypeptide codes of SEQ ID NOS. 3884–7743. Another aspect of the present invention is a computer readable medium having recorded thereon at least 2, 5, 10, 15, 20, 25, 30, or 50 cDNA codes of SEQ ID NOs. 24–3883 and 7744–19335. Another aspect of the present invention is a computer readable medium having recorded thereon at least 2, 5, 10, 15, 20, 25, 30, or 50 polypeptide codes of SEQ ID NOS. 3884–7743.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Figure 6:
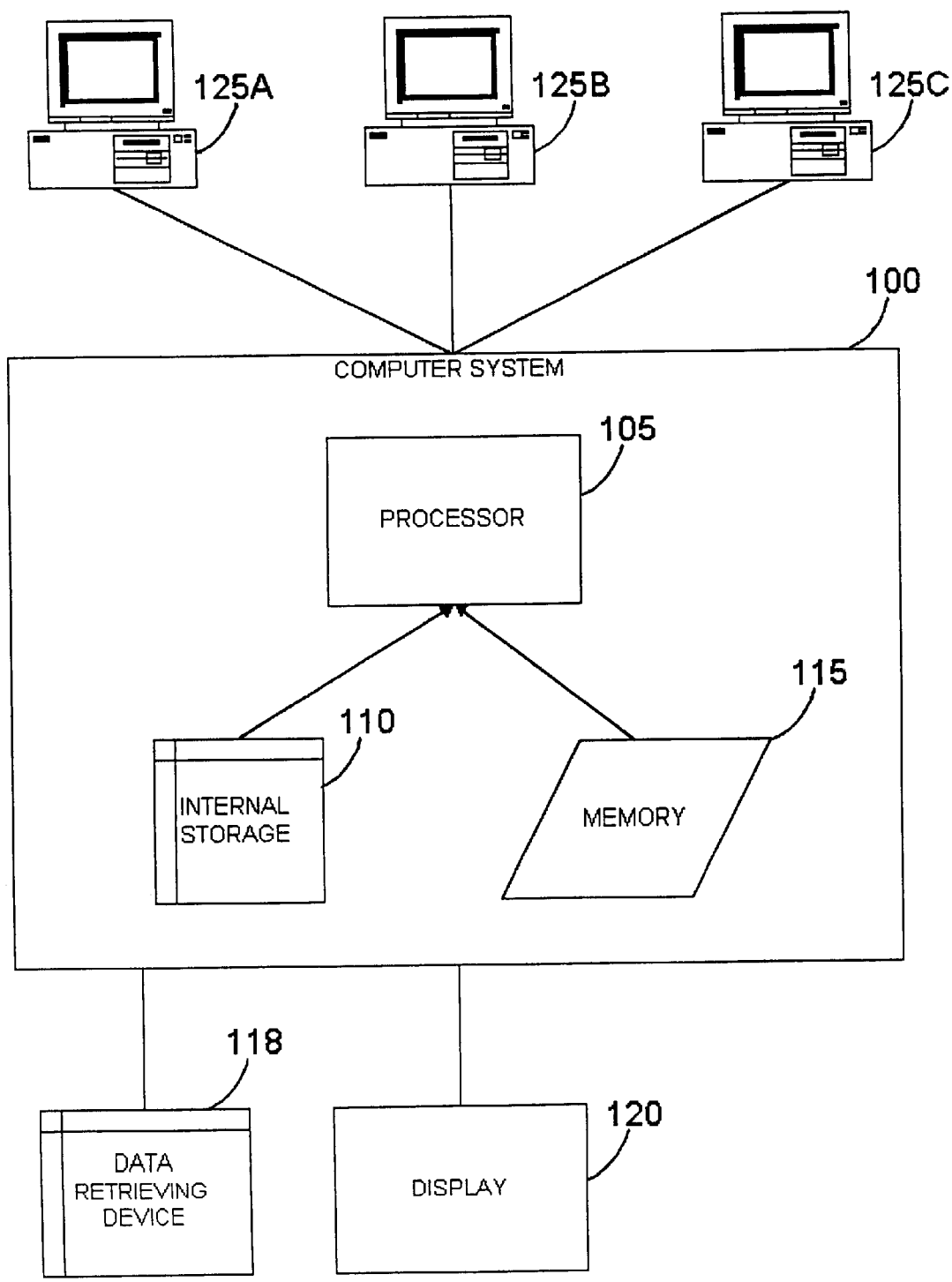
FIG. 6 is a block diagram of an exemplary computer system.

Embodiments of the present invention include systems, particularly computer systems which store and manipulate the sequence information described herein. One example of a computer system 100 is illustrated in block diagram form in FIG. 6. As used herein, "a computer system" refers to the hardware components, software components, and data storage components used to analyze the nucleotide sequences of the cDNA codes of SEQ ID NOs. 24–3883 and 7744–19335, or the amino acid sequences of the polypeptide codes of SEQ ID NOS. 3884–7743. In one embodiment, the computer system 100 is a Sun Enterprise 1000 server (Sun Microsystems, Palo Alto, Calif.). The computer system 100 preferably includes a processor for processing, accessing and manipulating the sequence data. The processor 105 can be any well-known type of central processing unit, such as the Pentium III from Intel Corporation, or similar processor from Sun, Motorola, Compaq or International Business Machines.

Preferably, the computer system 100 is a general purpose system that comprises the processor 105 and one or more internal data storage components 105 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 18 for reading the data stored on the internal data storage devices 101.

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a–c in a network or wide area network to provide centralized access to the computer system 100.

Software for accessing and processing the nucleotide sequences of the cDNA codes of SEQ ID NOs. 24–3883 and 7744–19335, or the amino acid sequences of the polypeptide codes of SEQ ID NOS. 3884–7743 (such as search tools, compare tools, and modeling tools etc.) may reside in main memory 115 during execution.

In some embodiments, the computer system 100 may further comprise a sequence comparer for comparing the above-described cDNA codes of SEQ ID NOs. 24–3883 and 7744–19335 or polypeptide codes of SEQ ID NOS. 3884–7743 stored on a computer readable medium to reference nucleotide or polypeptide sequences stored on a computer readable medium. A "sequence comparer" refers to one or more programs which are implemented on the computer system 100 to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the cDNA codes of SEQ ID NOs. 24–3883 and 7744–19335, or the amino acid sequences of the polypeptide codes of SEQ ID NOS. 3884–7743 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

Figure 7:
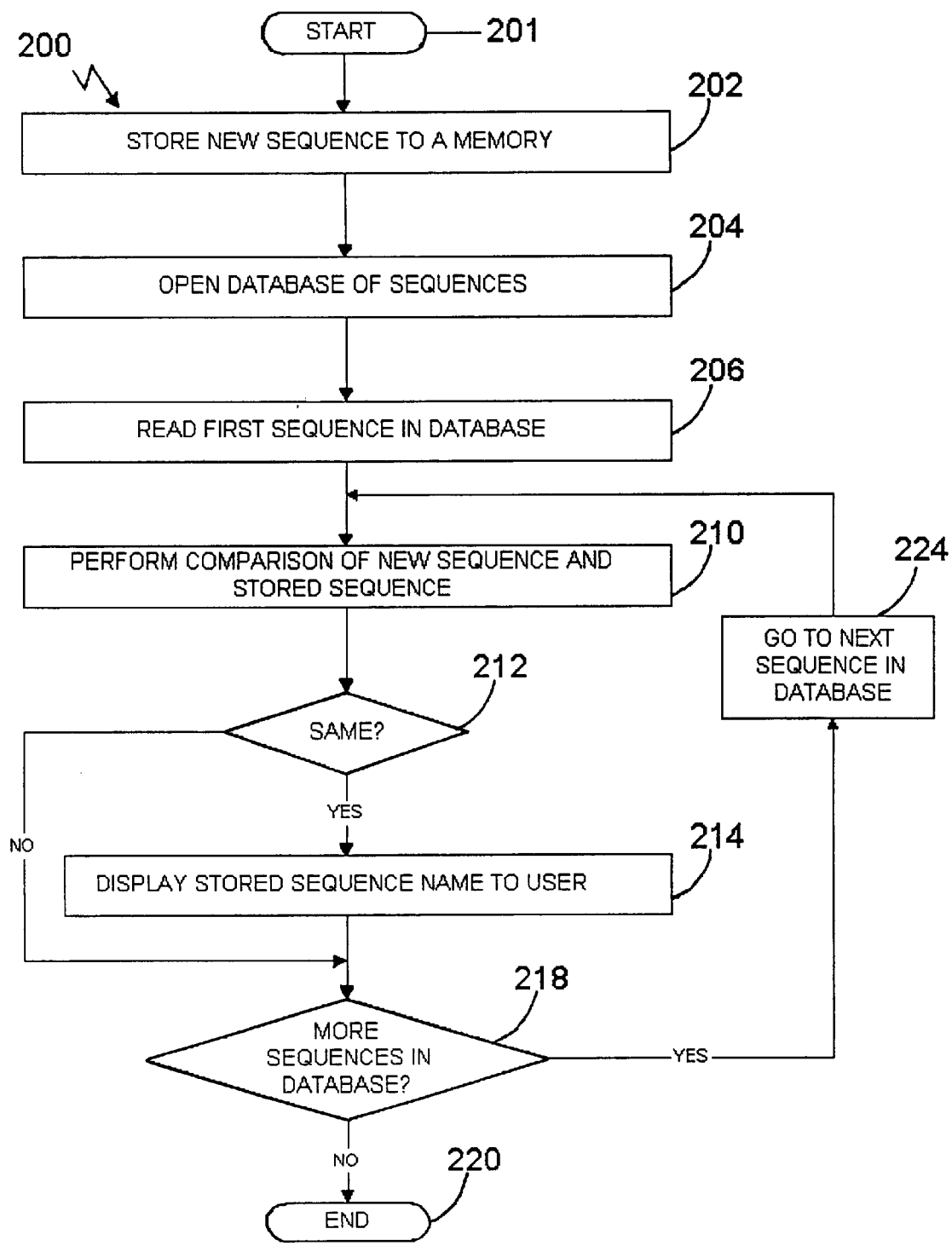
FIG. 7 is a flow diagram illustrating one embodiment of a process 200 for comparing a new nucleotide or protein sequence with a database of sequences in order to determine the homology levels between the new sequence and the sequences in the database.

FIG. 7 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK, PIR or SWISSPROT that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of SEQ ID NOs. 24–3883 and 7744–19335 or a polypeptide code of SEQ ID NOS. 3884–7743, a data storage device having retrievably stored thereon reference nucleotide sequences or polypeptide sequences to be compared to the nucleic acid code of SEQ ID NOs. 24–3883 and 7744–19335 or polypeptide code of SEQ ID NOS. 3884–7743 and a sequence comparer for conducting the comparison. The sequence comparer may indicate a homology level between the sequences compared or identify structural motifs in the above described nucleic acid code of SEQ ID NOs. 24–3883 and 7744–19335 and polypeptide codes of SEQ ID NOS. 3884–7743 or it may identify structural motifs in sequences which are compared to these cDNA codes and polypeptide codes. In some embodiments, the data storage device may have stored thereon the sequences of at least 2, 5, 10, 15, 20, 25, 30, or 50 of the cDNA codes of SEQ ID NOs. 24–3883 and 7744–19335 or polypeptide codes of SEQ ID NOS. 3884–7743.

Another aspect of the present invention is a method for determining the level of homology between a nucleic acid code of SEQ ID NOs. 24–3883 and 7744–19335 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described cDNA codes of SEQ ID NOs. 24–3883 and 7744–19335 through use of the computer program and determining homology between the cDNA codes and reference nucleotide sequences.

Figure 8:
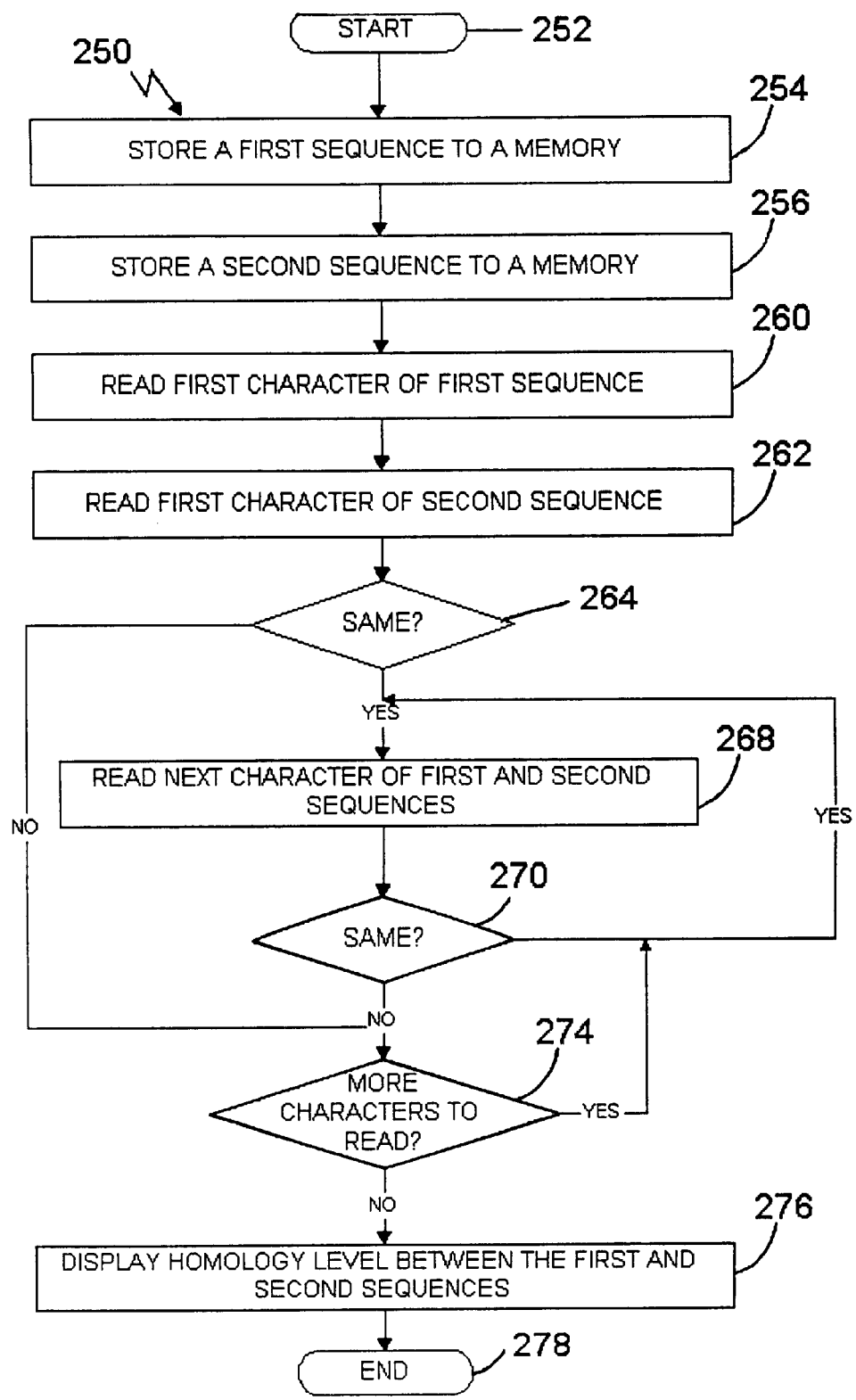
FIG. 8 is a flow diagram illustrating one embodiment of a process 250 in a computer for determining whether two sequences are homologous.

FIG. 8 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there aren't any more characters to read, then the process 250 moves to a state 276 wherein the level of homology between the first and second sequences is displayed to the user. The level of homology is determined by calculating the profragment of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the cDNA codes of the present invention, to reference nucleotide sequences in order to determine whether the nucleic acid code of SEQ ID NOs. 24–3883 and 7744–19335 differs from a reference nucleic acid sequence at one or more positions. Optionally such a program records the length and identity of inserted, deleted or substituted nucleotides with respect to the sequence of either the reference polynucleotide or the nucleic acid code of SEQ ID NOs. 24–3883 and 7744–19335. In one embodiment, the computer program may be a program which determines whether the nucleotide sequences of the cDNA codes of SEQ ID NOs. 24–3883 and 7744–19335 contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Another aspect of the present invention is a method for determining the level of homology between a polypeptide code of SEQ ID NOS. 3884–7743 and a reference polypeptide sequence, comprising the steps of reading the polypeptide code of SEQ ID NOS. 3884–7743 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of SEQ ID NOs. 24–3883 and 7744–19335 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above and the method illustrated in FIG. 8. The method may also be performed by reading at least 2, 5, 10, 15, 20, 25, 30, or 50 of the cDNA codes of SEQ ID NOs. 24–3883 and 7744–19335 and the reference nucleotide sequences through the use of the computer program and identifying differences between the cDNA codes and the reference nucleotide sequences with the computer program.

In other embodiments the computer based system may further comprise an identifier for identifying features within the nucleotide sequences of the cDNA codes of SEQ ID NOs. 24–3883 and 7744–19335 or the amino acid sequences of the polypeptide codes of SEQ ID NOS. 3884–7743.

An "identifier" refers to one or more programs which identifies certain features within the above-described nucleotide sequences of the cDNA codes of SEQ ID NOs. 24–3883 and 7744–19335 or the amino acid sequences of the polypeptide codes of SEQ ID NOS. 3884–7743. In one embodiment, the identifier may comprise a program which identifies an open reading frame in the cDNAs codes of SEQ ID NOs. 24–3883 and 7744–19335.

Figure 9:
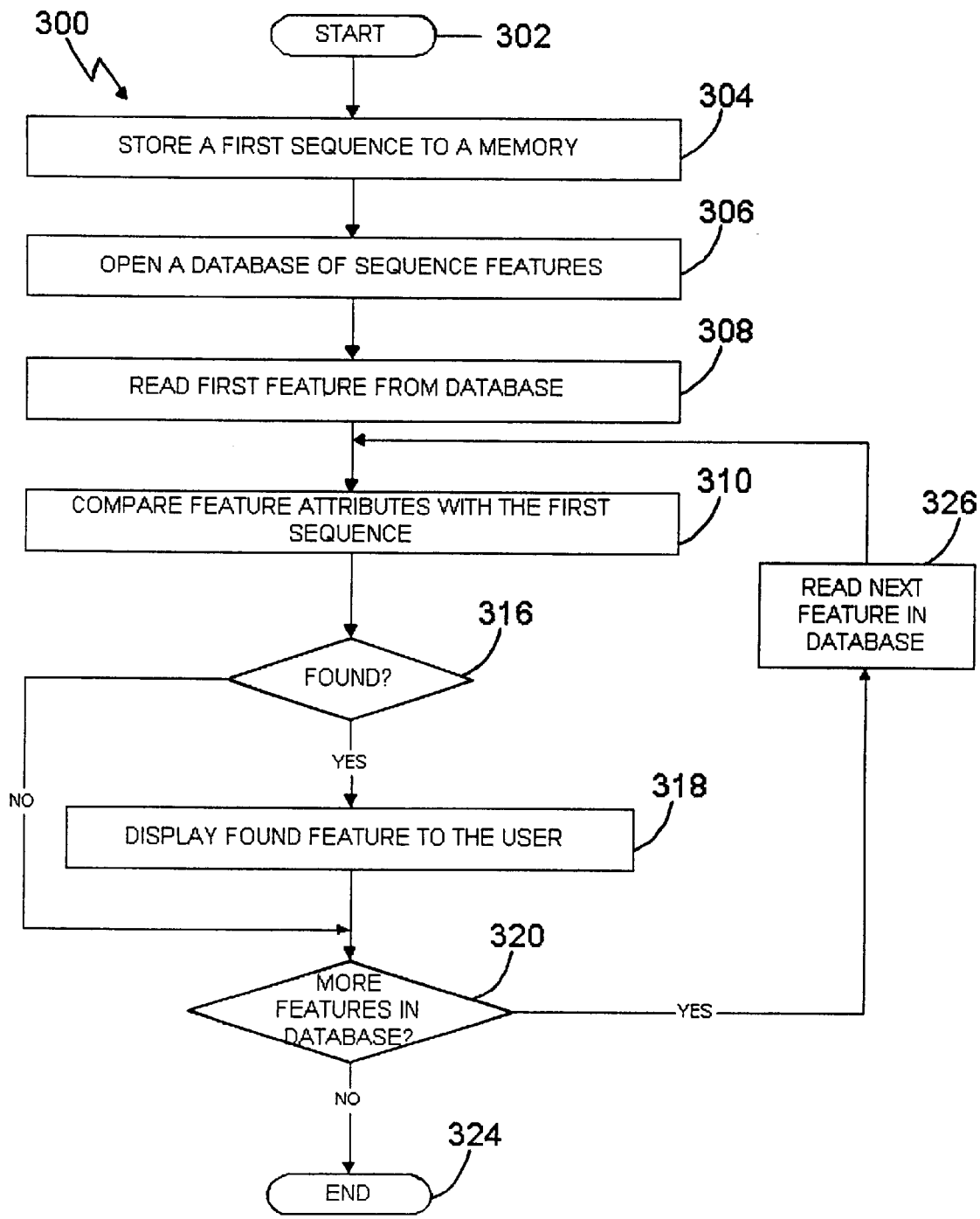
FIG. 9 is a flow diagram illustrating one embodiment of an identifier process 300 for detecting the presence of a feature in a sequence.

FIG. 9 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature+s attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (see Worldwide Website: gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

In another embodiment, the identifier may comprise a molecular modeling program which determines the 3-dimensional structure of the polypeptides codes of SEQ ID NOS. 3884–7743. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID NOS. 3884–7743. (See e.g., Srinivasan, et al., U.S. Pat. No. 5,557,535 issued Sept. 17, 1996). Conventional homology modeling techniques have been used routinely to build models of proteases and antibodies. (Sowdhamini et al., Protein Engineering 10:207, 215 (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into inter-residue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins:Structure, Function, and Genetics, Supplement 1:38–42 (1997)).

The results of the molecular modeling analysis may then be used in rational drug design techniques to identify agents which modulate the activity of the polypeptide codes of SEQ ID NOS. 3884–7743.

Accordingly, another aspect of the present invention is a method of identifying a feature within the cDNA codes of SEQ ID NOs. 24–3883 and 7744–19335 or the polypeptide codes of SEQ ID NOS. 3884–7743 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the cDNA codes of SEQ ID NOs. 24–3883 and 7744–19335 or the polypeptide codes of SEQ ID NOS. 3884–7743 through the use of the computer program and identifying features within the cDNA codes or polypeptide codes with the computer program.

The cDNA codes of SEQ ID NOs. 24–3883 and 7744–19335 or the polypeptide codes of SEQ ID NOS. 3884–7743 may be stored and manipulated in a variety of data processor programs in a variety of formats. For example, the cDNA codes of SEQ ID NOs. 24–3883 and 7744–19335 or the polypeptide codes of SEQ ID NOS. 3884–7743 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the cDNA codes of SEQ ID NOs. 24–3883 and 7744–19335 or the polypeptide codes of SEQ ID NOS. 3884–7743. The following list is intended not to limit the invention but to provide guidance to programs and databases which are useful with the cDNA codes of SEQ ID NOs. 24–3883 and 7744–19335 or the polypeptide codes of SEQ ID NOS. 3884–7743. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCB1), BLASTN and BLASTX (Altschul et al, *J. Mol. Biol.* 215: 403 (1990)), FASTA (Pearson and Lipman, *Proc. Natl. Acad. Sci. USA*, 85: 2444 (1988)), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

EXAMPLE 60

Methods of Making Nucleic Acids

The present invention also comprises methods of making the EST-related nucleic acids, fragments of EST-related nucleic acids, positional segments of the EST-related nucleic acids, or fragments of positional segments of the EST-related nucleic acids. The methods comprise sequentially linking together nucleotides to produce the nucleic acids having the preceding sequences. A variety of methods of synthesizing nucleic acids are known to those skilled in the art.

In many of these methods, synthesis is conducted on a solid support. These included the 3' phosphoramidite methods in which the 3' terminal base of the desired oligonucleotide is immobilized on an insoluble carrier. The nucleotide base to be added is blocked at the 5' hydroxyl and activated at the 3' hydroxyl so as to cause coupling with the immobilized nucleotide base. Deblocking of the new immobilized nucleotide compound and repetition of the cycle will produce the desired polynucleotide. Alternatively, polynucleotides may be prepared as described in U.S. Pat. No. 5,049,656, the disclosure of which is incorporated herein by reference. In some embodiments, several polynucleotides prepared as described above are ligated together to generate longer polynucleotides having a desired sequence.

EXAMPLE 61

Methods of Making Polypeptides

The present invention also comprises methods of making the polynucleotides encoded by EST-related nucleic acids, fragments of EST-related nucleic acids, positional segments of the EST-related nucleic acids, or fragments of positional segments of the EST-related nucleic acids and methods of making the EST-related polypeptides, fragments of EST-related polypeptides, positional segments of EST-related polypeptides, or fragments of EST-related polypeptides. The methods comprise sequentially linking together amino acids to produce the nucleic polypeptides having the preceding sequences. In some embodiments, the polypeptides made by these methods are 150 amino acid or less in length. In other embodiments, the polypeptides made by these methods are 120 amino acids or less in length.

A variety of methods of making polypeptides are known to those skilled in the art, including methods in which the carboxyl terminal amino acid is bound to polyvinyl benzene or another suitable resin. The amino acid to be added possesses blocking groups on its amino moiety and any side chain reactive groups so that only its carboxyl moiety can react. The carboxyl group is activated with carbodiimide or another activating agent and allowed to couple to the immobilized amino acid. After removal of the blocking group, the cycle is repeated to generate a polypeptide having the desired sequence. Alternatively, the methods described in U.S. Pat. No. 5,049,656, the disclosure of which is incorporated herein by reference, may be used.

As discussed above, the EST-related nucleic acids, fragments of the EST-related nucleic acids, positional segments of the EST-related nucleic acids, or fragments of positional segments of the EST-related nucleic acids can be used for various purposes. The polynucleotides can be used to express recombinant protein for analysis, characterization or therapeutic use; production of secreted polypeptides or chimeric polypeptides, antibody production, as markers for tissues in which the corresponding protein is preferentially expressed (either constitutively or at a particular stage of tissue differentiation or development or in disease states); as molecular weight markers on Southern gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; for selecting and making oligomers for attachment to a "gene chip" or other support, including for examination for expression patterns; to raise anti-protein antibodies using DNA immunization techniques; and as an antigen to raise anti-DNA antibodies or elicit another immune response. Where the polynucleotide encodes a protein or polypeptide which binds or potentially binds to another protein or polypeptide (such as, for example, in a receptor-ligand interaction), the polynucleotide can also be used in interaction trap assays (such as, for example, that described in Gyuris et al., Cell 75:791–803 (1993), the disclosure of which is hereby incorporated by reference) to identify polynucleotides encoding the other protein or polypeptide with which binding occurs or to identify inhibitors of the binding interaction.

The proteins or polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding protein is preferentially expressed (either constitutively or at a particular stage of tissue differentiation or development or in a disease state); and, of course, to isolate correlative receptors or ligands. Where the protein or polypeptide binds or potentially binds to another protein or polypeptide (such as, for example, in a receptor-ligand interaction), the protein can be used to identify the other protein with which binding occurs or to identify inhibitors of the binding interaction. Proteins or polypeptides involved in these binding interactions can also be used to screen for peptide or small molecule inhibitors or agonists of the binding interaction.

Any or all of these research utilities are capable of being developed into reagent grade or kit format for commercializationas research products.

Methods for performing the uses listed above are well known to those skilled in the art. References disclosing such methods include without limitation "Molecular Cloning; A Laboratory Manual", 2d ed., Cold Spring Harbor Laboratory Press, Sambrook, J., E. F. Fritsch and T. Maniatis eds., 1989, and "Methods in Enzymology; Guide to Molecular Cloning Techniques", Academic Press, Berger, S. L. and A. R. Kimmel eds., 1987.

Polynucleotides and proteins or polypeptides of the present invention can also be used as nutritional sources or supplements. Such uses include without limitation use as a protein or amino acid supplement, use as a carbon source, use as a nitrogen source and use as a source of carbohydrate. In such cases the protein or polynucleotide of the invention can be added to the feed of a particular organism or can be administered as a separate solid or liquid preparation, such as in the form of powder, pills, solutions, suspensions or capsules. In the case of microorganisms, the protein or polynucleotide of the invention can be added to the medium in or on which the microorganism is cultured.

Although this invention has been described in terms of certain preferred embodiments, other embodiments which will be apparent to those of ordinary skill in the art in view of the disclosure herein are also within the scope of this invention. Accordingly, the scope of the invention is intended to be defined only by reference to the appended claims. All documents cited herein are incorporated herein by reference in their entirety.

TABLE I (Positions of all ORFs)

| Seq Id No. | Positions of Open Reading Frame(s) | Seq Id No. | Positions of Open Reading Frame(s) |
|---|---|---|---|
| 24 | [109–342],[188–340] | 70 | [159–395],[317–472] |
| 25 | [63–365] | 71 | [143–328] |
| 26 | [73–555] | 72 | [65–487],[142–486] |
| 27 | [363–512] | 73 | [38–268] |
| 28 | [21–485] | 74 | [85–417] |
| 29 | [105–332] | 75 | [85–420] |
| 30 | [166–366] | 76 | [196–483],[248–484] |
| 31 | [52–504] | 77 | [171–434] |
| 32 | [107–517] | 78 | [26–190],[263–793] |
| 33 | [157–477] | 79 | [168–443] |
| 34 | [233–397] | 80 | [112–306],[153–308] |
| 35 | [60–482] | 81 | [147–323] |
| 36 | [284–454] | 82 | [21–569] |
| 37 | [35–481],[238–432] | 83 | [289–468] |
| 38 | [77–490] | 84 | [101–298],[295–459] |
| 39 | [107–676] | 85 | [255–419],[289–468] |
| 40 | [31–249] | 86 | [30–179],[300–515] |
| 41 | [81–440] | 87 | [221–673] |
| 42 | [23–424],[196–351] | 88 | [153–401] |
| 43 | [53–511] | 89 | [209–472] |
| 44 | [118–339] | 90 | [278–472] |
| 45 | [185–544] | 91 | [116–286],[355–570] |
| 46 | [9–482],[238–483] | 92 | [164–586] |
| 47 | [69–494] | 93 | [54–311] |
| 48 | [316–534] | 94 | [127–450] |
| 49 | [27–431] | 95 | [40–324] |
| 50 | [54–410] | 96 | [1–381],[24–263] |
| 51 | [164–463] | 97 | [227–670] |

TABLE I-continued (Positions of all ORFs)

| Seq Id No. | Positions of Open Reading Frame(s) | Seq Id No. | Positions of Open Reading Frame(s) |
|---|---|---|---|
| 52 | [94–546] | 98 | [76–450],[99–281] |
| 53 | [74–481] | 99 | [117–482] |
| 54 | [27–503] | 100 | [34–498] |
| 55 | [260–544] | 101 | [76–504],[95–250] |
| 56 | [297–506] | 102 | [72–248] |
| 57 | [27–479] | 103 | [113–349] |
| 58 | [163–390] | 104 | [72–356] |
| 59 | [85–273] | 105 | [73–276] |
| 60 | [85–273] | 106 | [167–487] |
| 61 | [31–273] | 107 | [257–490] |
| 62 | [46–255] | 108 | [274–453] |
| 63 | [154–342] | 109 | [144–500],[331–498] |
| 64 | [34–276] | 110 | [195–569] |
| 65 | [5–172] | 111 | [33–269],[116–583] |
| 66 | [144–479] | 112 | [153–416] |
| 67 | [233–478] | 113 | [14–400] |
| 68 | [115–321] | 114 | [9–524] |
| 69 | [72–443] | 115 | [258–479] |
| 116 | [223–495] | 162 | [32–721] |
| 117 | [206–622] | 163 | [298–495] |
| 118 | [344–496] | 164 | [306–491] |
| 119 | [290–541] | 165 | [45–593] |
| 120 | [86–451] | 166 | [156–308],[161–499] |
| 121 | [100–465] | 167 | [297–479] |
| 122 | [13–213] | 168 | [233–562],[270–515],[280–498] |
| 123 | [93–371],[202–465] | | |
| 124 | [195–488] | 169 | [164–490],[318–488] |
| 125 | [201–491] | 170 | [250–540] |
| 126 | [144–488] | 171 | [127–528] |
| 127 | [44–463] | 172 | [242–448] |
| 128 | [131–553] | 173 | [96–599] |
| 129 | [88–465],[153–410] | 174 | [239–514],[306–461] |
| 130 | [61–456] | 175 | [80–313],[96–458] |
| 131 | [194–391] | 176 | [140–499],[261–431] |
| 132 | [124–477] | 177 | [74–508] |
| 133 | [7–306],[89–289],[129–308] | 178 | [90–542] |
| 134 | [222–422] | 179 | [110–301] |
| 135 | [142–570] | 180 | [44–502] |
| 136 | [59–415],[265–414] | 181 | [293–454],[309–542] |
| 137 | [39–500] | 182 | [35–205],[150–509] |
| 138 | [143–493] | 183 | [198–500] |
| 139 | [259–645] | 184 | [202–465] |
| 140 | [236–496] | 185 | [274–561] |
| 141 | [292–456] | 186 | [229–483] |
| 142 | [54–488] | 187 | [202–519] |
| 143 | [62–217] | 188 | [148–330] |
| 144 | [6–290],[265–522] | 189 | [86–262] |
| 145 | [112–513] | 190 | [110–550] |
| 146 | [152–523] | 191 | [223–405] |
| 147 | [276–437] | 192 | [35–247] |
| 148 | [72–263] | 193 | [148–324] |
| 149 | [221–499] | 194 | [154–333] |
| 150 | [88–318] | 195 | [148–336] |
| 151 | [293–511] | 196 | [182–490] |
| 152 | [71–496] | 197 | [177–482] |
| 153 | [112–501] | 198 | [86–415],[304–471] |
| 154 | [19–225] | 199 | [72–521] |
| 155 | [354–542] | 200 | [362–829] |
| 156 | [21–209] | 201 | [290–475] |
| 157 | [303–473] | 202 | [346–522] |
| 158 | [198–587] | 203 | [272–451] |
| 159 | [55–531] | 204 | [6–503] |
| 160 | [4–507] | 205 | [73–276] |
| 161 | [8–307] | 206 | [298–699] |
| 208 | [211–483],[306–485] | 207 | [213–497] |
| 209 | [69–458] | 254 | [272–478] |
| 210 | [8–559] | 255 | [41–325] |
| 211 | [167–481] | 256 | [97–474] |
| 212 | [21–452] | 257 | [127–504] |
| 213 | [286–471] | 258 | [36–446],[289–447] |
| 214 | [214–444] | 259 | [172–432],[218–400] |
| 215 | [236–451] | 260 | [89–466] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 216 | [183–470] | 261 | [89–508] | 332 | [303–494] | 378 | [96–284] |
| 217 | [78–461] | 262 | [78–476] | 333 | [3–161],[272–496] | 379 | [21–320],[323–496] |
| 218 | [187–468] | 263 | [103–501] | 334 | [174–461] | 380 | [110–493] |
| 219 | [187–468] | 264 | [217–570] | 335 | [303–473] | 381 | [242–529],[297–530], [328–528] |
| 220 | [330–479] | 265 | [233–496] | 336 | [319–471] | | |
| 221 | [142–363],[198–362] | 266 | [357–551] | 337 | [196–501],[279–638] | 382 | [15–299],[139–300] |
| 222 | [178–483] | 267 | [221–481] | 338 | [292–561],[338–535] | 383 | [15–569],[92–328] |
| 223 | [55–213],[318–488] | 268 | [112–597] | 339 | [180–428] | 384 | [153–479] |
| 224 | [97–492] | 269 | [254–466] | 340 | [30–509] | 385 | [233–421] |
| 225 | [142–315],[315–563] | 270 | [4–171] | 341 | [116–487] | 386 | [125–496] |
| 226 | [19–210],[306–497] | 271 | [222–737] | 342 | [68–460],[82–279] | 387 | [290–496] |
| 227 | [130–372],[252–524], [302–523] | 272 | [330–479] | 343 | [1–450] | 388 | [57–473] |
| | | 273 | [15–449],[263–427] | 344 | [86–478] | 389 | [136–318] |
| 228 | [89–283] | 274 | [71–472] | 345 | [34–285],[152–472] | 390 | [71–490] |
| 229 | [97–450],[216–422], [242–415] | 275 | [43–540] | 392 | [38–307] | 391 | [35–457] |
| | | 276 | [175–468] | 393 | [186–347] | 438 | [153–341] |
| 230 | [83–304] | 277 | [204–482] | 394 | [50–502] | 439 | [255–428] |
| 231 | [111–350] | 278 | [35–472] | 395 | [8–409],[73–306] | 440 | [138–536] |
| 232 | [97–522],[215–385] | 279 | [261–509] | 396 | [32–205],[208–450] | 441 | [149–358] |
| 233 | [85–252] | 280 | [158–313],[186–398], [286–498] | 397 | [107–442] | 442 | [329–502] |
| 234 | [146–403] | | | 398 | [65–370],[370–573] | 443 | [91–465] |
| 235 | [182–592] | 281 | [104–442],[178–471] | 399 | [139–369] | 444 | [215–454],[285–464] |
| 236 | [214–399] | 282 | [34–489] | 400 | [225–455] | 445 | [141–503] |
| 237 | [145–480],[258–476] | 283 | [23–478] | 401 | [185–481] | 446 | [56–475],[258–407] |
| 238 | [118–663] | 284 | [171–488] | 402 | [11–286],[31–180] | 447 | [49–504] |
| 239 | [114–539],[229–432] | 285 | [166–465] | 403 | [67–216] | 448 | [95–493] |
| 240 | [98–559] | 286 | [176–451] | 404 | [193–417] | 449 | [51–368],[299–502] |
| 241 | [131–478] | 287 | [63–254],[104–607], [261–410] | 405 | [18–434] | 450 | [20–460] |
| 242 | [30–515] | | | 406 | [104–448] | 451 | [6–506] |
| 243 | [167–556] | 288 | [24–296] | 407 | [226–510] | 452 | [154–480] |
| 244 | [258–476] | 289 | [140–502] | 408 | [227–433] | 453 | [265–510] |
| 245 | [27–470],[155–466] | 290 | [17–385] | 409 | [185–484] | 454 | [337–492] |
| 246 | [65–451] | 291 | [94–498],[116–319] | 410 | [37–237] | 455 | [176–592] |
| 247 | [94–456] | 292 | [518–670] | 411 | [223–480],[276–482] | 456 | [99–482] |
| 248 | [266–472] | 293 | [139–510] | 412 | [331–480] | 457 | [242–463] |
| 249 | [13–321],[50–322] | 294 | [330–488] | 413 | [96–419] | 458 | [119–376] |
| 250 | [60–548] | 295 | [107–322] | 414 | [188–463] | 459 | [144–515] |
| 251 | [118–453] | 296 | [40–201] | 415 | [37–219] | 460 | [197–475] |
| 252 | [22–576] | 297 | [247–495] | 416 | [66–458] | 461 | [303–527] |
| 253 | [36–671] | 298 | [220–492] | 417 | [297–473] | 462 | [89–283] |
| 300 | [9–248] | 299 | [4–222],[267–476] | 418 | [223–507] | 463 | [161–457] |
| 301 | [221–487] | 346 | [197–535] | 419 | [1–171] | 464 | [37–186] |
| 302 | [170–481] | 347 | [22–486] | 420 | [8–505] | 465 | [239–460] |
| 303 | [264–494] | 348 | [51–470] | 421 | [323–502] | 466 | [223–495] |
| 304 | [136–378],[233–622] | 349 | [15–563],[331–498] | 422 | [28–270] | 467 | [192–479] |
| 305 | [74–520],[291–476] | 350 | [199–492] | 423 | [51–314],[56–226] | 468 | [125–490] |
| 306 | [109–498] | 351 | [251–520] | 424 | [54–212] | 469 | [40–387],[161–376] |
| 307 | [38–487] | 352 | [28–489] | 425 | [176–406] | 470 | [197–478] |
| 308 | [28–495] | 353 | [70–360],[164–490] | 426 | [105–323] | 471 | [81–467] |
| 309 | [28–483] | 354 | [76–363] | 427 | [329–478] | 472 | [170–526] |
| 310 | [142–465] | 355 | [23–232],[69–233] | 428 | [318–497] | 473 | [87–548] |
| 311 | [201–434] | 356 | [206–520] | 429 | [67–309] | 474 | [26–301] |
| 312 | [339–491] | 357 | [6–485],[121–288] | 430 | [286–468] | 475 | [10–168] |
| 313 | [180–569],[281–535] | 358 | [80–274],[250–468] | 431 | [278–463] | 476 | [177–470] |
| 314 | [99–386] | 359 | [42–332] | 432 | [167–493] | 477 | [71–250] |
| 315 | [323–481] | 360 | [117–413] | 433 | [174–413] | 478 | [248–472] |
| 316 | [171–476],[268–432], [296–463] | 361 | [81–737],[421–588] | 434 | [104–322],[138–290] | 479 | [110–508] |
| | | 362 | [110–469] | 435 | [386–547] | 480 | [356–505] |
| 317 | [66–458] | 363 | [271–450] | 436 | [184–492] | 481 | [188–352] |
| 318 | [67–555],[129–464] | 364 | [79–486] | 437 | [78–455] | 482 | [20–286] |
| 319 | [92–586] | 365 | [432–596] | 484 | [91–243] | 483 | [18–449],[193–387] |
| 320 | [32–319],[304–489] | 366 | [80–274],[250–453] | 485 | [228–482] | 530 | [209–472] |
| 321 | [303–473] | 367 | [21–494] | 486 | [149–382] | 531 | [17–178],[306–467] |
| 322 | [304–462] | 368 | [229–411] | 487 | [164–370] | 532 | [104–487] |
| 323 | [302–472] | 369 | [53–226],[243–482] | 488 | [24–266] | 533 | [331–489] |
| 324 | [242–496] | 370 | [277–513] | 489 | [1–282] | 534 | [7–192] |
| 325 | [355–519] | 371 | [62–436] | 490 | [273–458],[277–456] | 535 | [105–395] |
| 326 | [303–479] | 372 | [204–392] | 491 | [299–457] | 536 | [248–502] |
| 327 | [136–291] | 373 | [276–473] | 492 | [125–484],[237–461] | 537 | [232–501] |
| 328 | [320–514] | 374 | [156–317] | 493 | [244–450] | 538 | [43–225] |
| 329 | [303–512] | 375 | [265–429] | 494 | [121–294] | 539 | [177–401] |
| 330 | [166–342],[224–541] | 376 | [100–522] | 495 | [217–486] | 540 | [272–472] |
| 331 | [303–473] | 377 | [95–457] | 496 | [65–268],[291–467] | 541 | [20–451] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 497 | [189–479] | 542 | [185–505],[324–506] | 615 | [188–487],[324–488] | | [300–458] |
| 498 | [127–294] | 543 | [260–469] | 616 | [303–479] | 661 | [55–210],[197–451] |
| 499 | [143–421] | 544 | [211–372],[291–488] | 617 | [148–492] | 662 | [27–485] |
| 500 | [184–459] | 545 | [282–467] | 618 | [121–357] | 663 | [308–457] |
| 501 | [312–506] | 546 | [10–198],[228–452] | 619 | [121–360] | 664 | [1–153],[199–354], [264–533] |
| 502 | [109–426] | 547 | [155–484] | 620 | [121–309] | | |
| 503 | [263–481] | 548 | [344–526] | 621 | [123–278] | 665 | [43–363],[249–488] |
| 504 | [12–314],[190–489] | 549 | [251–484] | 668 | [177–497] | 666 | [324–539] |
| 505 | [7–315],[147–500] | 550 | [71–283],[283–456] | 669 | [9–539] | 667 | [20–490],[42–257] |
| 506 | [52–456] | 551 | [154–525] | 670 | [280–495] | 714 | [116–532],[361–534] |
| 507 | [334–501] | 552 | [177–458] | 671 | [33–269],[116–505] | 715 | [336–524] |
| 508 | [271–471] | 553 | [287–511],[363–512] | 672 | [32–286],[303–491] | 716 | [178–453] |
| 509 | [272–469] | 554 | [130–462] | 673 | [236–463] | 717 | [290–451] |
| 510 | [106–486] | 555 | [36–230] | 674 | [27–467] | 718 | [305–493] |
| 511 | [25–204] | 556 | [287–490] | 675 | [279–491] | 719 | [116–490] |
| 512 | [130–318] | 557 | [164–472],[315–473] | 676 | [247–429] | 720 | [97–468] |
| 513 | [135–317],[169–468], [320–469] | 558 | [252–470] | 677 | [95–496] | 721 | [205–483] |
| | | 559 | [216–383] | 678 | [204–473] | 722 | [265–558] |
| 514 | [259–453] | 560 | [293–469] | 679 | [9–209],[209–451] | 723 | [94–276],[315–497] |
| 515 | [296–478] | 561 | [91–504] | 680 | [229–459] | 724 | [56–238],[277–468] |
| 516 | [88–495] | 562 | [222–488] | 681 | [13–399] | 725 | [257–529] |
| 517 | [226–477] | 563 | [151–468] | 682 | [267–506] | 726 | [256–501] |
| 518 | [267–458] | 564 | [166–345],[297–479] | 683 | [109–534] | 727 | [157–396] |
| 519 | [24–560],[184–390] | 565 | [166–345],[297–491] | 684 | [106–306] | 728 | [96–476],[149–376] |
| 520 | [93–464] | 566 | [74–508] | 685 | [298–450] | 729 | [243–470] |
| 521 | [290–478] | 567 | [94–477] | 686 | [262–495] | 730 | [132–512] |
| 522 | [94–276] | 568 | [308–466] | 687 | [44–496] | 731 | [198–518] |
| 523 | [105–416],[238–417] | 569 | [135–374] | 688 | [264–497] | 732 | [136–378] |
| 524 | [288–464] | 570 | [307–486] | 689 | [15–467],[205–366] | 733 | [189–380] |
| 525 | [1–468] | 571 | [176–601] | 690 | [33–521] | 734 | [129–278] |
| 526 | [157–459] | 572 | [99–251] | 691 | [263–472] | 735 | [313–489],[341–490] |
| 527 | [71–481] | 573 | [343–495] | 692 | [255–503] | 736 | [110–304],[304–495] |
| 528 | [207–455] | 574 | [133–495],[321–494] | 693 | [269–457] | 737 | [310–474] |
| 529 | [4–204],[242–493] | 575 | [51–449] | 694 | [100–540] | 738 | [311–496] |
| 576 | [149–451] | 622 | [214–474] | 695 | [177–338] | 739 | [228–515] |
| 577 | [130–507],[236–505] | 623 | [241–411] | 696 | [21–170] | 740 | [229–453] |
| 578 | [195–641] | 624 | [50–448] | 697 | [100–279],[289–558] | 741 | [237–461] |
| 579 | [191–508],[273–485] | 625 | [140–292],[401–550] | 698 | [104–433] | 742 | [79–501] |
| 580 | [188–412] | 626 | [203–463] | 699 | [4–210],[242–517] | 743 | [31–327] |
| 581 | [43–480] | 627 | [168–380],[380–580] | 700 | [139–387] | 744 | [89–448],[156–365] |
| 582 | [216–509] | 628 | [282–479] | 701 | [161–310],[310–486] | 745 | [290–472] |
| 583 | [121–456] | 629 | [174–476] | 702 | [64–480] | 746 | [217–519],[326–505] |
| 584 | [226–537] | 630 | [422–607] | 703 | [9–494],[113–268] | 747 | [91–474],[200–379] |
| 585 | [202–513] | 631 | [255–458] | 704 | [289–492] | 748 | [91–471],[200–379] |
| 586 | [196–531] | 632 | [212–502] | 705 | [128–304],[163–477] | 749 | [91–453],[200–379] |
| 587 | [67–327] | 633 | [326–484] | 706 | [228–671] | 750 | [91–459],[200–379] |
| 588 | [183–491],[221–454] | 634 | [13–462] | 707 | [147–401] | 751 | [91–477],[200–379] |
| 589 | [258–734] | 635 | [292–492] | 708 | [44–499] | 752 | [6–377],[19–183], [226–375] |
| 590 | [192–344],[280–450] | 636 | [84–479] | | | | |
| 591 | [138–521],[229–390] | 637 | [147–305],[152–448] | 709 | [213–398] | 753 | [28–180] |
| 592 | [211–468] | 638 | [147–344] | 710 | [28–471] | 754 | [43–486] |
| 593 | [72–233] | 639 | [202–468] | 711 | [211–369] | 755 | [236–499] |
| 594 | [68–238] | 640 | [109–426] | 712 | [305–484] | 756 | [6–305],[125–307] |
| 595 | [199–372] | 641 | [91–306],[273–458] | 713 | [193–489] | 757 | [36–494] |
| 596 | [300–458] | 642 | [246–497],[265–495] | 760 | [68–466] | 758 | [136–390] |
| 597 | [157–459] | 643 | [119–271] | 761 | [100–351] | 759 | [211–366] |
| 598 | [64–498] | 644 | [170–352] | 762 | [75–326],[151–324] | 806 | [59–508] |
| 599 | [335–520] | 645 | [11–166],[297–545] | 763 | [36–386],[196–378] | 807 | [280–474] |
| 600 | [79–504] | 646 | [175–336] | 764 | [303–470] | 808 | [225–491] |
| 601 | [14–169] | 647 | [124–366] | 765 | [141–455],[248–406] | 809 | [131–376] |
| 602 | [40–246] | 648 | [161–481],[333–482] | 766 | [149–490] | 810 | [104–388] |
| 603 | [257–529] | 649 | [166–510] | 767 | [159–518] | 811 | [252–518] |
| 604 | [205–477] | 650 | [308–487] | 768 | [263–544] | 812 | [92–256] |
| 605 | [14–271],[154–453] | 651 | [120–509] | 769 | [68–538] | 813 | [12–191],[34–189] |
| 606 | [93–326] | 652 | [273–488] | 770 | [138–476] | 814 | [223–483] |
| 607 | [279–521] | 653 | [153–314],[325–519] | 771 | [330–506] | 815 | [209–541] |
| 608 | [105–383] | 654 | [107–343] | 772 | [151–375],[176–337] | 816 | [269–478],[319–480] |
| 609 | [256–417] | 655 | [99–506] | 773 | [153–497] | 817 | [32–220],[99–356], [298–507] |
| 610 | [142–414],[251–415] | 656 | [244–486] | 774 | [342–497] | | |
| 611 | [133–459] | 657 | [51–509] | 775 | [192–497],[247–498] | 818 | [60–212],[263–526] |
| 612 | [96–338] | 658 | [78–551] | 776 | [255–485],[310–459] | 819 | [60–212],[263–526] |
| 613 | [145–333],[218–511] | 659 | [57–263] | 777 | [99–746],[493–726] | 820 | [89–331] |
| 614 | [187–504],[347–505] | 660 | [43–234],[286–459], | 778 | [91–588] | 821 | [36–407] |

TABLE I-continued

(Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 779 | [78–470] | 822 | [212–376] | 944 | [38–529] | 940 | [228–539] |
| 780 | [131–703] | 823 | [376–534] | 945 | [213–605] | 941 | [224–556] |
| 781 | [196–501],[251–412] | 824 | [78–350] | 946 | [219–488] | 942 | [37–477],[179–427] |
| 782 | [312–485] | 825 | [44–325],[147–326] | 947 | [94–285] | 943 | [158–313],[217–474] |
| 783 | [352–516] | 826 | [313–465] | 948 | [43–345] | 990 | [150–458] |
| 784 | [291–467] | 827 | [218–418] | 949 | [238–555] | 991 | [214–549] |
| 785 | [351–515] | 828 | [58–315] | 950 | [64–351],[195–353] | 992 | [94–549] |
| 786 | [248–514] | 829 | [331–480] | 951 | [213–515] | 993 | [208–564] |
| 787 | [76–474] | 830 | [340–501] | 952 | [141–506] | 994 | [85–531] |
| 788 | [306–617],[337–537] | 831 | [75–227] | 953 | [195–464] | 995 | [72–227] |
| 789 | [212–376] | 832 | [39–317],[104–289],[265–492] | 954 | [99–476],[185–409] | 996 | [229–417] |
| 790 | [53–493] | | | 955 | [149–505] | 997 | [54–218] |
| 791 | [242–391],[273–464] | 833 | [125–301],[304–495] | 956 | [202–438] | 998 | [180–353],[307–474] |
| 792 | [206–484] | 834 | [489–650] | 957 | [1–207],[395–628] | 999 | [139–357] |
| 793 | [244–492] | 835 | [21–257] | 958 | [183–524] | 1000 | [38–319] |
| 794 | [24–452] | 836 | [195–485] | 959 | [209–496],[249–446] | 1001 | [29–490],[153–449] |
| 795 | [68–310],[352–546] | 837 | [149–301] | 960 | [195–500] | 1002 | [128–583] |
| 796 | [113–487] | 838 | [2–223] | 961 | [188–523] | 1003 | [188–520] |
| 797 | [182–496] | 839 | [7–228],[164–535] | 962 | [70–444],[108–443],[245–421] | 1004 | [218–490] |
| 798 | [279–476] | 840 | [54–509] | | | 1005 | [196–450],[242–433] |
| 799 | [24–452] | 841 | [61–342] | 963 | [122–334] | 1006 | [217–474] |
| 800 | [124–576] | 842 | [105–512] | 964 | [184–456] | 1007 | [201–458],[247–396] |
| 801 | [20–193],[42–194] | 843 | [80–535] | 965 | [12–203],[288–497] | 1008 | [201–443],[247–396] |
| 802 | [191–442] | 844 | [286–525] | 966 | [128–310] | 1009 | [185–424],[231–380] |
| 803 | [21–284],[233–466] | 845 | [52–459] | 967 | [13–180] | 1010 | [168–506],[214–363] |
| 804 | [21–446] | 846 | [315–503] | 968 | [215–547] | 1011 | [201–467],[247–396] |
| 805 | [271–483] | 847 | [35–469] | 969 | [230–493] | 1012 | [201–428],[247–396] |
| 852 | [148–363],[324–473] | 848 | [41–484] | 970 | [247–459] | 1013 | [172–492],[218–367] |
| 853 | [244–546] | 849 | [217–387],[258–518] | 971 | [29–229],[240–452],[248–490] | 1014 | [201–533],[247–396] |
| 854 | [35–229],[126–497] | 850 | [275–475] | | | 1015 | [201–428],[247–396] |
| 855 | [131–280],[175–483] | 851 | [116–490] | 972 | [131–469] | 1016 | [159–413],[205–354] |
| 856 | [139–471] | 898 | [11–307],[208–453] | 973 | [214–471] | 1017 | [159–428],[205–354] |
| 857 | [261–500] | 899 | [116–496] | 974 | [83–280] | 1018 | [176–508],[222–371] |
| 858 | [176–514] | 900 | [69–422] | 975 | [171–320] | 1019 | [159–515],[205–354] |
| 859 | [228–479] | 901 | [69–359] | 976 | [101–478] | 1020 | [201–506],[247–396] |
| 860 | [273–506] | 902 | [68–496],[114–284] | 977 | [1–174],[180–329],[281–514] | 1021 | [207–410],[253–402] |
| 861 | [226–534],[348–533] | 903 | [31–363] | | | 1022 | [172–486],[218–367] |
| 862 | [31–504] | 904 | [42–539] | 978 | [278–493] | 1023 | [171–479],[217–366] |
| 863 | [17–403] | 905 | [213–368] | 979 | [67–459] | 1024 | [169–441],[215–364] |
| 864 | [171–482] | 906 | [24–485] | 980 | [254–481] | 1025 | [201–440],[247–396] |
| 865 | [156–557],[266–544] | 907 | [271–462] | 981 | [350–502] | 1026 | [173–463],[219–368] |
| 866 | [388–537] | 908 | [242–469] | 982 | [119–388] | 1027 | [159–524],[205–354] |
| 867 | [288–494] | 909 | [147–707] | 983 | [131–412] | 1028 | [211–381],[218–367] |
| 868 | [288–491] | 910 | [147–602] | 984 | [71–538] | 1029 | [172–477],[218–367] |
| 869 | [85–351] | 911 | [22–216],[270–452] | 985 | [227–481],[255–425],[283–480] | 1030 | [130–474] |
| 870 | [279–515] | 912 | [7–171] | | | 1031 | [129–554] |
| 871 | [305–466] | 913 | [157–411],[200–412] | 986 | [290–487] | 1032 | [152–385],[376–537] |
| 872 | [154–348] | 914 | [77–400] | 987 | [32–427] | 1033 | [140–424] |
| 873 | [160–387],[387–542] | 915 | [55–243],[86–244] | 988 | [135–314],[185–490] | 1034 | [134–460] |
| 874 | [133–489] | 916 | [285–491] | 989 | [206–508] | 1035 | [97–453] |
| 875 | [211–369] | 917 | [75–272] | 1036 | [260–445] | 1082 | [131–478] |
| 876 | [314–550] | 918 | [46–462] | 1037 | [289–450] | 1083 | [216–488] |
| 877 | [56–244] | 919 | [46–516] | 1038 | [11–298],[178–453] | 1084 | [193–417] |
| 878 | [312–473] | 920 | [178–354] | 1039 | [133–291] | 1085 | [189–491] |
| 879 | [234–485] | 921 | [79–525] | 1040 | [53–520],[129–398] | 1086 | [192–413] |
| 880 | [83–463] | 922 | [83–478] | 1041 | [250–453] | 1087 | [211–480] |
| 881 | [152–334],[394–711] | 923 | [31–474],[290–472] | 1042 | [44–478] | 1088 | [69–254] |
| 882 | [220–489] | 924 | [252–434] | 1043 | [39–221],[363–530] | 1089 | [153–581] |
| 883 | [90–542] | 925 | [725–898] | 1044 | [327–515] | 1090 | [98–346] |
| 884 | [170–346] | 926 | [130–522] | 1045 | [82–471] | 1091 | [344–625] |
| 885 | [232–483] | 927 | [113–358] | 1046 | [82–354] | 1092 | [252–482] |
| 886 | [261–497] | 928 | [303–512] | 1047 | [24–176] | 1093 | [221–493] |
| 887 | [231–455] | 929 | [166–546] | 1048 | [78–494] | 1094 | [141–512] |
| 888 | [117–452] | 930 | [222–485] | 1049 | [94–468] | 1095 | [337–519] |
| 889 | [158–487] | 931 | [112–456] | 1050 | [229–531] | 1096 | [56–439] |
| 890 | [163–525] | 932 | [54–527] | 1051 | [363–515] | 1097 | [190–549] |
| 891 | [88–408] | 933 | [205–501] | 1052 | [13–273],[116–274],[120–272] | 1098 | [272–517],[336–515] |
| 892 | [21–266],[304–516] | 934 | [31–339] | | | 1099 | [104–484],[270–455] |
| 893 | [125–478],[169–384] | 935 | [76–402] | 1053 | [171–515] | 1100 | [191–463] |
| 894 | [140–547] | 936 | [108–503] | 1054 | [119–316],[268–456] | 1101 | [303–482] |
| 895 | [224–499] | 937 | [274–600] | 1055 | [21–242] | 1102 | [10–234] |
| 896 | [24–323] | 938 | [140–493] | 1056 | [98–484] | 1103 | [84–251] |
| 897 | [165–467] | 939 | [228–521] | 1057 | [219–422] | 1104 | [69–485],[127–471] |

TABLE I-continued (Positions of all ORFs)

| Seq Id No. | Positions of Open Reading Frame(s) | Seq Id No. | Positions of Open Reading Frame(s) |
|---|---|---|---|
| 1058 | [59–448] | 1105 | [191–514] |
| 1059 | [366–566] | 1106 | [303–491] |
| 1060 | [13–450],[209–361] | 1107 | [117–491] |
| 1061 | [95–418] | 1108 | [341–526] |
| 1062 | [98–400] | 1109 | [207–482] |
| 1063 | [98–466] | 1110 | [341–523] |
| 1064 | [100–555] | 1111 | [137–349] |
| 1065 | [145–486] | 1112 | [96–257] |
| 1066 | [97–315] | 1113 | [96–482] |
| 1067 | [98–481] | 1114 | [116–331] |
| 1068 | [98–379] | 1115 | [10–261] |
| 1069 | [98–505] | 1116 | [204–365] |
| 1070 | [98–493] | 1117 | [341–523] |
| 1071 | [362–529] | 1118 | [218–406] |
| 1072 | [180–395] | 1119 | [37–246] |
| 1073 | [118–327] | 1120 | [35–238],[163–615] |
| 1074 | [140–562],[378–551] | 1121 | [116–283] |
| 1075 | [239–490] | 1122 | [386–559] |
| 1076 | [96–479],[196–357] | 1123 | [69–398] |
| 1077 | [59–262],[346–519] | 1124 | [324–551] |
| 1078 | [224–397],[250–480] | 1125 | [9–161],[179–484] |
| 1079 | [308–538] | 1126 | [381–533] |
| 1080 | [30–254],[286–507] | 1127 | [65–223] |
| 1081 | [262–444] | 1174 | [71–313],[274–498] |
| 1128 | [316–501] | 1175 | [191–505] |
| 1129 | [214–426] | 1176 | [361–510] |
| 1130 | [52–258] | 1177 | [351–530] |
| 1131 | [99–470] | 1178 | [108–524] |
| 1132 | [270–527] | 1179 | [351–914],[397–567] |
| 1133 | [178–348] | 1180 | [156–326],[194–556] |
| 1134 | [191–505] | 1181 | [104–691] |
| 1135 | [157–564] | 1182 | [108–566] |
| 1136 | [138–287],[296–520] | 1183 | [31–435] |
| 1137 | [93–524] | 1184 | [334–486] |
| 1138 | [42–356] | 1185 | [75–599] |
| 1139 | [322–609] | 1186 | [161–391],[279–548],[358–534] |
| 1140 | [203–478] | 1187 | [36–509],[205–462] |
| 1141 | [283–492] | 1188 | [277–471] |
| 1142 | [36–392],[196–393] | 1189 | [290–472],[315–470] |
| 1143 | [66–509] | 1190 | [32–535] |
| 1144 | [94–468] | 1191 | [294–476] |
| 1145 | [71–238] | 1192 | [53–205],[331–552] |
| 1146 | [27–341] | 1193 | [290–574] |
| 1147 | [265–528] | 1194 | [65–469] |
| 1148 | [86–481] | 1195 | [22–174],[128–478],[289–450] |
| 1149 | [39–503] | 1196 | [86–553] |
| 1150 | [218–517] | 1197 | [51–482],[163–366] |
| 1151 | [137–529] | 1198 | [92–460] |
| 1152 | [191–370] | 1199 | [138–467] |
| 1153 | [136–450] | 1200 | [106–270],[171–485] |
| 1154 | [70–453] | 1201 | [24–206] |
| 1155 | [253–459] | 1202 | [343–510] |
| 1156 | [147–494] | 1203 | [91–333],[287–496],[360–749] |
| 1157 | [272–556] | 1204 | [106–348],[302–511],[375–533] |
| 1158 | [182–457] | 1205 | [288–452] |
| 1159 | [280–480] | 1206 | [188–463] |
| 1160 | [323–535] | 1207 | [15–506],[70–279] |
| 1161 | [339–506] | 1208 | [157–456] |
| 1162 | [338–499] | 1209 | [157–486] |
| 1163 | [338–487] | 1210 | [273–599] |
| 1164 | [342–491] | 1211 | [372–560] |
| 1165 | [299–475] | 1212 | [267–452] |
| 1166 | [339–488] | 1213 | [145–402] |
| 1167 | [337–492] | 1214 | [373–549] |
| 1168 | [118–321] | 1215 | [17–223],[22–522],[249–485] |
| 1169 | [14–457],[282–458] | 1216 | [104–505] |
| 1170 | [255–404],[353–517] | 1217 | [199–348] |
| 1171 | [204–455] | 1218 | [267–455] |
| 1172 | [151–564] | 1222 | [274–459],[278–448] |
| 1173 | [23–469] | 1223 | [262–462] |
| 1220 | [268–453],[272–442] | 1224 | [261–458] |
| 1221 | [27–485] | 1225 | [182–346] |
| 1219 | [267–452] | 1226 | [51–200] |
| 1266 | [157–306] | 1227 | [262–456] |
| 1267 | [291–515] | 1228 | [178–594] |
| 1268 | [189–611] | 1229 | [109–579] |
| 1269 | [84–542] | 1230 | [103–504] |
| 1270 | [154–495] | 1231 | [62–517],[192–350] |
| 1271 | [132–287],[378–530] | 1232 | [155–316] |
| 1272 | [193–474] | 1233 | [13–270],[270–473] |
| 1273 | [41–433] | 1234 | [57–488] |
| 1274 | [33–227] | 1235 | [141–317] |
| 1275 | [205–519] | 1236 | [114–485] |
| 1276 | [130–540] | 1237 | [75–455] |
| 1277 | [102–494] | 1238 | [74–223],[105–536] |
| 1278 | [134–487] | 1239 | [29–466] |
| 1279 | [28–222],[238–480],[330–482] | 1240 | [307–567] |
| 1280 | [358–603] | 1241 | [73–246] |
| 1281 | [306–491] | 1242 | [250–408] |
| 1282 | [114–512] | 1243 | [261–539] |
| 1283 | [276–518] | 1244 | [309–563] |
| 1284 | [4–474] | 1245 | [293–544] |
| 1285 | [94–246],[135–476] | 1246 | [75–476] |
| 1286 | [235–516] | 1247 | [268–504] |
| 1287 | [135–488] | 1248 | [55–525] |
| 1288 | [91–243],[132–488] | 1249 | [221–466] |
| 1289 | [89–418] | 1250 | [33–536] |
| 1290 | [279–512] | 1251 | [41–568] |
| 1291 | [377–526] | 1252 | [41–490] |
| 1292 | [94–435],[161–457] | 1253 | [40–528],[254–526] |
| 1293 | [167–406],[253–483] | 1254 | [32–514] |
| 1294 | [68–364] | 1255 | [32–511] |
| 1295 | [125–466] | 1256 | [34–480] |
| 1296 | [70–300],[242–493] | 1257 | [33–482] |
| 1297 | [98–271] | 1258 | [89–454] |
| 1298 | [20–472] | 1259 | [324–524] |
| 1299 | [30–224],[49–225] | 1260 | [121–552] |
| 1300 | [37–561] | 1261 | [245–649] |
| 1301 | [33–188],[340–501] | 1262 | [141–491] |
| 1302 | [233–574],[279–638] | 1263 | [199–507] |
| 1303 | [73–597] | 1264 | [66–488],[316–489] |
| 1304 | [305–511],[342–497] | 1265 | [159–539] |
| 1305 | [299–469] | 1312 | [267–515] |
| 1306 | [105–482] | 1313 | [96–293],[269–469] |
| 1307 | [228–485] | 1314 | [105–503] |
| 1308 | [30–338],[173–337] | 1315 | [99–491] |
| 1309 | [162–449] | 1316 | [13–333] |
| 1310 | [37–459],[233–436] | 1317 | [68–469] |
| 1311 | [14–487],[228–461] | 1318 | [49–201],[207–503] |
| 1357 | [39–212] | 1319 | [104–562],[358–561] |
| 1358 | [176–421],[354–521] | 1320 | [143–367] |
| 1359 | [70–354],[204–401] | 1321 | [235–468] |
| 1360 | [21–404] | 1322 | [28–249] |
| 1361 | [264–701],[355–564] | 1323 | [28–204] |
| 1362 | [53–526] | 1324 | [28–240] |
| 1363 | [137–454] | 1325 | [28–210] |
| 1364 | [103–255] | 1326 | [154–510] |
| 1365 | [230–400] | 1327 | [208–480],[251–430] |
| 1366 | [185–613] | 1328 | [294–470] |
| 1367 | [61–267] | 1329 | [5–169],[208–453] |
| 1368 | [118–399] | 1330 | [127–498] |
| 1369 | [87–329],[332–616] | 1331 | [35–526] |
| 1370 | [99–281] | 1332 | [11–475] |
| 1371 | [208–429] | 1333 | [3–347] |
| 1372 | [316–495] | 1334 | [221–394] |
| 1373 | [32–277],[193–402] | 1335 | [93–341] |
| 1374 | [99–356],[113–364] | 1336 | [39–317] |
| 1375 | [132–317],[215–457] | 1337 | [137–478] |
| 1376 | [56–355] | 1338 | [60–212] |
| 1377 | [53–247] | 1339 | [1–477],[152–415] |
| 1378 | [201–491] | 1340 | [200–430] |
| 1379 | [7–216],[189–452] | | |
| 1380 | [113–346],[301–474] | | |
| 1381 | [183–434] | | |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 1341 | [105–395] | 1382 | [40–246] | 1503 | [72–296] | 1543 | [174–527] |
| 1342 | [92–412] | 1383 | [10–216] | 1504 | [72–296] | 1544 | [121–390] |
| 1343 | [90–479] | 1384 | [218–457],[294–485] | 1505 | [30–242] | 1545 | [93–344] |
| 1344 | [33–263],[224–388] | 1385 | [42–440] | 1506 | [76–234] | 1546 | [88–339] |
| 1345 | [9–446],[199–363],[314–622],[493–774] | 1386 | [70–252],[114–299] | 1507 | [36–404],[112–417] | 1547 | [133–339] |
| | | 1387 | [37–429] | 1508 | [238–480] | 1548 | [139–426] |
| 1346 | [9–491],[199–438] | 1388 | [37–474] | 1509 | [96–359] | 1549 | [84–326] |
| 1347 | [189–464] | 1389 | [56–601] | 1510 | [125–415] | 1550 | [205–354] |
| 1348 | [112–387] | 1390 | [97–381] | 1511 | [138–338] | 1551 | [43–360] |
| 1349 | [56–214] | 1391 | [142–354] | 1512 | [190–393] | 1552 | [221–535],[252–461] |
| 1350 | [132–443],[190–396] | 1392 | [322–483] | 1513 | [77–457] | 1553 | [13–180],[240–443] |
| 1351 | [14–163] | 1393 | [125–352],[198–482] | 1514 | [279–473] | 1554 | [107–298] |
| 1352 | [57–215] | 1394 | [7–162],[36–221] | 1515 | [27–278] | 1555 | [93–383],[202–510] |
| 1353 | [169–423] | 1395 | [55–297] | 1516 | [257–505] | 1556 | [224–382],[271–429] |
| 1354 | [183–398] | 1396 | [90–326] | 1517 | [342–581] | 1557 | [151–363],[294–491] |
| 1355 | [133–417] | 1397 | [76–273] | 1518 | [77–367] | 1558 | [50–520],[360–539] |
| 1356 | [310–906] | 1398 | [225–428] | 1519 | [165–443] | 1559 | [92–310] |
| 1403 | [10–504] | 1399 | [111–371] | 1520 | [16–297] | 1560 | [233–454] |
| 1404 | [101–442] | 1400 | [40–189] | 1521 | [52–264],[155–346] | 1561 | [179–397] |
| 1405 | [94–441] | 1401 | [38–262],[88–366] | 1522 | [1–495] | 1562 | [179–397] |
| 1406 | [155–340] | 1402 | [113–319] | 1523 | [192–476] | 1563 | [28–363] |
| 1407 | [30–527] | 1449 | [6–164],[25–240] | 1524 | [156–422] | 1564 | [28–363] |
| 1408 | [106–453] | 1450 | [6–164],[25–237] | 1525 | [77–472] | 1565 | [90–257] |
| 1409 | [169–381] | 1451 | [6–164],[25–240] | 1526 | [56–505] | 1566 | [4–339] |
| 1410 | [137–367],[180–362] | 1452 | [6–164],[25–237] | 1527 | [179–433] | 1567 | [22–327],[297–470],[346–519] |
| 1411 | [50–205],[241–402] | 1453 | [21–380] | 1528 | [107–298] | | |
| 1412 | [69–356] | 1454 | [121–288] | 1529 | [237–398] | 1568 | [281–451] |
| 1413 | [18–257] | 1455 | [41–286],[324–506] | 1530 | [237–398] | 1569 | [201–578],[371–523] |
| 1414 | [140–472] | 1456 | [153–335] | 1531 | [117–467] | 1570 | [109–381] |
| 1415 | [95–346],[213–533] | 1457 | [153–335] | 1532 | [8–343] | 1571 | [23–370] |
| 1416 | [67–390],[206–403] | 1458 | [121–375] | 1533 | [14–247],[205–447] | 1572 | [72–296] |
| 1417 | [56–217],[163–336] | 1459 | [153–335] | 1534 | [229–456] | 1573 | [267–479] |
| 1418 | [204–353] | 1460 | [17–187],[132–287],[160–378] | 1535 | [129–554],[202–564] | 1574 | [176–439] |
| 1419 | [55–261],[261–425] | | | 1536 | [176–424] | 1575 | [33–224],[193–348] |
| 1420 | [57–320] | 1461 | [21–266] | 1537 | [111–272] | 1576 | [114–332] |
| 1421 | [243–467],[302–538] | 1462 | [133–336] | 1538 | [281–430] | 1577 | [21–179],[195–347] |
| 1422 | [68–334] | 1463 | [138–671] | 1539 | [289–462] | 1578 | [51–254] |
| 1423 | [33–218],[302–475] | 1464 | [11–166],[279–458] | 1540 | [216–380] | 1579 | [75–332] |
| 1424 | [31–207],[51–260],[269–430] | 1465 | [21–584] | 1587 | [261–452] | 1580 | [275–448] |
| | | 1466 | [64–213] | 1588 | [148–411] | 1581 | [21–377] |
| 1425 | [172–447] | 1467 | [250–408] | 1589 | [16–315],[212–427] | 1582 | [272–481] |
| 1426 | [454–615] | 1468 | [9–170],[204–431],[271–444] | 1590 | [72–296] | 1583 | [143–433] |
| 1427 | [43–225],[237–428] | | | 1591 | [81–368] | 1584 | [225–458] |
| 1428 | [18–314] | 1469 | [100–441] | 1592 | [176–367] | 1585 | [229–465] |
| 1429 | [210–386] | 1470 | [158–442] | 1593 | [115–411] | 1586 | [40–234],[69–443] |
| 1430 | [206–355] | 1471 | [68–235] | 1594 | [99–443] | 1633 | [130–303] |
| 1431 | [10–273] | 1472 | [1–309],[144–464],[320–484] | 1595 | [95–409],[213–386] | 1634 | [104–319] |
| 1432 | [72–287] | | | 1596 | [44–427] | 1635 | [70–483] |
| 1433 | [69–305] | 1473 | [11–331] | 1597 | [75–317] | 1636 | [266–439],[315–473] |
| 1434 | [17–259] | 1474 | [204–443] | 1598 | [202–477] | 1637 | [13–165],[21–182] |
| 1435 | [218–418] | 1475 | [273–437] | 1599 | [260–544],[571–723] | 1638 | [22–333] |
| 1436 | [332–574] | 1476 | [47–280] | 1600 | [136–435] | 1639 | [47–274] |
| 1437 | [229–429] | 1477 | [312–497] | 1601 | [21–233] | 1640 | [52–210] |
| 1438 | [77–247] | 1478 | [1–309],[144–461],[320–514] | 1602 | [165–536] | 1641 | [64–240] |
| 1439 | [83–259] | | | 1603 | [44–217],[123–494] | 1642 | [67–225] |
| 1440 | [68–238],[169–339],[254–529] | 1479 | [206–358],[362–532] | 1604 | [49–213],[117–539],[422–676] | 1643 | [16–183],[211–459] |
| | | 1480 | [13–216],[263–466] | | | 1644 | [18–230],[140–352] |
| 1441 | [39–284],[49–222] | 1481 | [102–326],[292–444] | 1605 | [35–187] | 1645 | [196–396] |
| 1442 | [188–472],[256–429] | 1482 | [125–316],[238–402] | 1606 | [139–513],[389–556] | 1646 | [67–225] |
| 1443 | [157–318] | 1483 | [191–355] | 1607 | [65–247] | 1647 | [19–315] |
| 1444 | [58–363] | 1484 | [77–235] | 1608 | [83–241] | 1648 | [201–410] |
| 1445 | [6–164],[25–237] | 1485 | [59–319] | 1609 | [80–304] | 1649 | [194–379] |
| 1446 | [155–334] | 1486 | [209–475] | 1610 | [96–290],[208–381] | 1650 | [75–275],[134–379] |
| 1447 | [78–248] | 1487 | [14–478],[237–485] | 1611 | [114–308],[172–423] | 1651 | [145–318] |
| 1448 | [50–304] | 1488 | [39–347],[142–354] | 1612 | [67–237],[113–352],[252–425] | 1652 | [47–397] |
| 1495 | [42–491] | 1489 | [32–217] | | | 1653 | [322–513] |
| 1496 | [293–502] | 1490 | [69–383],[154–366] | 1613 | [127–285] | 1654 | [167–331] |
| 1497 | [273–452] | 1491 | [83–316] | 1614 | [130–300] | 1655 | [191–448] |
| 1498 | [148–474] | 1492 | [167–379] | 1615 | [135–320] | 1656 | [94–375] |
| 1499 | [73–267] | 1493 | [186–368] | 1616 | [42–536],[119–331] | 1657 | [26–370],[307–480] |
| 1500 | [71–385] | 1494 | [38–283] | 1617 | [32–307] | 1658 | [163–468],[380–628] |
| 1501 | [53–334],[277–435] | 1541 | [239–394] | 1618 | [75–251] | 1659 | [35–319] |
| 1502 | [137–286] | 1542 | [90–290] | 1619 | [65–253] | 1660 | [183–413] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 1620 | [154–471],[216–383] | 1661 | [43–264] | 1784 | [60–242] | 1821 | [129–323] |
| 1621 | [30–284] | 1662 | [32–385] | 1785 | [120–347] | 1822 | [243–479] |
| 1622 | [126–371],[340–525] | 1663 | [187–405],[282–443],[290–499] | 1786 | [20–247] | 1823 | [50–202] |
| 1623 | [140–304] | | | 1787 | [17–178] | 1824 | [154–351],[236–403],[291–470] |
| 1624 | [226–447] | 1664 | [76–675] | 1788 | [123–332] | | |
| 1625 | [223–435] | 1665 | [228–401] | 1789 | [148–333] | 1825 | [56–274] |
| 1626 | [34–327] | 1666 | [191–439] | 1790 | [77–388] | 1826 | [161–334] |
| 1627 | [17–298],[46–270] | 1667 | [76–276] | 1791 | [34–315],[336–548] | 1827 | [153–431] |
| 1628 | [54–224] | 1668 | [228–401] | 1792 | [95–349] | 1828 | [23–382] |
| 1629 | [124–333] | 1669 | [5–334] | 1793 | [29–259] | 1829 | [5–175] |
| 1630 | [60–209] | 1670 | [26–214] | 1794 | [238–462] | 1830 | [29–271],[147–374] |
| 1631 | [8–184],[189–434] | 1671 | [76–276],[330–530] | 1795 | [5–409] | 1831 | [73–378],[282–431] |
| 1632 | [55–459] | 1672 | [94–324] | 1796 | [186–398] | 1832 | [70–366] |
| 1679 | [111–377] | 1673 | [66–251],[258–416] | 1797 | [269–439] | 1833 | [109–450],[293–517] |
| 1680 | [96–497],[452–685] | 1674 | [159–368] | 1798 | [280–474] | 1834 | [56–229] |
| 1681 | [180–377],[197–370] | 1675 | [44–193] | 1799 | [174–329],[214–378] | 1835 | [173–511] |
| 1682 | [11–487] | 1676 | [203–352] | 1800 | [42–320] | 1836 | [123–359] |
| 1683 | [41–304] | 1677 | [97–477] | 1801 | [182–451] | 1837 | [79–435] |
| 1684 | [194–427] | 1678 | [41–337] | 1802 | [142–384] | 1838 | [92–298] |
| 1685 | [315–536],[439–648] | 1725 | [21–209] | 1803 | [1–453],[120–353],[381–569] | 1839 | [359–547] |
| 1686 | [24–329] | 1726 | [108–275] | | | 1840 | [243–401] |
| 1687 | [76–408] | 1727 | [234–407] | 1804 | [30–218] | 1841 | [18–239],[139–438] |
| 1688 | [75–242] | 1728 | [128–319] | 1805 | [90–371],[139–297] | 1842 | [129–323] |
| 1689 | [28–324] | 1729 | [17–187] | 1806 | [207–419] | 1843 | [32–274] |
| 1690 | [138–350] | 1730 | [147–326] | 1807 | [186–449] | 1844 | [71–256],[195–461] |
| 1691 | [239–397] | 1731 | [50–241] | 1808 | [123–284],[356–514] | 1845 | [216–635],[434–652] |
| 1692 | [2–157] | 1732 | [28–387] | 1809 | [6–212] | 1846 | [40–231] |
| 1693 | [196–351],[240–407] | 1733 | [73–390] | 1810 | [167–508] | 1847 | [244–453] |
| 1694 | [114–287] | 1734 | [235–525] | 1811 | [132–419],[287–520] | 1848 | [264–443] |
| 1695 | [23–202],[33–293] | 1735 | [52–372],[90–242] | 1812 | [122–382] | 1849 | [16–201] |
| 1696 | [139–378] | 1736 | [51–368],[259–432],[356–505] | 1813 | [87–245] | 1850 | [17–373] |
| 1697 | [240–395],[284–451] | | | 1814 | [183–443] | 1851 | [144–308] |
| 1698 | [8–325],[76–432] | 1737 | [86–244],[271–438],[317–520] | 1815 | [14–460] | 1852 | [150–434] |
| 1699 | [56–310] | | | 1816 | [28–282] | 1853 | [143–361] |
| 1700 | [188–679],[243–521] | 1738 | [50–340] | 1863 | [31–321],[305–535] | 1854 | [266–547],[303–497] |
| 1701 | [51–209] | 1739 | [2–250] | 1864 | [102–362] | 1855 | [16–201] |
| 1702 | [83–358] | 1740 | [23–247],[73–294] | 1865 | [232–450] | 1856 | [99–395],[172–486] |
| 1703 | [79–288],[291–455] | 1741 | [194–346] | 1866 | [20–343] | 1857 | [37–3219],[206–433] |
| 1704 | [49–432] | 1742 | [128–412] | 1867 | [166–435],[414–611] | 1858 | [102–263],[205–387] |
| 1705 | [35–526] | 1743 | [132–449] | 1868 | [10–204] | 1859 | [222–374] |
| 1706 | [148–402] | 1744 | [86–244],[271–438],[317–466] | 1869 | [101–436] | 1860 | [255–422] |
| 1707 | [110–526],[226–381] | | | 1870 | [21–497] | 1861 | [17–178] |
| 1708 | [187–360] | 1745 | [83–658] | 1871 | [219–443] | 1862 | [7–162],[436–585] |
| 1709 | [94–267] | 1746 | [79–276] | 1872 | [125–301],[136–357] | 1909 | [186–446] |
| 1710 | [176–325] | 1747 | [63–299] | 1873 | [111–386] | 1910 | [70–354],[149–304] |
| 1711 | [50–403] | 1748 | [73–249] | 1874 | [53–229],[214–378] | 1911 | [122–352] |
| 1712 | [178–507] | 1749 | [17–316] | 1875 | [6–287] | 1912 | [205–408] |
| 1713 | [110–277] | 1750 | [85–333],[186–539],[424–585] | 1876 | [29–304],[258–428] | 1913 | [78–233] |
| 1714 | [5–274],[278–481] | | | 1877 | [174–443] | 1914 | [170–346] |
| 1715 | [235–414] | 1751 | [155–376],[429–581] | 1878 | [152–673] | 1915 | [30–356],[67–504] |
| 1716 | [170–319] | 1752 | [286–465] | 1879 | [152–448] | 1916 | [13–441] |
| 1717 | [229–471],[261–494] | 1753 | [262–501] | 1880 | [50–253] | 1917 | [291–455] |
| 1718 | [53–271] | 1754 | [46–249] | 1881 | [22–432],[32–472],[141–362] | 1918 | [69–299] |
| 1719 | [278–463] | 1755 | [33–218] | | | 1919 | [15–179] |
| 1720 | [202–351] | 1756 | [19–168] | 1882 | [27–203] | 1920 | [199–618],[453–641] |
| 1721 | [56–271] | 1757 | [55–399] | 1883 | [184–438] | 1921 | [138–368] |
| 1722 | [62–235] | 1758 | [9–380] | 1884 | [179–475] | 1922 | [226–411] |
| 1723 | [8–214] | 1759 | [62–385] | 1885 | [237–389] | 1923 | [91–366] |
| 1724 | [55–240] | 1760 | [78–311] | 1886 | [75–596] | 1924 | [119–421] |
| 1771 | [244–465] | 1761 | [216–395] | 1887 | [53–229],[214–378] | 1925 | [17–193] |
| 1772 | [31–213] | 1762 | [43–312] | 1888 | [144–428] | 1926 | [18–266],[302–463] |
| 1773 | [159–470],[178–408] | 1763 | [131–346] | 1889 | [274–432] | 1927 | [7–354],[195–410],[215–475] |
| 1774 | [21–227],[190–435],[239–451] | 1764 | [107–313] | 1890 | [4–180] | | |
| | | 1765 | [17–244] | 1891 | [98–361],[129–329] | 1928 | [25–267],[257–475] |
| 1775 | [5–328],[79–399] | 1766 | [43–312] | 1892 | [143–418] | 1929 | [41–220],[289–471] |
| 1776 | [5–328],[79–426] | 1767 | [107–313] | 1893 | [167–493] | 1930 | [13–360],[201–416],[221–481] |
| 1777 | [84–284] | 1768 | [184–444] | 1894 | [61–429] | | |
| 1778 | [30–410] | 1769 | [65–370] | 1895 | [62–430] | 1931 | [269–418] |
| 1779 | [5–328],[79–426] | 1770 | [216–401] | 1896 | [95–475] | 1932 | [237–473],[241–495] |
| 1780 | [22–210],[122–280] | 1817 | [106–441],[164–391] | 1897 | [24–209] | 1933 | [105–287] |
| 1781 | [2–151],[220–456] | 1818 | [62–220] | 1898 | [61–429] | 1934 | [1–291] |
| 1782 | [232–381] | 1819 | [21–335] | 1899 | [148–414] | 1935 | [189–464] |
| 1783 | [87–311],[395–544] | 1820 | [111–293],[259–546] | 1900 | [139–327] | 1936 | [344–577] |

TABLE I-continued (Positions of all ORFs)

| Seq Id No. | Positions of Open Reading Frame(s) | Seq Id No. | Positions of Open Reading Frame(s) |
|---|---|---|---|
| 1901 | [218–370],[285–512] | 1937 | [34–195] |
| 1902 | [38–310] | 1938 | [84–296] |
| 1903 | [125–313] | 1939 | [34–195] |
| 1904 | [126–398] | 1940 | [34–195] |
| 1905 | [9–167],[175–354] | 1941 | [8–169] |
| 1906 | [124–351] | 1942 | [34–195] |
| 1907 | [222–380] | 1943 | [34–195] |
| 1908 | [65–316] | 1944 | [34–195] |
| 1955 | [181–333],[189–347] | 1945 | [195–530],[253–480] |
| 1956 | [16–243] | 1946 | [139–330] |
| 1957 | [195–407] | 1947 | [333–482],[585–740] |
| 1958 | [181–333],[189–347] | 1948 | [285–506] |
| 1959 | [80–301] | 1949 | [122–271],[153–329] |
| 1960 | [171–419] | 1950 | [206–403] |
| 1961 | [37–279],[98–634] | 1951 | [82–297],[221–427] |
| 1962 | [209–397] | 1952 | [181–333],[189–347] |
| 1963 | [248–469] | 1953 | [133–327] |
| 1964 | [93–341] | 1954 | [133–327] |
| 1965 | [206–403] | 2001 | [106–348] |
| 1966 | [17–391] | 2002 | [7–234] |
| 1967 | [252–440] | 2003 | [98–340],[202–567] |
| 1968 | [142–411],[453–608] | 2004 | [108–350],[212–490] |
| 1969 | [29–367],[330–662],[370–708] | 2005 | [211–570],[230–430] |
| 1970 | [126–350],[221–394] | 2006 | [181–384],[353–523],[403–792] |
| 1971 | [7–186] | 2007 | [79–297] |
| 1972 | [92–340] | 2008 | [58–228] |
| 1973 | [47–199],[229–405] | 2009 | [125–373],[286–474] |
| 1974 | [233–424] | 2010 | [148–315] |
| 1975 | [99–410] | 2011 | [295–474] |
| 1976 | [80–238] | 2012 | [62–244] |
| 1977 | [203–433] | 2013 | [219–374] |
| 1978 | [19–474] | 2014 | [271–426] |
| 1979 | [15–221] | 2015 | [218–373] |
| 1980 | [97–327] | 2016 | [218–379] |
| 1981 | [64–234],[105–332] | 2017 | [284–439] |
| 1982 | [41–352] | 2018 | [39–266],[184–492] |
| 1983 | [180–455] | 2019 | [54–350] |
| 1984 | [385–768] | 2020 | [14–469],[255–428] |
| 1985 | [83–325],[126–314] | 2021 | [7–330] |
| 1986 | [7–258] | 2022 | [104–367],[157–435] |
| 1987 | [102–398] | 2023 | [24–185] |
| 1988 | [98–331] | 2024 | [161–589] |
| 1989 | [52–255] | 2025 | [32–187] |
| 1990 | [76–339] | 2026 | [88–312] |
| 1991 | [162–356] | 2027 | [21–290],[239–406] |
| 1992 | [236–391] | 2028 | [57–248] |
| 1993 | [301–477] | 2029 | [53–454] |
| 1994 | [99–290] | 2030 | [174–530] |
| 1995 | [150–569] | 2031 | [130–288] |
| 1996 | [94–276] | 2032 | [187–342] |
| 1997 | [94–276] | 2033 | [221–466] |
| 1998 | [206–436],[211–534] | 2034 | [22–357] |
| 1999 | [6–164],[71–268] | 2035 | [102–377] |
| 2000 | [119–304] | 2036 | [266–502] |
| 2047 | [212–400] | 2037 | [36–224],[241–507] |
| 2048 | [155–433] | 2038 | [128–367] |
| 2049 | [102–377] | 2039 | [157–318] |
| 2050 | [147–389] | 2040 | [115–288] |
| 2051 | [114–449],[194–364] | 2041 | [102–377] |
| 2052 | [21–290],[239–397] | 2042 | [126–290] |
| 2053 | [52–315] | 2043 | [52–315] |
| 2054 | [102–377] | 2044 | [40–318],[318–479] |
| 2055 | [21–566] | 2045 | [272–430] |
| 2056 | [44–214] | 2046 | [23–352] |
| 2057 | [1–189] | 2093 | [39–245] |
| 2058 | [88–312] | 2094 | [167–355] |
| 2059 | [36–353] | 2095 | [12–203],[288–446] |
| 2060 | [225–455] | 2096 | [279–449] |
| 2061 | [65–265],[192–383] | 2097 | [179–379],[288–476] |
| 2062 | [9–161],[262–417] | 2098 | [119–313] |
| 2063 | [231–404] | 2099 | [18–239],[223–372] |
| 2064 | [115–288] | 2100 | [168–356] |
| 2065 | [158–325],[219–377] | 2101 | [85–267] |
| 2066 | [24–173] | 2102 | [54–224] |
| 2067 | [39–191] | 2103 | [3–176] |
| 2068 | [57–320] | 2104 | [280–504] |
| 2069 | [189–461],[313–501] | 2105 | [18–206] |
| 2070 | [146–433] | 2106 | [196–363] |
| 2071 | [3–176] | 2107 | [10–177] |
| 2072 | [42–215] | 2108 | [193–453],[221–373] |
| 2073 | [46–249] | 2109 | [71–253],[265–495] |
| 2074 | [140–313] | 2110 | [3–215] |
| 2075 | [74–379] | 2111 | [101–256],[160–381] |
| 2076 | [104–430] | 2112 | [11–349] |
| 2077 | [229–411] | 2113 | [19–222] |
| 2078 | [3–185] | 2114 | [125–322] |
| 2079 | [273–422] | 2115 | [47–256] |
| 2080 | [212–427] | 2116 | [127–378],[215–391] |
| 2081 | [76–303],[350–505] | 2117 | [25–219] |
| 2082 | [231–584] | 2118 | [152–346] |
| 2083 | [140–313] | 2119 | [178–339],[242–439] |
| 2084 | [118–363],[266–463] | 2120 | [25–204] |
| 2085 | [223–444] | 2121 | [102–320] |
| 2086 | [231–455],[310–504] | 2122 | [122–379] |
| 2087 | [13–195],[223–444] | 2123 | [115–378] |
| 2088 | [79–378],[128–358] | 2124 | [84–248],[182–352] |
| 2089 | [265–432] | 2125 | [12–203],[288–437] |
| 2090 | [178–330] | 2126 | [169–354] |
| 2091 | [22–180],[131–427] | 2127 | [163–330] |
| 2092 | [12–209] | 2128 | [139–324] |
| 2139 | [85–297] | 2129 | [292–474] |
| 2140 | [89–289] | 2130 | [103–372] |
| 2141 | [14–205],[144–449] | 2131 | [47–295] |
| 2142 | [330–494] | 2132 | [106–366] |
| 2143 | [287–466] | 2133 | [199–420] |
| 2144 | [92–256] | 2134 | [50–208] |
| 2145 | [218–406] | 2135 | [9–200] |
| 2146 | [83–259] | 2136 | [191–349] |
| 2147 | [56–244] | 2137 | [280–429] |
| 2148 | [310–462] | 2138 | [47–226] |
| 2149 | [70–237] | 2185 | [55–390] |
| 2150 | [160–315] | 2186 | [224–454] |
| 2151 | [174–440] | 2187 | [64–213] |
| 2152 | [136–330] | 2188 | [92–280],[136–306] |
| 2153 | [18–239],[223–396] | 2189 | [44–478] |
| 2154 | [20–181] | 2190 | [59–448] |
| 2155 | [103–450],[288–485] | 2191 | [150–314] |
| 2156 | [280–450] | 2192 | [213–467] |
| 2157 | [17–400] | 2193 | [64–321] |
| 2158 | [175–483] | 2194 | [88–315] |
| 2159 | [8–193],[227–472] | 2195 | [88–315],[363–566] |
| 2160 | [138–311],[247–408] | 2196 | [21–209] |
| 2161 | [24–257] | 2197 | [158–424] |
| 2162 | [17–223] | 2198 | [132–422] |
| 2163 | [106–276] | 2199 | [4–192],[116–304] |
| 2164 | [75–224] | 2200 | [88–480],[356–520] |
| 2165 | [79–246] | 2201 | [110–268] |
| 2166 | [66–275] | 2202 | [53–214],[308–463] |
| 2167 | [197–376],[238–426] | 2203 | [93–272] |
| 2168 | [173–322] | 2204 | [129–356] |
| 2169 | [83–319],[205–384] | 2205 | [181–345] |
| 2170 | [18–497] | 2206 | [208–366] |
| 2171 | [29–214] | 2207 | [257–463] |
| 2172 | [213–431] | 2208 | [113–364] |
| 2173 | [327–476] | 2209 | [36–569] |
| 2174 | [262–525] | 2210 | [39–188] |
| 2175 | [12–209] | 2211 | [32–337],[216–455] |
| 2176 | [158–379] | 2212 | [122–286],[258–458] |
| 2177 | [59–346] | 2213 | [6–386] |
| 2178 | [27–338] | 2214 | [137–439] |
| 2179 | [287–457] | 2215 | [85–252] |
| 2180 | [49–243] | 2216 | [112–363] |
| 2181 | [86–265],[172–450] | 2217 | [58–306] |
| 2182 | [135–428] | 2218 | [67–381],[360–509] |
| 2183 | [206–385],[231–413] | 2219 | [98–442] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 2184 | [85–243] | 2220 | [217–393] | 2348 | [54–260],[254–409] | 2383 | [76–261] |
| 2231 | [3–239],[106–255] | 2221 | [55–237] | 2349 | [27–194] | 2384 | [175–375],[339–569], [425–622] |
| 2232 | [24–242] | 2222 | [57–212] | 2350 | [11–202] | | |
| 2233 | [90–431],[295–465] | 2223 | [29–181] | 2351 | [34–381],[407–616] | 2385 | [190–369] |
| 2234 | [27–212] | 2224 | [5–214] | 2352 | [48–197] | 2386 | [49–210] |
| 2235 | [20–181] | 2225 | [44–283] | 2353 | [301–459] | 2387 | [64–336],[101–343], [267–515] |
| 2236 | [107–409],[117–308] | 2226 | [189–386] | 2354 | [46–318],[209–478] | | |
| 2237 | [60–209] | 2227 | [56–298] | 2355 | [168–350] | 2388 | [29–232],[78–308] |
| 2238 | [125–274],[187–357] | 2228 | [201–353] | 2356 | [154–315] | 2389 | [211–369] |
| 2239 | [130–306] | 2229 | [48–230],[140–295] | 2357 | [144–353] | 2390 | [33–368] |
| 2240 | [69–323] | 2230 | [32–253] | 2358 | [148–432] | 2391 | [78–329] |
| 2241 | [104–421],[222–467] | 2277 | [188–409] | 2359 | [1–195],[141–293] | 2392 | [159–533] |
| 2242 | [63–440],[157–324] | 2278 | [99–254] | 2360 | [209–400] | 2393 | [23–202] |
| 2243 | [66–227] | 2279 | [129–293] | 2361 | [70–351],[285–470] | 2394 | [170–328],[285–467] |
| 2244 | [120–290],[293–460] | 2280 | [202–432] | 2362 | [257–412] | 2395 | [160–453] |
| 2245 | [28–234],[137–433], [259–471] | 2281 | [33–212],[216–386] | 2363 | [36–368] | 2396 | [101–274] |
| | | 2282 | [82–234],[290–520] | 2364 | [24–182] | 2397 | [267–482] |
| 2246 | [123–383] | 2283 | [199–405] | 2365 | [3–329],[247–480] | 2398 | [80–274] |
| 2247 | [125–337] | 2284 | [133–381],[222–533] | 2366 | [166–402] | 2399 | [96–443] |
| 2248 | [129–446] | 2285 | [206–367] | 2367 | [118–285],[269–457] | 2400 | [224–418] |
| 2249 | [90–242] | 2286 | [131–349] | 2368 | [266–454] | 2401 | [145–486],[296–466] |
| 2250 | [290–469] | 2287 | [83–394],[238–480] | 2415 | [34–201] | 2402 | [38–202] |
| 2251 | [182–496] | 2288 | [218–370] | 2416 | [182–487] | 2403 | [263–415] |
| 2252 | [101–406] | 2289 | [110–295] | 2417 | [388–687],[751–930] | 2404 | [102–305] |
| 2253 | [296–478] | 2290 | [62–223] | 2418 | [105–296],[223–423] | 2405 | [1–411],[65–337] |
| 2254 | [126–383] | 2291 | [188–457] | 2419 | [49–321] | 2406 | [112–339] |
| 2255 | [113–385],[268–492] | 2292 | [130–309] | 2420 | [98–253] | 2407 | [77–241] |
| 2256 | [58–270] | 2293 | [46–324] | 2421 | [162–317] | 2408 | [59–268],[190–372] |
| 2257 | [6–155] | 2294 | [202–357] | 2422 | [93–293] | 2409 | [81–269],[347–514] |
| 2258 | [58–270] | 2295 | [47–271] | 2423 | [251–487] | 2410 | [199–399] |
| 2259 | [58–450] | 2296 | [182–355] | 2424 | [19–321] | 2411 | [44–238],[102–254] |
| 2260 | [131–298] | 2297 | [54–401],[193–474], [248–475] | 2425 | [96–251],[319–486] | 2412 | [192–437],[211–378] |
| 2261 | [207–380] | | | 2426 | [44–259],[300–485] | 2413 | [123–302] |
| 2262 | [216–368] | 2298 | [99–269] | 2427 | [38–463] | 2414 | [95–376],[297–467] |
| 2263 | [195–356] | 2299 | [36–242],[133–333] | 2428 | [17–442] | 2461 | [64–552] |
| 2264 | [11–169],[237–389] | 2300 | [53–274] | 2429 | [16–441] | 2462 | [53–217] |
| 2265 | [133–423] | 2301 | [33–188] | 2430 | [66–263] | 2463 | [288–446] |
| 2266 | [226–375] | 2302 | [25–204] | 2431 | [143–373] | 2464 | [187–336] |
| 2267 | [187–453] | 2303 | [226–450] | 2432 | [66–446] | 2465 | [52–390] |
| 2268 | [153–317],[245–457] | 2304 | [165–344] | 2433 | [190–465] | 2466 | [37–372] |
| 2269 | [257–421] | 2305 | [87–263] | 2434 | [52–360] | 2467 | [237–509],[329–484] |
| 2270 | [192–422] | 2306 | [13–186] | 2435 | [341–490] | 2468 | [72–317] |
| 2271 | [106–369] | 2307 | [301–462] | 2436 | [35–454] | 2469 | [214–375] |
| 2272 | [266–469] | 2308 | [189–455],[212–442], [277–498] | 2437 | [42–308],[59–361] | 2470 | [125–418],[214–363] |
| 2273 | [43–213] | | | 2438 | [174–377],[275–433] | 2471 | [202–357] |
| 2274 | [36–197] | 2309 | [5–154] | 2439 | [146–310] | 2472 | [51–215] |
| 2275 | [215–424],[234–389] | 2310 | [163–345] | 2440 | [168–428],[313–507] | 2473 | [206–364] |
| 2276 | [219–407] | 2311 | [165–473] | 2441 | [99–272] | 2474 | [133–375] |
| 2323 | [46–207] | 2312 | [283–450] | 2442 | [6–215] | 2475 | [146–334] |
| 2324 | [2–166] | 2313 | [132–281] | 2443 | [155–382] | 2476 | [149–298] |
| 2325 | [95–265] | 2314 | [96–281] | 2444 | [180–401] | 2477 | [28–204] |
| 2326 | [115–294] | 2315 | [14–232] | 2445 | [161–328] | 2478 | [105–332] |
| 2327 | [140–349] | 2316 | [3–254] | 2446 | [63–254],[104–430], [261–410] | 2479 | [38–211] |
| 2328 | [238–399] | 2317 | [65–304] | | | 2480 | [124–489],[284–502] |
| 2329 | [210–413] | 2318 | [34–201] | 2447 | [115–321] | 2481 | [235–516] |
| 2330 | [33–230],[149–412] | 2319 | [62–370],[225–422] | 2448 | [116–298] | 2482 | [18–254],[103–390] |
| 2331 | [123–350] | 2320 | [135–335],[280–471] | 2449 | [151–423] | 2483 | [149–298] |
| 2332 | [80–313],[210–452] | 2321 | [7–174],[270–422] | 2450 | [95–289] | 2484 | [172–489] |
| 2333 | [50–310] | 2322 | [87–326] | 2451 | [58–222] | 2485 | [271–528] |
| 2334 | [251–400] | 2369 | [13–330],[96–344] | 2452 | [238–387] | 2486 | [231–410] |
| 2335 | [95–331] | 2370 | [34–216],[207–452] | 2453 | [276–467] | 2487 | [137–301],[204–386] |
| 2336 | [133–462] | 2371 | [18–191] | 2454 | [260–448] | 2488 | [177–401] |
| 2337 | [62–217] | 2372 | [141–515],[247–468] | 2455 | [228–398] | 2489 | [108–266],[134–292] |
| 2338 | [23–268] | 2373 | [219–464] | 2456 | [130–282] | 2490 | [226–387] |
| 2339 | [132–281] | 2374 | [74–265] | 2457 | [259–450] | 2491 | [257–406] |
| 2340 | [239–388] | 2375 | [219–464] | 2458 | [259–450] | 2492 | [175–405] |
| 2341 | [27–194] | 2376 | [261–503] | 2459 | [259–450] | 2493 | [124–498] |
| 2342 | [8–193] | 2377 | [203–385],[231–440] | 2460 | [276–467] | 2494 | [256–426] |
| 2343 | [301–462] | 2378 | [169–378] | 2507 | [81–326],[266–469] | 2495 | [56–250] |
| 2344 | [296–478] | 2379 | [12–398] | 2508 | [22–255] | 2496 | [8–367],[160–465] |
| 2345 | [106–288] | 2380 | [12–368] | 2509 | [22–270] | 2497 | [109–396] |
| 2346 | [141–308] | 2381 | [129–395] | 2510 | [264–452],[313–483] | 2498 | [153–437],[298–483] |
| 2347 | [42–218],[134–319] | 2382 | [169–414] | 2511 | [16–165] | 2499 | [288–443] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 2512 | [57–236],[202–462] | 2500 | [10–195] | 2627 | [147–335] | 2662 | [38–286] |
| 2513 | [107–376] | 2501 | [131–334] | 2628 | [147–335] | 2663 | [164–454] |
| 2514 | [171–449],[247–498] | 2502 | [22–213] | 2629 | [147–335] | 2664 | [44–208] |
| 2515 | [37–192] | 2503 | [22–444] | 2630 | [147–335] | 2665 | [164–355] |
| 2516 | [279–545] | 2504 | [191–376] | 2631 | [147–335] | 2666 | [113–358] |
| 2517 | [74–274],[298–468] | 2505 | [39–527] | 2632 | [147–335] | 2667 | [2–205],[186–338] |
| 2518 | [86–325] | 2506 | [31–261] | 2633 | [147–335] | 2668 | [129–329],[226–552] |
| 2519 | [300–455] | 2553 | [83–274] | 2634 | [147–335] | 2669 | [219–431] |
| 2520 | [65–454] | 2554 | [14–286] | 2635 | [199–357] | 2670 | [17–169] |
| 2521 | [68–238] | 2555 | [30–344],[310–477] | 2636 | [147–335] | 2671 | [93–251],[157–402] |
| 2522 | [49–228],[276–446] | 2556 | [241–390] | 2637 | [12–374] | 2672 | [60–284],[169–348] |
| 2523 | [20–349],[165–473] | 2557 | [60–221] | 2638 | [124–324] | 2673 | [63–308] |
| 2524 | [20–349],[165–473], [412–567] | 2558 | [73–261] | 2639 | [147–335] | 2674 | [135–299] |
| 2525 | [2–238] | 2559 | [115–288] | 2640 | [113–409] | 2675 | [473–652] |
| 2526 | [68–223] | 2560 | [107–289],[180–437], [356–505] | 2641 | [110–310] | 2676 | [253–447] |
| 2527 | [119–313] | | | 2642 | [34–213],[84–443] | 2677 | [49–222] |
| 2528 | [21–326] | 2561 | [90–368] | 2643 | [147–335] | 2678 | [152–337] |
| 2529 | [13–165] | 2562 | [182–379] | 2644 | [165–374] | 2679 | [23–220] |
| 2530 | [105–314] | 2563 | [168–380] | 2691 | [282–470] | 2680 | [116–283],[258–419] |
| | | 2564 | [9–221],[37–306], [215–433] | 2692 | [203–355] | 2681 | [116–283],[258–419] |
| | | | | 2693 | [144–302],[154–330] | 2682 | [247–453] |
| 2531 | [111–410] | 2565 | [18–272] | 2694 | [250–501] | 2683 | [93–299],[445–594] |
| 2532 | [171–389] | 2566 | [256–429] | 2695 | [85–336] | 2684 | [19–315] |
| 2533 | [22–318] | 2567 | [108–266],[169–360] | 2696 | [15–197],[197–445] | 2685 | [75–281] |
| 2534 | [80–247] | 2568 | [72–335] | 2697 | [12–275] | 2686 | [261–422] |
| 2535 | [232–402] | 2569 | [326–556] | 2698 | [248–397] | 2687 | [195–350] |
| 2536 | [115–339],[243–464] | 2570 | [132–281] | 2699 | [65–229],[229–408] | 2688 | [206–364] |
| 2537 | [160–405] | 2571 | [68–238] | 2700 | [325–489] | 2689 | [26–226] |
| 2538 | [261–476] | 2572 | [25–231] | 2701 | [4–420] | 2690 | [26–424],[90–245] |
| 2539 | [85–297] | 2573 | [57–224] | 2702 | [233–397] | 2737 | [110–271] |
| 2540 | [284–442],[351–521], [524–904] | 2574 | [497–826] | 2703 | [191–442] | 2738 | [13–162] |
| | | 2575 | [264–422] | 2704 | [202–387],[230–415] | 2739 | [41–226] |
| 2541 | [170–346] | 2576 | [60–215],[202–447] | 2705 | [105–446] | 2740 | [46–471],[95–259] |
| 2542 | [189–455] | 2577 | [57–212],[124–411] | 2706 | [83–418],[219–431] | 2741 | [163–312] |
| 2543 | [49–243],[275–457] | 2578 | [57–212],[124–411] | 2707 | [137–337] | 2742 | [125–316],[235–444] |
| 2544 | [143–418],[154–306] | 2579 | [91–246] | 2708 | [179–412] | 2743 | [30–329] |
| 2545 | [257–454] | 2580 | [210–392] | 2709 | [234–410] | 2744 | [97–288] |
| 2546 | [4–270] | 2581 | [110–328],[270–449] | 2710 | [52–252],[263–448] | 2745 | [95–454] |
| 2547 | [56–277] | 2582 | [69–308],[250–429] | 2711 | [11–232] | 2746 | [93–416] |
| 2548 | [197–364] | 2583 | [110–328],[270–449] | 2712 | [269–472],[300–485] | 2747 | [12–191] |
| 2549 | [168–365] | 2584 | [1–207],[355–609] | 2713 | [142–435] | 2748 | [41–232] |
| 2550 | [220–399] | 2585 | [166–420] | 2714 | [21–230] | 2749 | [77–241] |
| 2551 | [193–348] | 2586 | [119–334] | 2715 | [21–230] | 2750 | [115–354] |
| 2552 | [113–391] | 2587 | [53–208],[372–539] | 2716 | [103–327] | 2751 | [93–257] |
| 2599 | [67–228] | 2588 | [92–283],[247–501] | 2717 | [343–504] | 2752 | [231–440] |
| 2600 | [57–245] | 2589 | [48–326] | 2718 | [42–263] | 2753 | [8–202],[78–323] |
| 2601 | [65–310],[211–366] | 2590 | [214–456] | 2719 | [3–176] | 2754 | [59–307] |
| 2602 | [117–290] | 2591 | [233–439] | 2720 | [46–249],[293–481] | 2755 | [362–514] |
| 2603 | [128–331],[255–452] | 2592 | [9–368] | 2721 | [1–156] | 2756 | [46–264] |
| 2604 | [2–151],[301–495] | 2593 | [32–220] | 2722 | [131–388] | 2757 | [139–525] |
| 2605 | [287–490] | 2594 | [142–432],[221–388] | 2723 | [71–379] | 2758 | [39–356] |
| 2606 | [12–191] | 2595 | [4–186],[302–475] | 2724 | [71–379] | 2759 | [48–341] |
| 2607 | [2–166] | 2596 | [4–168] | 2725 | [333–683] | 2760 | [125–445] |
| 2608 | [158–331] | 2597 | [91–270] | 2726 | [103–261] | 2761 | [147–497] |
| 2609 | [9–314] | 2598 | [132–305] | 2727 | [151–360],[341–505] | 2762 | [81–254] |
| 2610 | [179–358],[259–411] | 2645 | [147–335] | 2728 | [105–377] | 2763 | [81–374] |
| 2611 | [217–450] | 2646 | [147–335] | 2729 | [74–250],[129–401] | 2764 | [276–440] |
| 2612 | [279–443],[446–697] | 2647 | [285–443] | 2730 | [57–329] | 2765 | [115–405],[360–509] |
| 2613 | [64–249],[253–417] | 2648 | [275–469] | 2731 | [16–234] | 2766 | [64–306] |
| 2614 | [2–217],[362–526], [529–780] | 2649 | [212–391] | 2732 | [26–193],[81–287] | 2767 | [135–314] |
| | | 2650 | [41–271] | 2733 | [217–387] | 2768 | [64–306] |
| 2615 | [101–253] | 2651 | [20–184],[103–258] | 2734 | [198–380] | 2769 | [64–306] |
| 2616 | [164–400] | 2652 | [229–462],[398–568] | 2735 | [63–221],[170–481] | 2770 | [24–266] |
| 2617 | [285–458] | 2653 | [204–437],[373–540] | 2736 | [142–294],[189–389] | 2771 | [58–237] |
| 2618 | [286–447] | 2654 | [185–355] | 2783 | [119–328] | 2772 | [170–448],[351–506] |
| 2619 | [146–322] | 2655 | [298–465] | 2784 | [299–499] | 2773 | [118–267] |
| 2620 | [66–464],[76–249] | 2656 | [121–273] | 2785 | [90–491] | 2774 | [285–497] |
| 2621 | [281–460] | 2657 | [26–406] | 2786 | [16–210] | 2775 | [134–472] |
| 2622 | [56–226],[138–332] | 2658 | [28–222],[173–334] | 2787 | [91–315] | 2776 | [338–487] |
| 2623 | [147–335] | 2659 | [11–172],[165–335] | 2788 | [123–449] | 2777 | [109–351] |
| 2624 | [147–335] | 2660 | [113–295],[126–398], [301–456] | 2789 | [174–344] | 2778 | [256–411] |
| 2625 | [147–335] | | | 2790 | [10–297],[281–487] | 2779 | [130–438] |
| 2626 | [147–335] | 2661 | [73–285],[107–337] | 2791 | [20–313] | 2780 | [73–429],[350–502] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 2792 | [3–161],[473–700] | 2781 | [189–581] | 2908 | [267–533] | 2943 | [163–345],[305–508] |
| 2793 | [216–431] | 2782 | [88–249],[194–355] | 2909 | [32–235],[132–293] | 2944 | [23–364] |
| 2794 | [74–226],[154–342] | 2829 | [155–391],[168–353] | 2910 | [287–460] | 2945 | [120–410],[367–543] |
| 2795 | [94–276],[224–454] | 2830 | [82–372],[375–533] | 2911 | [177–521] | 2946 | [43–321] |
| 2796 | [96–278],[226–459] | 2831 | [79–228],[179–334] | 2912 | [64–354] | 2947 | [132–317] |
| 2797 | [96–278],[226–459] | 2832 | [181–588] | 2913 | [22–225] | 2948 | [22–408] |
| 2798 | [96–278],[226–456] | 2833 | [74–271] | 2914 | [174–335] | 2949 | [18–209] |
| 2799 | [95–277],[225–461] | 2834 | [103–330],[338–508] | 2915 | [236–469] | 2950 | [37–222],[95–397] |
| 2800 | [96–278],[226–432] | 2835 | [99–308] | 2916 | [174–356] | 2951 | [179–472] |
| 2801 | [96–278],[226–456] | 2836 | [33–230],[286–462] | 2917 | [33–296] | 2952 | [102–476],[259–525] |
| 2802 | [96–278],[226–456] | 2837 | [100–276] | 2918 | [34–201] | 2953 | [34–201] |
| 2803 | [95–277],[225–431] | 2838 | [109–261],[161–490],[336–515] | 2919 | [94–498] | 2954 | [190–486] |
| 2804 | [95–277],[225–458] | | | 2966 | [76–384] | 2955 | [3–215] |
| 2805 | [94–276],[224–472] | 2839 | [11–205],[307–468] | 2967 | [34–216],[227–385] | 2956 | [34–201] |
| 2806 | [89–268] | 2840 | [130–333] | 2968 | [116–286] | 2957 | [34–201] |
| 2807 | [276–434] | 2841 | [21–182] | 2969 | [66–305],[353–520] | 2958 | [121–447],[203–433] |
| 2808 | [227–433] | 2842 | [85–267] | 2970 | [160–390],[260–481] | 2959 | [380–532] |
| 2809 | [187–495] | 2843 | [216–395] | 2971 | [310–462] | 2960 | [34–201] |
| 2810 | [293–487] | 2844 | [111–335],[272–499] | 2972 | [181–369] | 2961 | [124–288] |
| 2811 | [313–486] | 2845 | [126–467],[193–504] | 2973 | [116–280] | 2962 | [143–355] |
| 2812 | [171–458],[176–325] | 2846 | [92–433],[159–470] | 2974 | [48–347] | 2963 | [94–465] |
| 2813 | [235–399] | 2847 | [95–436],[162–473] | 2975 | [304–549] | 2964 | [80–286] |
| 2814 | [30–392] | 2848 | [92–433],[159–470] | 2976 | [187–399] | 2965 | [273–443] |
| 2815 | [69–233] | 2849 | [16–180] | 2977 | [192–353],[196–369] | 3012 | [120–401] |
| 2816 | [364–546] | 2850 | [12–161],[127–282] | 2978 | [297–494] | 3013 | [135–293],[212–361] |
| 2817 | [6–158] | 2851 | [258–416] | 2979 | [20–463],[247–489] | 3014 | [46–432] |
| 2818 | [34–201] | 2852 | [78–233],[344–511] | 2980 | [35–331],[172–483],[213–419] | 3015 | [3–215] |
| 2819 | [142–396] | 2853 | [84–275] | | | 3016 | [277–495] |
| 2820 | [57–224],[227–454],[743–922] | 2854 | [76–324],[221–403] | 2981 | [44–196],[247–513] | 3017 | [182–445] |
| | | 2855 | [259–465] | 2982 | [60–434] | 3018 | [354–509] |
| 2821 | [167–361] | 2856 | [88–513] | 2983 | [75–227] | 3019 | [129–281] |
| 2822 | [114–275] | 2857 | [271–426] | 2984 | [12–260],[202–369] | 3020 | [73–249],[146–433] |
| 2823 | [126–377],[230–502] | 2858 | [7–198],[179–343] | 2985 | [575–769] | 3021 | [161–439] |
| 2824 | [144–374] | 2859 | [119–334] | 2986 | [63–467],[205–393] | 3022 | [82–393] |
| 2825 | [14–190],[195–464] | 2860 | [219–398] | 2987 | [115–288] | 3023 | [200–391] |
| 2826 | [94–270] | 2861 | [225–455] | 2988 | [34–201] | 3024 | [134–469] |
| 2827 | [199–456] | 2862 | [161–412] | 2989 | [195–350] | 3025 | [114–491],[388–582] |
| 2828 | [111–323] | 2863 | [121–273],[243–575] | 2990 | [244–411] | 3026 | [20–217],[190–354] |
| 2875 | [93–257],[242–493] | 2864 | [173–322] | 2991 | [180–515] | 3027 | [13–162],[513–713] |
| 2876 | [110–463],[147–326] | 2865 | [4–162],[303.455] | 2992 | [195–428] | 3028 | [57–218] |
| 2877 | [380–595] | 2866 | [238–405] | 2993 | [202–432] | 3029 | [114–464] |
| 2878 | [153–359] | 2867 | [160–333] | 2994 | [8–181],[295–477] | 3030 | [123–356],[169–360] |
| 2879 | [177–488] | 2868 | [468–617] | 2995 | [202–459] | 3031 | [85–234] |
| 2880 | [268–474] | 2869 | [49–201] | 2996 | [39–371] | 3032 | [248–418] |
| 2881 | [23–253],[133–552],[267–491] | 2870 | [189–455] | 2997 | [48–332],[178–414] | 3033 | [144–368] |
| | | 2871 | [189–455] | 2998 | [120–431],[253–504] | 3034 | [295–477] |
| 2882 | [243–434] | 2872 | [177–368] | 2999 | [104–271] | 3035 | [219–446] |
| 2883 | [85–258] | 2873 | [180–338] | 3000 | [265–441],[291–467] | 3036 | [56–340],[111–374] |
| 2884 | [347–556] | 2874 | [93–257],[242–430],[310–486] | 3001 | [110–271] | 3037 | [67–366],[261–461] |
| 2885 | [169–381],[311–460] | | | 3002 | [248–439] | 3038 | [395–553] |
| 2886 | [63–242] | 2920 | [38–208] | 3003 | [336–515] | 3039 | [226–432] |
| 2887 | [97–297] | 2921 | [62–268] | 3004 | [85–300],[191–373] | 3040 | [204–365] |
| 2888 | [173–484] | 2922 | [79–402],[173–358] | 3005 | [141–536] | 3041 | [8–160],[180–389],[223–420] |
| 2889 | [202–432] | 2923 | [224–472] | 3006 | [203–361] | | |
| 2890 | [37–348] | 2924 | [326–490] | 3007 | [127–453] | 3042 | [209–475] |
| 2891 | [48–455],[274–486] | 2925 | [114–359],[136–285] | 3008 | [127–297],[200–457] | 3043 | [90–278] |
| 2892 | [68–406] | 2926 | [88–276] | 3009 | [114–284],[187–441] | 3044 | [141–326] |
| 2893 | [14–328],[58–393] | 2927 | [270–431] | 3010 | [112–267],[53–413],[179–337] | 3045 | [88–273],[312–518] |
| 2894 | [22–204] | 2928 | [213–422] | | | 3046 | [75–236] |
| 2895 | [69–326] | 2929 | [278–454] | 3011 | [25–462],[191–358],[222–392],[492–698] | 3047 | [136–354],[245–508] |
| 2896 | [73–255],[155–325],[310–513],[437–586] | 2930 | [207–461] | | | 3048 | [177–359] |
| | | 2931 | [25–210] | 3057 | [261–446] | 3049 | [38–262],[87–308] |
| 2897 | [10–216] | 2932 | [341–490] | 3058 | [140–403] | 3050 | [183–455] |
| 2898 | [7–357],[41–205] | 2933 | [117–305] | 3059 | [229–444],[320–481] | 3051 | [183–461] |
| 2899 | [81–353] | 2934 | [180–437] | 3060 | [188–391] | 3052 | [104–562] |
| 2900 | [40–456],[203–484] | 2935 | [123–407] | 3061 | [135–341] | 3053 | [147–782] |
| 2901 | [34–201] | 2936 | [101–394] | 3062 | [149–355] | 3054 | [257–418] |
| 2902 | [99–704],[493–651] | 2937 | [25–252],[312–500] | 3063 | [116–286] | 3055 | [53–367] |
| 2903 | [34–201] | 2938 | [53–676] | 3064 | [93–431] | 3056 | [118–273] |
| 2904 | [199–354] | 2939 | [44–262] | 3065 | [20–382] | 3103 | [337–486] |
| 2905 | [139–303] | 2940 | [25–210] | 3066 | [171–380] | 3104 | [147–356] |
| 2906 | [108–374],[169–387] | 2941 | [81–359] | 3067 | [222–392] | 3105 | [231–410] |
| 2907 | [175–507] | 2942 | [11–268] | 3068 | [23–259] | 3106 | [193–402] |

TABLE I-continued (Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 3069 | [112–282] | 3107 | [207–368] | 3187 | [50–199] | 3224 | [3–164] |
| 3070 | [121–417],[230–484] | 3108 | [137–286] | 3188 | [60–233],[154–444] | 3225 | [120–281] |
| 3071 | [69–422] | 3109 | [201–512] | 3189 | [22–171] | 3226 | [41–217],[217–462] |
| 3072 | [16–240],[295–450] | 3110 | [91–294],[194–379] | 3190 | [102–263] | 3227 | [100–480] |
| 3073 | [81–392],[97–306] | 3111 | [261–455] | 3191 | [127–288] | 3228 | [198–437] |
| 3074 | [94–345] | 3112 | [36–287] | 3192 | [183–404] | 3229 | [44–244] |
| 3075 | [240–410] | 3113 | [60–293] | 3193 | [370–558],[521–718] | 3230 | [27–536],[184–384] |
| 3076 | [34–204],[231–425] | 3114 | [68–265] | 3194 | [132–284],[289–456] | 3231 | [27–389],[184–468] |
| 3077 | [109–285] | 3115 | [182–346] | 3241 | [62–292],[181–570], | 3232 | [85–252] |
| 3078 | [57–299] | 3116 | [160–441] |  | [408–653] | 3233 | [214–366] |
| 3079 | [22–231] | 3117 | [83–496],[228–452] | 3242 | [266–475],[375–524] | 3234 | [109–360],[296–463] |
| 3080 | [122–286],[279–428] | 3118 | [313–480] | 3243 | [120–326],[160–444] | 3235 | [32–295],[314–478] |
| 3081 | [105–299] | 3119 | [34–201] | 3244 | [63–248] | 3236 | [115–411] |
| 3082 | [56–277] | 3120 | [39–188],[98–466] | 3245 | [389–553] | 3237 | [115–342] |
| 3083 | [249–434] | 3121 | [79–501] | 3246 | [150–353] | 3238 | [115–474] |
| 3084 | [214–453] | 3122 | [79–501] | 3247 | [157–360] | 3239 | [62–292],[181–609], |
| 3085 | [61–255] | 3123 | [293–460] | 3248 | [217–381] |  | [405–590] |
| 3086 | [25–231] | 3124 | [69–296],[128–478], | 3249 | [212–370] | 3240 | [187–402] |
| 3087 | [144–320] |  | [315–479] | 3250 | [90–269] | 3287 | [16–282] |
| 3088 | [144–320] | 3125 | [69–296],[128–490], | 3251 | [90–314] | 3288 | [153–410] |
| 3089 | [144–320] |  | [315–491] | 3252 | [90–302],[184–483] | 3289 | [34–462],[120–344] |
| 3090 | [144–320] | 3126 | [12–203],[360–707] | 3253 | [90–269],[184–484] | 3290 | [34–186],[176–403] |
| 3091 | [144–320] | 3127 | [269–478],[333–503] | 3254 | [91–408] | 3291 | [34–186] |
| 3092 | [144–320] | 3128 | [165–407],[310–477] | 3255 | [22–339] | 3292 | [34–186],[176–403] |
| 3093 | [43–240] | 3129 | [72–443],[112–342] | 3256 | [31–252] | 3293 | [171–416] |
| 3094 | [253–411] | 3130 | [2–205] | 3257 | [31–189],[125–349] | 3294 | [138–296] |
| 3095 | [213–410] | 3131 | [135–299] | 3258 | [284–523],[303–533] | 3295 | [155–421] |
| 3096 | [17–484] | 3132 | [57–230] | 3259 | [85–396],[113–316] | 3296 | [67–306],[149–301] |
| 3097 | [208–423] | 3133 | [90–281],[300–509] | 3260 | [90–248] | 3297 | [33–329] |
| 3098 | [184–360] | 3134 | [84–275],[294–449] | 3261 | [10–213],[278–460] | 3298 | [26–331],[72–341] |
| 3099 | [159–431] | 3135 | [53–244],[263–418] | 3262 | [36–305] | 3299 | [50–199] |
| 3100 | [135–362] | 3136 | [84–281],[300–455] | 3263 | [131–466] | 3300 | [211–426] |
| 3101 | [209–373] | 3137 | [7–303],[95–250] | 3264 | [125–427],[312–461] | 3301 | [334–519] |
| 3102 | [96–425] | 3138 | [253–408] | 3265 | [146–334] | 3302 | [83–412] |
| 3149 | [292–558] | 3139 | [6–578] | 3266 | [164–346],[273–509] | 3303 | [204–362] |
| 3150 | [102–521] | 3140 | [141–377] | 3267 | [76–333] | 3304 | [142–300],[194–385] |
| 3151 | [99–476] | 3141 | [171–515] | 3268 | [183–383] | 3305 | [137–358] |
| 3152 | [26–277],[225–482] | 3142 | [92–253] | 3269 | [158–310] | 3306 | [152–430] |
| 3153 | [150–329] | 3143 | [185–346] | 3270 | [54–248],[187–414] | 3307 | [103–354] |
| 3154 | [142–417] | 3144 | [66–299] | 3271 | [33–239] | 3308 | [24–464] |
| 3155 | [202–474] | 3145 | [410–604] | 3272 | [67–285] | 3309 | [13–243] |
| 3156 | [160–381],[419–589] | 3146 | [85–291] | 3273 | [27–218] | 3310 | [62–268] |
| 3157 | [53–337] | 3147 | [205–486] | 3274 | [147–335] | 3311 | [101–286],[232–444] |
| 3158 | [36–251] | 3148 | [150–302] | 3275 | [146–433],[288–458] | 3312 | [362–562] |
| 3159 | [53–337] | 3195 | [63–389] | 3276 | [123–404],[265–474] | 3313 | [302–499] |
| 3160 | [122–382],[258–494] | 3196 | [204–377] | 3277 | [32–223],[105–473] | 3314 | [26–190],[298–471] |
| 3161 | [53–337] | 3197 | [5–226],[339–494] | 3278 | [268–420] | 3315 | [72–302] |
| 3162 | [165–341] | 3198 | [119–307] | 3279 | [284–448] | 3316 | [183–461] |
| 3163 | [9–263],[64–282] | 3199 | [50–226] | 3280 | [53–208] | 3317 | [172–351] |
| 3164 | [196–423],[233–445] | 3200 | [110–313] | 3281 | [128–376] | 3318 | [30–248] |
| 3165 | [167–490] | 3201 | [28–198] | 3282 | [13–255],[108–431] | 3319 | [312–530] |
| 3166 | [58–264],[254–418] | 3202 | [161–337] | 3283 | [245–421] | 3320 | [4–180] |
| 3167 | [17–202] | 3203 | [75–380] | 3284 | [45–197] | 3321 | [307–525] |
| 3168 | [117–299],[299–469] | 3204 | [101–415] | 3285 | [18–260],[272–466] | 3322 | [199–360] |
| 3169 | [101–265] | 3205 | [16–403] | 3286 | [83–250] | 3323 | [13–252],[216–449], |
| 3170 | [224–388] | 3206 | [154–396] | 3333 | [147–296] |  | [316–477] |
| 3171 | [124–321],[255–410] | 3207 | [129–320] | 3334 | [33–209],[104–316] | 3324 | [19–168] |
| 3172 | [557–736] | 3208 | [178–351] | 3335 | [268–429] | 3325 | [106–393] |
| 3173 | [128–322] | 3209 | [173–421] | 3336 | [95–385],[153–392] | 3326 | [27–242] |
| 3174 | [63–356] | 3210 | [70–297] | 3337 | [100–438] | 3327 | [259–480] |
| 3175 | [93–266],[235–414] | 3211 | [102–500],[266–493] | 3338 | [16–255] | 3328 | [249–401] |
| 3176 | [70–300] | 3212 | [4–153],[149–322] | 3339 | [75–239] | 3329 | [50–208],[217–417] |
| 3177 | [279–434] | 3213 | [147–335] | 3340 | [5–157] | 3330 | [50–208],[217–471] |
| 3178 | [30–422] | 3214 | [100–294] | 3341 | [51–476] | 3331 | [199–420] |
| 3179 | [161–364] | 3215 | [69–359] | 3342 | [3–185] | 3332 | [124–354],[236–391] |
| 3180 | [51–233],[170–373] | 3216 | [100–294] | 3343 | [120–464] | 3379 | [13–282],[138–344] |
| 3181 | [112–282] | 3217 | [285–521] | 3344 | [115–402] | 3380 | [147–347] |
| 3182 | [52–282] | 3218 | [36–491] | 3345 | [154–402] | 3381 | [172–462] |
| 3183 | [12–266] | 3219 | [89–358] | 3346 | [184–336],[346–507], | 3382 | [302–577] |
| 3184 | [75–260] | 3220 | [100–294] |  | [351–503] | 3383 | [132–338] |
| 3185 | [151–414] | 3221 | [119–460] | 3347 | [184–348] | 3384 | [48–461] |
| 3186 | [35–193],[135–407], | 3222 | [29–211] | 3348 | [74–247] | 3385 | [58–246],[156–419] |
|  | [274–537] | 3223 | [160–492] | 3349 | [357–509] | 3386 | [110–277] |

TABLE I-continued

(Positions of all ORFs)

| Seq Id No. | Positions of Open Reading Frame(s) | Seq Id No. | Positions of Open Reading Frame(s) | Seq Id No. | Positions of Open Reading Frame(s) | Seq Id No. | Positions of Open Reading Frame(s) |
|---|---|---|---|---|---|---|---|
| 3350 | [165–317] | 3387 | [151–318] | 3469 | [191–436] | 3504 | [54–257] |
| 3351 | [127–444] | 3388 | [339–542] | 3470 | [152–451] | 3505 | [15–218],[241–408] |
| 3352 | [97–444] | 3389 | [22–345],[374–565] | 3517 | [21–215] | 3506 | [1–153] |
| 3353 | [217–450] | 3390 | [110–277] | 3518 | [452–727],[462–665] | 3507 | [6–206] |
| 3354 | [291–491] | 3391 | [338–487] | 3519 | [364–630] | 3508 | [62–250] |
| 3355 | [291–491] | 3392 | [64–393] | 3520 | [240–434] | 3509 | [89–313] |
| 3356 | [141–344] | 3393 | [37–360] | 3521 | [291–494] | 3510 | [87–242] |
| 3357 | [211–384] | 3394 | [176–355] | 3522 | [93–332] | 3511 | [48–272] |
| 3358 | [152–430] | 3395 | [42–452],[244–426] | 3523 | [134–382] | 3512 | [204–476] |
| 3359 | [3–176],[166–411] | 3396 | [66–311] | 3524 | [43–348] | 3513 | [6–209],[307–459] |
| 3360 | [87–344] | 3397 | [161–373] | 3525 | [150–356] | 3514 | [46–348] |
| 3361 | [72–254] | 3398 | [222–392] | 3526 | [200–370] | 3515 | [17–214] |
| 3362 | [91–315] | 3399 | [75–236] | 3527 | [195–389],[295–579] | 3516 | [34–207] |
| 3363 | [91–315] | 3400 | [82–246],[86–256] | 3528 | [147–482] | 3563 | [69–302] |
| 3364 | [91–315] | 3401 | [63–215],[118–402] | 3529 | [214–435] | 3564 | [136–294] |
| 3365 | [19–243] | 3402 | [138–326] | 3530 | [105–254] | 3565 | [101–370] |
| 3366 | [60–284],[337–516] | 3403 | [6–161],[211–366] | 3531 | [200–376] | 3566 | [101–370] |
| 3367 | [26–250] | 3404 | [1–234] | 3532 | [4–171],[149–496],[313–510] | 3567 | [172–360] |
| 3368 | [202–405],[408–566] | 3405 | [196–354],[281–508],[354–506] | 3533 | [56–280],[99–344] | 3568 | [316–492] |
| 3369 | [237–440] | | | | | 3569 | [378–554] |
| 3370 | [172–399],[218–367] | 3406 | [222–572],[505–726] | 3534 | [138–347] | 3570 | [7–171] |
| 3371 | [176–475],[222–371] | 3407 | [22–210],[290–457] | 3535 | [56–244] | 3571 | [341–517] |
| 3372 | [173–337],[219–383] | 3408 | [10–348] | 3536 | [55–234] | 3572 | [338–514] |
| 3373 | [201–365],[247–414] | 3409 | [151–423] | 3537 | [153–326] | 3573 | [131–310],[267–425] |
| 3374 | [237–440] | 3410 | [14–184] | 3538 | [76–321],[282–461] | 3574 | [5–244] |
| 3375 | [203–511],[249–398] | 3411 | [55–261] | 3539 | [57–236],[211–390] | 3575 | [185–361] |
| 3376 | [201–545],[247–396] | 3412 | [113–460] | 3540 | [237–485] | 3576 | [34–207] |
| 3377 | [200–364],[246–422] | 3413 | [39–191],[94–285] | 3541 | [128–304] | 3577 | [81–269] |
| 3378 | [122–496],[168–317] | 3414 | [71–223] | 3542 | [240–437] | 3578 | [255–404] |
| 3425 | [96–425] | 3415 | [157–342],[215–430] | 3543 | [202–405] | 3579 | [16–195],[62–307] |
| 3426 | [98–340] | 3416 | [19–171] | 3544 | [184–366] | 3580 | [109–285] |
| 3427 | [98–442] | 3417 | [1–507],[98–295] | 3545 | [34–207] | 3581 | [91–426],[161–331] |
| 3428 | [111–341] | 3418 | [50–277] | 3546 | [105–398] | 3582 | [318–476] |
| 3429 | [201–350] | 3419 | [117–371] | 3547 | [37–402] | 3583 | [91–315] |
| 3430 | [618–782] | 3420 | [125–358] | 3548 | [74–433] | 3584 | [217–510],[293–451] |
| 3431 | [13–285] | 3421 | [174–458] | 3549 | [1–156] | 3585 | [14–304] |
| 3432 | [22–294] | 3422 | [98–571] | 3550 | [59–247],[207–401] | 3586 | [148–396],[165–389] |
| 3433 | [152–424] | 3423 | [98–421] | 3551 | [89–250],[186–428] | 3587 | [28–300] |
| 3434 | [263–442] | 3424 | [43–198],[183–386] | 3552 | [135–344] | 3588 | [170–337],[334–558] |
| 3435 | [218–460],[376–540] | 3471 | [37–405],[344–511] | 3553 | [21–494] | 3589 | [348–614],[410–622] |
| 3436 | [284–469] | 3472 | [156–347] | 3554 | [34–207] | 3590 | [4–177] |
| 3437 | [63–284] | 3473 | [78–242],[287–436] | 3555 | [185–448] | 3591 | [97–255],[255–458] |
| 3438 | [284–526] | 3474 | [44–256] | 3556 | [185–448] | 3592 | [72–314],[116–280],[296–532],[348–506] |
| 3439 | [1–222] | 3475 | [13–198],[179–328] | 3557 | [34–201] | | |
| 3440 | [155–640] | 3476 | [27–266] | 3558 | [16–303] | 3593 | [90–464] |
| 3441 | [34–207] | 3477 | [37–276] | 3559 | [287–460] | 3594 | [84–404] |
| 3442 | [16–285] | 3478 | [239–475] | 3560 | [159–344] | 3595 | [255–461] |
| 3443 | [89–319],[280–504] | 3479 | [173–334] | 3561 | [30–347],[352–540] | 3596 | [175–342] |
| 3444 | [158–322] | 3480 | [253–414] | 3562 | [40–204] | 3597 | [108–539] |
| 3445 | [70–261] | 3481 | [7–207] | 3608 | [11–220],[174–353] | 3598 | [130–327],[135–419],[512–775] |
| 3446 | [76–288] | 3482 | [183–545] | 3609 | [326–478],[418–627] | | |
| 3447 | [79–360],[171–326] | 3483 | [137–337] | 3610 | [242–475] | 3599 | [265–924],[500–658] |
| 3448 | [73–402],[88–376] | 3484 | [152–370] | 3611 | [14–181] | 3600 | [80–292],[316–468] |
| 3449 | [247–474] | 3485 | [117–290] | 3612 | [159–566] | 3601 | [73–237] |
| 3450 | [102–395] | 3486 | [89–307] | 3613 | [129–344] | 3602 | [95–265] |
| 3451 | [31–231] | 3487 | [89–553] | 3614 | [93–350] | 3603 | [196–402] |
| 3452 | [13–180] | 3488 | [89–307] | 3615 | [137–406] | 3604 | [58–255] |
| 3453 | [13–180] | 3489 | [256–411] | 3616 | [120–335],[320–469] | 3605 | [50–466] |
| 3454 | [89–244] | 3490 | [107–454] | 3617 | [189–353] | 3606 | [75–443] |
| 3455 | [175–498],[350–538] | 3491 | [120–359],[338–493],[399–560] | 3618 | [123–575] | 3607 | [9–434],[178–486] |
| 3456 | [248–406] | | | 3619 | [33–296] | 3654 | [324–554] |
| 3457 | [248–553] | 3492 | [119–358],[337–492] | 3620 | [48–416] | 3655 | [30–347],[209–445] |
| 3458 | [313–471] | 3493 | [205–411] | 3621 | [82–300] | 3656 | [46–348] |
| 3459 | [114–353] | 3494 | [204–419] | 3622 | [133–282] | 3657 | [46–348] |
| 3460 | [118–330] | 3495 | [213–521],[283–456] | 3623 | [28–366] | 3658 | [145–441] |
| 3461 | [195–398],[232–462] | 3496 | [109–264] | 3624 | [117–476] | 3659 | [180–464] |
| 3462 | [82–252] | 3497 | [147–359],[160–327] | 3625 | [37–393] | 3660 | [179–385] |
| 3463 | [300–461] | 3498 | [186–515] | 3626 | [51–239] | 3661 | [180–410] |
| 3464 | [112–303] | 3499 | [56–328],[162–320] | 3627 | [36–452] | 3662 | [76–252] |
| 3465 | [43–342] | 3500 | [366–593] | 3628 | [1–486] | 3663 | [295–510],[317–532],[674–865],[711–1043] |
| 3466 | [530–742] | 3501 | [69–239],[205–510] | 3629 | [94–309],[524–835] | | |
| 3467 | [10–189] | 3502 | [112–276] | 3630 | [121–270],[161–355] | 3664 | [153–416] |
| 3468 | [303–503] | 3503 | [119–277] | 3631 | [123–482] | 3665 | [177–380] |

TABLE I-continued (Positions of all ORFs)

| Seq Id No. | Positions of Open Reading Frame(s) | Seq Id No. | Positions of Open Reading Frame(s) |
|---|---|---|---|
| 3632 | [29–271],[192–476] | 3666 | [152–415] |
| 3633 | [208–402] | 3667 | [177–383] |
| 3634 | [4–156],[48–209] | 3668 | [70–333] |
| 3635 | [82–231],[234–404] | 3669 | [177–380] |
| 3636 | [110–292],[192–389] | 3670 | [77–364] |
| 3637 | [21–257],[227–466] | 3671 | [252–401] |
| 3638 | [112–390] | 3672 | [145–432] |
| 3639 | [215–427] | 3673 | [252–401] |
| 3640 | [16–291] | 3674 | [30–242],[166–318] |
| 3641 | [19–294] | 3675 | [252–401] |
| 3642 | [16–291] | 3676 | [96–299] |
| 3643 | [174–365] | 3677 | [65–340] |
| 3644 | [250–429] | 3678 | [188–343],[219–455] |
| 3645 | [37–207] | 3679 | [72–287] |
| 3646 | [4–153] | 3680 | [387–644] |
| 3647 | [246–482],[250–420] | 3681 | [61–354] |
| 3648 | [53–253] | 3682 | [2–181] |
| 3649 | [197–367] | 3683 | [73–306] |
| 3650 | [301–480] | 3684 | [261–479] |
| 3651 | [267–488] | 3685 | [34–183],[228–425] |
| 3652 | [150–398],[319–522] | 3686 | [44–232] |
| 3653 | [7–216] | 3687 | [95–250] |
| 3699 | [242–640] | 3688 | [130–318] |
| 3700 | [60–212] | 3689 | [369–521] |
| 3701 | [95–391] | 3690 | [62–493],[192–350] |
| 3702 | [131–307] | 3691 | [42–203],[301–483] |
| 3703 | [92–331] | 3692 | [70–276] |
| 3704 | [92–433] | 3693 | [49–213],[117–458] |
| 3705 | [31–204],[110–277] | 3694 | [49–234],[117–314] |
| 3706 | [142–492] | 3695 | [132–284] |
| 3707 | [34–207] | 3696 | [63–260] |
| 3708 | [76–396] | 3697 | [110–328] |
| 3709 | [76–396] | 3698 | [106–366] |
| 3710 | [99–326] | 3745 | [51–233],[260–427] |
| 3711 | [161–313] | 3746 | [84–371] |
| 3712 | [141–317] | 3747 | [54–350],[160–477] |
| 3713 | [176–352] | 3748 | [110–397] |
| 3714 | [139–366] | 3749 | [96–341],[223–381] |
| 3715 | [148–435] | 3750 | [25–348] |
| 3716 | [40–213],[386–703] | 3751 | [25–348] |
| 3717 | [113–430] | 3752 | [141–353] |
| 3718 | [86–403] | 3753 | [173–382] |
| 3719 | [48–503] | 3754 | [211–414],[236–394] |
| 3720 | [48–341],[331–627] | 3755 | [126–392] |
| 3721 | [194–400] | 3756 | [136–366] |
| 3722 | [122–451] | 3757 | [31–279] |
| 3723 | [90–305],[151–426] | 3758 | [81–278],[152–457] |
| 3724 | [174–383],[187–429] | 3759 | [165–485] |
| 3725 | [95–310] | 3760 | [105–281] |
| 3726 | [31–483],[369–521] | 3761 | [225–401] |
| 3727 | [360–557],[376–579] | 3762 | [144–329] |
| 3728 | [141–353] | 3763 | [116–445] |
| 3729 | [88–318] | 3764 | [124–453] |
| 3730 | [6–185],[161–394] | 3765 | [7–411],[338–502] |
| 3731 | [56–388],[300–449] | 3766 | [249–434] |
| 3732 | [111–440],[352–501] | 3767 | [165–395] |
| 3733 | [128–394] | 3768 | [141–353] |
| 3734 | [105–332],[289–444] | 3769 | [169–348],[290–460] |
| 3735 | [94–366] | 3770 | [215–397] |
| 3736 | [141–353] | 3771 | [364–519] |
| 3737 | [139–294],[333–497] | 3772 | [88–237] |
| 3738 | [9–173] | 3773 | [2–166] |
| 3739 | [67–354] | 3774 | [390–542],[828–1022] |
| 3740 | [225–389] | 3775 | [134–313] |
| 3741 | [191–376] | 3776 | [28–642],[344–628],[703–852] |
| 3742 | [345–530] | | |
| 3743 | [13–579],[21–203] | 3777 | [159–362] |
| 3744 | [54–236],[263–484] | 3778 | [249–428] |
| 3791 | [155–316] | 3779 | [96–248],[137–361] |
| 3792 | [163–369] | 3780 | [96–248],[137–361] |
| 3793 | [122–328] | 3781 | [110–466] |
| 3794 | [258–452] | 3782 | [12–329],[59–466] |
| 3795 | [108–314] | 3783 | [133–300] |
| 3796 | [102–254],[143–424],[283–432] | 3784 | [123–323] |
| 3797 | [77–283],[317–472] | 3785 | [200–382] |
| 3798 | [77–283] | 3786 | [175–396] |
| 3799 | [107–313] | 3787 | [71–502] |
| 3800 | [96–248],[137–301] | 3788 | [8–175],[294–491] |
| 3801 | [92–448] | 3789 | [18–266] |
| 3802 | [92–448] | 3790 | [99–281] |
| 3803 | [116–577],[553–906],[788–985] | 3837 | [92–484],[351–548] |
| | | 3838 | [169–429] |
| 3804 | [142–354] | 3839 | [3–224],[220–372] |
| 3805 | [34–207] | 3840 | [3–224],[220–372] |
| 3806 | [249–410] | 3841 | [165–389] |
| 3807 | [146–364] | 3842 | [143–370] |
| 3808 | [208–366] | 3843 | [100–303] |
| 3809 | [97–516] | 3844 | [34–201] |
| 3810 | [35–490] | 3845 | [5–181] |
| 3811 | [162–512] | 3846 | [139–300],[318–491],[376–591],[533–760] |
| 3812 | [87–242] | 3847 | [81–323] |
| 3813 | [11–361] | 3848 | [132–317],[317–469] |
| 3814 | [17–445] | 3849 | [130–402] |
| 3815 | [11–190] | 3850 | [129–401] |
| 3816 | [138–344] | 3851 | [129–401] |
| 3817 | [93–350] | 3852 | [130–402] |
| 3818 | [165–395] | 3853 | [130–417] |
| 3819 | [181–438],[365–514] | 3854 | [129–401] |
| 3820 | [181–438] | 3855 | [130–417] |
| 3821 | [96–260] | 3856 | [131–403] |
| 3822 | [350–508] | 3857 | [131–403] |
| 3823 | [140–352] | 3858 | [131–403] |
| 3824 | [240–389] | 3859 | [129–416] |
| 3825 | [33–338],[317–487] | 3860 | [134–379] |
| 3826 | [68–355],[396–602] | 3861 | [99–356] |
| 3827 | [141–353] | 3862 | [140–421] |
| 3828 | [189–353] | 3863 | [17–166] |
| 3829 | [98–262] | 3864 | [11–220],[58–210] |
| 3830 | [220–378] | 3865 | [100–264],[269–430] |
| 3831 | [8–268] | 3866 | [273–428] |
| 3832 | [219–410] | 3867 | [115–348],[197–466] |
| 3833 | [195–413],[310–462] | 3868 | [281–445] |
| 3834 | [327–509] | 3869 | [240–440] |
| 3835 | [42–335] | 3870 | [274–492] |
| 3836 | [8–295] | 3871 | [12–170] |
| 3882 | [25–480],[293–484] | 3872 | [240–440] |
| 3883 | [24–197] | 3873 | [62–364],[273–458] |
| | | 3874 | [276–440],[443–613] |
| | | 3875 | [4–255] |
| | | 3876 | [18–176],[23–232] |
| | | 3877 | [147–359] |
| | | 3878 | [111–335] |
| | | 3879 | [114–335],[281–463] |
| | | 3880 | [2–217],[364–624] |
| | | 3881 | [82–249],[285–458] |

TABLE II (Tiling path)

| Seq Id No. | Positions of biological 5'ESTs |
|---|---|
| 26 | 1–494;1–380;1–434;1–494;1–557;1–455 |
| 28 | 1–467;3–323;3–487;3–470 |
| 30 | 1–368;1–135 |
| 32 | 1–177;45–519 |
| 33 | 1–186;1–471;1–479;40–259 |
| 36 | 1–454;247–358 |
| 38 | 1–294;4–486;4–486;4–491;12–107;12–107;12–107;12–107;12–107;12–105;12–105;12–107;12–107;12–107;12–107;12–107;12– |

TABLE II-continued (Tiling path)

| Seq Id No. | Positions of biological 5'ESTs |
|---|---|
|  | 105;12–104;12–105;12–107;12–107;12–105;12–107;12–107;12–107;12–107;12–105;12–105;12–105;12–105;12–107;12–105;12–107;12–94;12–94;12–105;12–105;12–105;12–105;12–105;12–107;12–94;12–107;12–105;12–423;12–105;12–105;12–107;12–107;12–105;12–105;12–105;12–105;12–105;12–107;12–107;12–107;12–105;12–105;32–490 |
| 39 | 1–541;1–424;177–678 |
| 40 | 1–249;1–177;1–176;1–176;19–144 |
| 42 | 1–224;1–320;1–241;1–425;1–241;1–392 |
| 43 | 1–483;1–489;1–450;1–477;2–376;2–445;2–478;2–434;2–424;2–495;2–442;2–498;2–234;2–460;2–404;2–484;2–64;2–473;2–419;2–414;2–277;3–449;3–438;12–442;12–412;39–512;39–348;39–502;39–481 |
| 44 | 1–234;1–296;1–339;1–245;1–294;1–326 |
| 45 | 1–324;38–528;38–504;46–496;46–499;47–502;47–511;47–511;47–485;47–464;48–433;48–490;48–544 |
| 48 | 1–535;3–479;30–435 |
| 49 | 1–413;7–432 |
| 51 | 1–293;1–373;1–464;1–465 |
| 54 | 1–491;4–505 |
| 55 | 1–546;1–453;1–441;1–446;1–421 |
| 56 | 1–503;1–485;1–276;1–367;1–507 |
| 63 | 1–343;1–145;1–343 |
| 64 | 1–225;1–277;1–277 |
| 65 | 1–172;1–174;1–172;1–174;1–174;1–170;1–171;1–174;1–174;1–172;1–174;1–164;1–174;1–174;1–174;1–174 |
| 67 | 1–478;1–476 |
| 68 | 1–323;1–323 |
| 70 | 1–473;1–406 |
| 71 | 1–329;1–329;1–329 |
| 72 | 1–488;3–476;3–453;3–479;3–426;3–356;3–373;4–445;4–461 |
| 74 | 1–415;1–417;1–392 |
| 76 | 1–360;1–486 |
| 78 | 1–429;6–461;12–341;12–395;13–432;13–793;15–458;18–436;18–73;18–313;18–459;18–428 |
| 82 | 1–92;15–570;15–385;15–418;15–424 |
| 83 | 1–203;1–468;1–442;1–105 |
| 87 | 1–440;130–616;194–674 |
| 88 | 1–78;1–402 |
| 90 | 1–135;1–474;1–210;1–428;1–443 |
| 91 | 1–388;46–118;49–284;51–464;56–402;56–397;56–411;71–217;71–470;71–390;71–463;74–463;77–415;84–470;85–470;85–425;85–399;85–565;85–235;85–463;85–401;85–291;85–409;85–303;85–392;85–416;85–569;86–399;86–405;90–460;95–236 |
| 92 | 1–479;1–399;3–499;3–484;3–502;3–277;3–381;32–482;75–575;75–568;75–551;75–571;75–523;75–570;76–569;94–368;128–586;137–553 |
| 94 | 1–452;1–350 |
| 95 | 1–323;1–326 |
| 97 | 1–462;1–480;59–480;59–475;59–431;59–465;59–576;59–517;59–576;59–557;59–483;59–536;59–498;60–672 |
| 99 | 1–459;1–482;1–466;3–418 |
| 100 | 1–479;1–498 |
| 101 | 1–480;1–214;1–504 |
| 103 | 1–351;1–192 |
| 108 | 1–274;1–453 |
| 109 | 1–500;1–488 |
| 110 | 1–570;19–481 |
| 111 | 1–476;79–570;106–584;06–520;106–233;106–565;106–570;106–570;106–550;106–513;106–207;106–526 |
| 112 | 1–225;1–417;1–370 |

TABLE II-continued (Tiling path)

| Seq Id No. | Positions of biological 5'ESTs |
|---|---|
| 114 | 1–494;1–480;1–423;1–451;1–365;1–355;1–451;1–525;1–511 |
| 115 | 1–471;1–480;1–478 |
| 117 | 1–382;75–623 |
| 118 | 1–462;1–481;1–451;1–497;1–436;1–456 |
| 119 | 1–542;1–436;1–537;1–521;1–465 |
| 120 | 1–453;1–441;1–411;1–229 |
| 123 | 1–465;1–407 |
| 125 | 1–371;1–493;1–427 |
| 127 | 1–463;1–70 |
| 128 | 1–495;1–491;1–494;7–498;7–493;7–515;7–495;9–495;9–494;9–440;10–498;10–554;10–414;10–109;11–466 |
| 132 | 1–477;29–367 |
| 134 | 1–422;1–421;1–327;1–421;1–412 |
| 135 | 1–452;1–498;1–528;1–528;6–490;6–452;6–481;6–490;6–420;6–173;6–516;6–498;6–461;6–516;6–464;6–516;6–476;6–515;6–463;6–490;6–452;6–410;6–497;6–284;6–476;6–464;6–464;6–496;6–464;6–452;6–462;6–486;6–531;6–461;6–515;6–492;6–507;6–515;6–516;6–531;6–549;6–548;6–486;6–533;6–450;6–452;6–464;6–507;6–530;6–531;6–462;6–516;6–516;6–498;6–507;6–451;6–481;6–484;6–488;6–478;6–452;6–481;6–488;6–569;6–532;7–485;7–488;7–534;7–461;7–403;7–487;7–530;7–484;7–419;7–450;8–437;10–528;10–477;10–485;11–420;15–452;15–360;22–539;22–537;22–490;23–498;23–481;23–539;26–451;31–524;31–528;31–464;31–527;31–552;31–452;31–538;31–481;31–507;31–535;31–464;31–516;31–360;31–569;34–553;34–530;34–539;34–570;34–516;34–532;34–537;34–516;34–553;34–528;34–464;35–516;35–534;35–464;35–255;35–420;35–552;35–475;35–528;35–516;35–498;35–557;35–498;35–516;35–452;35–516;35–498;35–534;35–516;35–548;35–568;35–516;36–451;38–528;38–498;39–516;44–314;56–528;56–547;56–481;56–561;56–515;56–548;56–384;56–563;56–452;56–452;56–564;56–549;56–539;56–552;56–536;56–552 |
| 136 | 1–416;1–101 |
| 137 | 1–495;1–466;1–461;1–473;1–390;1–407;1–346;1–502 |
| 138 | 1–332;1–495 |
| 139 | 1–444;1–434;1–441;1–410;1–443;1–387;1–438;1–467;1–468;1–437;283–646 |
| 140 | 1–497;1–459;1–481;1–490;1–462;1–492;1–252;1–432;19–136 |
| 144 | 1–446;1–416;1–385;1–524 |
| 146 | 1–448;40–525 |
| 149 | 1–123;9–501 |
| 150 | 1–85;1–320 |
| 151 | 1–439;1–370;25–512;25–465 |
| 152 | 1–487;1–497;1–495;1–272 |
| 153 | 1–501;27–458;27–456;27–458;27–458;27–458 |
| 155 | 1–497;1–376;1–455;1–542;1–443;1–434;1–486 |
| 158 | 1–421;1–515;1–587;1–544;1–283 |
| 159 | 1–481;1–130;1–466;1–490;1–481;1–498;1–423;1–453;1–489;1–480;1–499;1–486;1–495;1–466;1–488;1–473;1–199;1–485;1–492;1–497;1–485;1–488;1–498;1–290;1–533;1–500;1–502;1–495;1–464;1–498;1–514;1–499;1–473;1–507 |
| 160 | 1–509;73–470 |
| 162 | 1–314;236–721 |
| 165 | 1–594;1–466;29430;29–430;29–434;29–434;59–512 |
| 167 | 1–82;48–260;50–425;50–481 |

TABLE II-continued (Tiling path)

| Seq Id No. | Positions of biological 5'ESTs |
|---|---|
| 170 | 1–75;13–510;13–542 |
| 172 | 1–369;1–450;1–419 |
| 173 | 1–376;1–352;1–466;1–94;1–460;3–466;3–469;3–434;3–243;3–468;3–448;4–4 11;15–447;19–597;38–599;38–316;38–404;40–436;65–535;67–377 |
| 174 | 1–355;29–504;29–444;29–514;29–444;29–513 |
| 175 | 1–458;1–446;1–125;38–111 |
| 176 | 1–86;1–501;1–448;1–477;1–477;1–95;–185;1–462 |
| 178 | 1–362;–541;1–300 |
| 179 | 1–303;1–283;1–303;1–172;1–79;1–294;1–293 |
| 180 | 1–417;1–466;1–504;1–475;1–460 |
| 181 | 1–508;1–496;1–542;4–429;5–400;5–102;11–319;11–337;11–526;11–436;31–508;31–240;31–353;31–427;31–353;31–499;31–526;31–444;31–434;31–441;31–461;31–538;31–526;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–132;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–135;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;35–136;3 |
| 182 | 1–488;1–403;1–314;1–456;1–472;1–509;1–464;1–488;1–461 |
| 185 | 1–470;138–562 |
| 186 | 1–435;1–485 |
| 187 | 1–419;1–521;8–486 |
| 190 | 1–516;1–374;1–408;1–552;1–516;1–501 |
| 199 | 1–451;43–492;45–523 |
| 200 | 1–275;1–433;1–456;1–448;1–450;1–180;1–459;1–292;1–460;1–409;1–452;1–393;1–119;1–292;1–400;1–245;1–334;233–567;250–732;256–696;280–729;280–745;280–703;280–733;280–774;280–611;281–432;281–625;281–453;284–694;284–651;285–651;289–643;290–561;290–554;290–736;291–457;297–643;303–719;303–703;303–691;308–749;308–651;308–576;308–633;308–651;308–475;308–802;314–637;317–636;349–829 |
| 203 | 1–451;1–412 |
| 204 | 1–481;1–505 |
| 206 | 1–372;1–483;1–525;210–701 |
| 207 | 1–105;60–130;87–499 |
| 209 | 1–365;1–452;4–422;4–458;4–169 |
| 212 | 1–452;1–452 |
| 217 | 1–442;8–443;8–443;8–395;8–443;8–96;8–461;8–311;8–431;8–387;8–395;8–443 |
| 220 | 1–480;17–420 |
| 224 | 1–410;19–491;19–492 |
| 225 | 1–564;1–486 |
| 227 | 1–480;1–499;1–422;1–435;1–299;1–416;1–367;1–523;1–356;1–355;1–358;1–508;1–309;1–524;1–484 |
| 228 | 1–283;1–269;1–283 |
| 229 | 1–450;1–430;1–440;1–439 |
| 231 | 1–308;70–351 |
| 232 | 1–454;24–482;28–454;28494;28–522;28–433;29–439;29–485;33–194;35–433;61–406 |
| 235 | 1–269;12–445;12–481;58–594;58–562 |
| 236 | 1–400;1–400 |
| 237 | 1–481;1–356 |
| 238 | 1–365;25–522;25–486;25–516;51–517;51–663;51–555 |
| 239 | 1–508;6–540;6–453;12–299 |
| 241 | 1–479;10–429 |
| 242 | 1–461;1–516 |
| 243 | 1–504;1–485;1–491;1–446;1–427;1–495;1–498;1–225;1–400;1–513;–523;1–457;1–556;1–262;1–498;1–403;1–453;1–558 |
| 248 | 1–436;1–473;1–464 |
| 249 | 1–313;1–322;1–322 |
| 252 | 1–425;1–578 |
| 253 | 1–466;1–477;19–512;19–502;19–397;414–672 |
| 254 | 1–442;1–479 |
| 259 | 1–168,1–433 |
| 260 | 1–64;10–467;10–332;17–256;17–459;17–:451 |
| 261 | 1–64;10–485;10–508;10–332;10–500;17–456;17–459;17–451 |
| 263 | 1–416;24–492;24–404;24–286;24–397;24–503;24–478 |
| 264 | 1–225;1–141;2–388;2–142;2–446;2–297;2–475;2–451;2–493;2–571;17–230;7–319 |
| 265 | 1–424;–478;1–171;1–176;1–497;1–383;1–382;1–438 |
| 266 | 1–472;1–552;1–468 |
| 268 | 1–104;1–467;1–467;1–141;1–529;88–588;88–573;88–287;88–545;88–599;88–471;88–579;88–598;88–578;88–554;88–531;88–558;112–477 |
| 271 | 1–477;219–739;219–705;219–628 |
| 272 | 1–135;1–135;2–475;17–418 |
| 273 | 1–264;1–449 |
| 275 | 1–65;29–416;29–374;29–542;29–367;29–420;29–434 |
| 277 | 1–417;1–333;1–349;1–407;1–41 7;1–484 |
| 279 | 1–426;1–511;1–321 |
| 280 | 1–91;1–494;2–82;22–84;23–499;47–100;51–456 |
| 283 | 9–219;9–337;12–276 |
| 284 | 1–473;1–431;1–476;1–298;1–199;1–466;1–474;1–489;1–449;1–420 |
| 285 | 1–426;1–466 |
| 287 | 1–367;32–609;32–525;32–477;32–466 |
| 292 | 1–333;1–281;1–671 |
| 293 | 1–453;32–512;32–484 |
| 297 | 1–496;1–430 |
| 298 | 1–492;1–57;1–369;1–375;1–483;1–363;1–424;1–458 |
| 300 | 1–246;1–248 |
| 301 | 1–455;1–489;1–370 |
| 302 | 1–483;1–195;19–413 |
| 303 | 1–345;6–446;28–496 |
| 304 | 1–491;1–495;1–473;1–361;1–312;1–391;1–469;1–473;1–497;1–541;3–455;3–454;3–365;3–477;3–397;6–572;6–428;6–477;44–497;44–539;44–537;44–501;44–469;44–547;44–456;44–521;44–518;44–473;44–553;45–566;45–558;45–302;45–454;83–571;83–577;83–578;83–560;83–590;83–549;83–566;112–622;112–571 |

TABLE II-continued

(Tiling path)

| Seq Id No. | Positions of biological 5'ESTs |
|---|---|
| 305 | 1–466;1–462;1–469;1–489;1–522;1–447;9–133 |
| 306 | 1–472;1–479;15–500;15–481;15–239 |
| 313 | 1–494;1–434;1–444;1–509;1–471;4–469;72–570 |
| 318 | 1–175,1–410,1–180;1–434;2–482;2–454;36–518;36–557;36–482;36–188;36–483 |
| 319 | 1–587;1–451 |
| 320 | 1–239;6–444;6–413 |
| 324 | 1–463;1–302;1–495;1–496 |
| 328 | 1–427;15–503;15–450;15–432;15–430;15–515;15–461;15–280 |
| 330 | 1–422;1–543;70–520 |
| 337 | 1–638;1–344 |
| 338 | 1–562;52–474;52–474;52–472 |
| 341 | 1–418;–244,4–475;4–302;34–487 |
| 342 | 1–460;3–451 |
| 344 | 1–478;4–264;4–378 |
| 346 | 1–481;1–476;1–537;1–444;1–378;1–423;1–475;1–502 |
| 347 | 1–461;1–461;7–488 |
| 348 | 1–470;15–352 |
| 349 | 1–384;1–395;63–550;63–509;67–564 |
| 356 | 1–465;29–429;29–429;29–433;29–433;29–522;59–511 |
| 361 | 1–448;2–491;21–223;21–737;21–392 |
| 364 | 1–137;1–441;1–474;1–470;1–322;1–473;1–425;1–413;2–488 |
| 365 | 1–82;48–551;48–525;48–525;48–571;48–530;48–260;48–515;48–475;48–535;48–549;48–531;48–406;48–542;48–597;48–536;48–503;48–527;48–559;48–496;48–519;48–531;48–397;48–541;48–593;48–589;48–556;48–556;48–53;48–535;49–532 |
| 368 | 1–412;1–391;1–381 |
| 370 | 1–342;1–466;1–352;1–257;1–220;1–365;8–426;50–367;50–488;89–513 |
| 376 | 1–506;1–237;28–524;28–473 |
| 380 | 1–449;1–495 |
| 381 | 1–530;1–431 |
| 383 | 1–463;1–410;1–379;1–569 |
| 387 | 1–413;1–217;1–497;1–217;1–418;1–122;1–490;1–486 |
| 396 | 1–332;1–450;3–326;3–449;3–401;3–252;3–297 |
| 407 | 1–473;1–510 |
| 418 | 1–400;1–507;1–422;1–328 |
| 426 | 1–324;1–324;1–320;1–324;1–320;1–320;1–324;1–320;1–324;1–324;1–274;1–324;1–324;1–324;1–321;1–324;1–320;1–324;1–324 |
| 427 | 1–469;1–480;1–480 |
| 439 | 1–333;32–428;32–352;32–341 |
| 440 | 1–384;1–481;1–388;1–537 |
| 449 | 1–420;1–481;1–503;1–483 |
| 451 | 1–506;1–507 |
| 459 | 1–453,11–492;11–447;11–450;11–431;11–517 |
| 460 | 1–411;1–475 |
| 467 | 1–116;5–480 |
| 470 | 1–398;1–478 |
| 472 | 1–510;1–437;40–527;40–405 |
| 473 | 1–469;1–378;1–460;66–550 |
| 480 | 1–505;1–465;3–464 |
| 504 | 1–358;7–489 |
| 513 | 1–470;1–137 |
| 521 | 1–461;1–479;1–468 |
| 561 | 1–498;1–504;4–461;18–437 |
| 562 | 1–470;1–76;1–488;1–483 |
| 564 | 1–465;–480;–481 |
| 566 | 1–321;1–488;1–381;1–429;1–391;1–369;1–244;1–376;1–458;1–355;1–444;1–458;1–433;1–490;1–177;1–437;1–442;1–345;1–499;1–436;1–458;1–367;1–369;1–490;1–509;1–371;–493;1–183;1–207;1–466;1–497;1–431;1–363;1–443;1–480;1–261;1–424;1423;1–391;1–269;1–386;1–390;1–479;1–489 |
| 570 | 1–473;1–486 |
| 571 | 1–426;94–583;94–601;94–523;94–566 |
| 573 | 1–474;1–352;1–496 |
| 574 | 1–467;1–496;1–288 |
| 575 | 1–449;1–406 |
| 578 | 1–387;1–504;1–456;1–455;1–480;1–484;1–456;1–125;1–407;225–643 |
| 579 | 1–472;1–455;1–212;1–473;1–161;1–413;1–467;1–495;1–435;1–383;1–432;1–340;1–420;1–420;1–440;1–388;1–430;1–453;1–510;1–510;1–433;1–279;1–378;1–386;1–437;1–391;34–436 |
| 581 | 1–268;1–454;1–364;1–472;1–480 |
| 582 | 1–402;15–457;15–474;15–424;15–445;20–500;32–458;53–488;53–498;53–475;53–496;53–478;53–509;53–484;53–500;53–499;53–474;53–476;53–478;53–509;53–488;53–486;53–501;53–486;53–501;53–484;53–495 |
| 584 | 1–73;1–538 |
| 585 | 1–513;1–431 |
| 586 | 1–356;2–451;3–460;3–500;27–412;30–460;57–530;129–510 |
| 588 | 1–491;1–302 |
| 589 | 1–489;257–736 |
| 591 | 1–137;1–523;1–492;1–424;1–480 |
| 593 | 1–233;1–228;1–232 |
| 597 | 1–461_ 1–287 1–256;1–430;15–366 |
| 599 | 1–434;8–521 |
| 606 | 1–301;5–328 |
| 611 | 1–432;1–459;1–451;1–439 |
| 613 | 1–437;1–295;1–181;1–433;1–283;1–507;1–370;1–433;1–433;1–425;1–513;1–239;1–468;2–419;3–305;3–303 |
| 617 | 1–494;33–478 |
| 622 | 1–476;1–463 |
| 624 | 1–282;1–448 |
| 625 | 1–475;80–552 |
| 626 | 1–463;1–459 |
| 627 | 1–461;1–492;1–507;1–419;57–522;57–521;138–580 |
| 630 | 1–487;142–607 |
| 632 | 1–476;1–487;1–502;4–478 |
| 633 | 1–459;1–425;1–428;1–446;1–485;1–149;1–451;1–392;1–447;1–441;2–304 |
| 634 | 1–463;1–455;1–464 |
| 636 | 1–464;1–480 |
| 637 | 1–450;1–421;1–421 |
| 642 | 1–471;1–29;1–475;1–432;1–497;1–463;5–197;5–442;5–371;5–411;5–473;5–153;5–495;5–404;5–26;5–96 |
| 644 | 1–353;11–251 |
| 645 | 1–388;1–494;1–501;1–348;1–504;1–546;1–451;1–473;1–475 |
| 646 | 1–333;1–333;1–336;1–208;1–336;1–333;1–332;1–336;1–336;1–336;1–333 |
| 649 | 1–511;1–375;1–488;1–463;1–481;1–440;1–364 |
| 650 | 1–402;1–489;1–473;1–442;1–434;1–479 |
| 651 | 1–511;1–469;1–485;1–448;1–403;1–501;1–443;1–477;1–496;1–470 |
| 652 | 1–354;1–365;1–427;1–489 |
| 655 | 1–456;15–392;15–479;15–502;15–479;15–494;15–491;15–269;15–482;15–412;15–503;15–430;15–477;15–508 |
| 657 | 1–467;1–456;1–429;1–510 |
| 661 | 1–72;1–451 |
| 662 | 1–387;1–487;1–469;1–487;19–90;24–362;24–267 |
| 663 | 1–458;1–383 |

TABLE II-continued

(Tiling path)

| Seq Id No. | Positions of biological 5'ESTs |
|---|---|
| 666 | 1–469;19–539 |
| 667 | 1–479;1–490;1–467 |
| 669 | 1–504;1–532;1–354;1–532;1–464;1–540 |
| 671 | 1–476;106–506;106–233;106–207 |
| 672 | 1–238;6–443;6–412 |
| 674 | 1–281;1–467;1–469;1–416;1–404;23–451;23–269;23–467 |
| 677 | 1–419;1–497;1–492 |
| 682 | 1–464;1–466;1–508;1–499 |
| 683 | 1–458;1–486;1–485;1–354;1–481;1–446;1–465;1–346;1–495;1–490;1–270;1–482;1–535;1–450;1–499;1–461;1–406;1–435;1–477;1–499;1–373 |
| 686 | 1–321;1–350;1–259;1–321;1–333;1–320;1–338;1–288;1–168;1–321;1–336;1–347;1–347;1–338;1–321;1–330;1–331;1–347;1–251;1–336;1–330;1–321;1–347;1–335;1–321;1–347;1–347;1–341;1–332;1–320;1–321;1–329;1–347;1–323;2–244;5–468;5–495 |
| 687 | 1–453;1–497;1–486 |
| 688 | 1–499;1–487 |
| 689 | 1–454;6–467;6–465;7–67 |
| 690 | 1–523;9–479 |
| 692 | 1–503;1–467;1–463 |
| 694 | 1–488;1–482;1–423;1–523;1–541;1–425;1–462 |
| 697 | 1–296;1–248;45–136;45–315;45–252;45–304;45–491;45–94;45–224;45–282;45–558;45–210;45–303;45–251;45–272;45–316;45–234;45–3 19;45–94;45–211;45–215;45–536;45–258;45–488;45–537;45–96;45–473;45–311;45–238;45–403;45–318;45–272 |
| 702 | 1–425;1–480 |
| 703 | 1–423;1–495 |
| 704 | 1–492;1–455;1–381;35–206 |
| 705 | 1–204;1–399;1–479;1–457;1–457;1–179;1–368;1–127;1–409;1–449;1–450;1–467;1–58;1–450;1–452;1–450;1–327;1–402 |
| 706 | 1–378;94–595;94–582;94–584;94–583;94–402;94–552;94–554;94–672;95–610;101–604;101–577;101–620;101–366;105–505;118–596;118–472 |
| 710 | 1–451;1–472 |
| 712 | 1–333;1–391;1–432;15–484 |
| 714 | 1–484;1–503;1–534;2–480;2–469;2–476;2–358;125–483;125–210 |
| 715 | 1–468;1–512;1–492;1–484;1–178;1–491;1–327;1–443;1–509;1–319;1–434;1–491;1–393;1–493;1–180;1–393;1–514;1–443;1–490;1–484;1–477;1–477;1–441;1–525;1–493;1–469;1–490;1–509;1–442;1–461;1–477 |
| 718 | 1–474;1–495;1–462;1–476 |
| 719 | 1–55;1–416;1–482;1–439;1–457;14–492 |
| 720 | 1–423;1–469;2–326;12–469;12–425 |
| 721 | 1–485;1–471 |
| 722 | 1–251;1–419;1–434;1–560;1–490 |
| 725 | 1–470;1–508;1–531 |
| 726 | 1–503;1–431 |
| 727 | 1–371;1–350;32–396 |
| 728 | 1–477;28–389 |
| 730 | 1–480;25–511;25–512 |
| 731 | 1–509;13–465;18–463;18–493;18–498;18–499;18–519;18–511;18–257;18–460;18–496;18–307;18–463;19–482;21–492;22–509;22–496;22–499;23–421;26–455 |
| 732 | 1–380;1–345;1–380 |
| 739 | 1–464;18–478;18–511;18–516;18–506;18–483;19–371;19–509;19–301 |
| 740 | 1–123;78–150 |
| 742 | 1–453;1–421;1–494;1–469;5–439;6–467;7–456;17–489;17–465;17–93;17–502 |
| 753 | 1–182;1–76 |
| 754 | 1–344;1–487;8–472;13–475 |
| 757 | 1–453;12–494 |
| 758 | 1–392;1–370;1–381 |
| 760 | 1–355;1–467 |
| 764 | 1–314;1–456;1–472 |
| 768 | 1–466;8–350;13–474;13–544;13–523;19–488;19–490;22–234;22–512;22–226;22–222;39–537;39–430;42–307 |
| 769 | 1–504;1–508;1–480;1–484;–429;1–485;1–484;–474;1–482;1–465;1–303;1–523;1–502;4–500;4–476;4–495;4–538;4–504;4–437;4–500;4–519;4–528;4–501;4–495;4–500;4–496;4–498;4–476;4–501 |
| 771 | 1–265;1–450;153–506 |
| 773 | 1–432;1–499;4–386 |
| 774 | 1–476;1–492;1–295;1–479;1–477;1–498;1–472;1–462 |
| 775 | 1–450;1–428;5–420;5–372;5–498 |
| 777 | 1–317;1–439;1–470;1–433;1–432;235–732;235–690;249–603;249–748 |
| 778 | 1–136;28–456;28–526;28–420;28–494;61–360;61–522;61–495;61–331;61–431;61–450;63–558;63–386;64–534;66–457;66–358;66–560;66–342;66–533;70–589;70–320;72–512;73–534;73–542;73–451;73–533;73–512;73–528;73–508;73–541 |
| 780 | 1–520;69–415;101–595;101–585;101–583;101–470;108–595;108–572;108–513;108–588;108–595;108–610;108–595;108–646;108–605;108–577;110–653;247–704 |
| 781 | 1–394;1–491;1–502;1–497;1–502;1–476;1–403;1–470 |
| 783 | 1–484;9–516 |
| 786 | 1–384;1–486;10–515;10–482 |
| 787 | 1–476;1–463 |
| 788 | 1–312;1–310,1–384,7–514;49–401;55–499;55–532,56–552,56–435;56–584;56–521;56–618;56–560;56–567;56–576;56–415;56–521;56–512 |
| 790 | 1–445;16–474;16–396;27–410;27–465;27–443;28–281;28–249;30–484;30–145;30–330;30–429;30–427;30–462;30–462;30–466;30–444;30–386;30–467;30–459;30–462;30–462;30–410;30–423;30–463;30–494;30–480;30–253;30–405;30–430;30–483;30–379;30–398;30–426;30–410;30–443;30–459;30–442;30–449;30–459;30–427;30–485;30–463;30–445;30–478;30–398;30–458;30–451;30–324;30–453;30–462;30–483;30–432;30–440;30–458;30–494;30–426;30–477;30–334;30–396;30–397;30–447;30–459;30–331;30–444;30–410;30–494;30–482;30–468;30–189;30–444;30–444;30–456;30–494;30–478;30–485;30–466;30–291;30–470;30–485;30–402;30–322;30–410;30–416;30–416;30–468;30–197;30–462;30–448;30–415;30–410;30–469;30–469;30–395;30–474;30–372;30–494;30–449;30–410;30–418;30–410;30–399;30–462;30–468;30–223;30–468;30–416;30–410;30–398;30–430;30–481;30–462;30–448;30–245;30–410;30–420;30–494;30–485;30–365;30–410;30–448;30–485;30–483;30–454;30–457;30–444;30–441;30–150;30–378;30–494;30–442;30–409;30–407;30–478;30–454;30–483;30–474;30–484;30–448;30–409;30–374;30–453;31–396;32–410;32–147;32–443;32– |
| 792 | 1–484;1–470 |
| 793 | 1–445;1–492;1–419 |

TABLE II-continued (Tiling path)

| Seq Id No. | Positions of biological 5'ESTs |
|---|---|
| 795 | 1–492;–374;1–547:1–355;1–356;1–366;1–547;1–324;1–453;1–476;1–422;18–294 |
| 796 | 1–489;1–160 |
| 797 | 1–443;1–227;3–415;5–215;5–479;5–290;5–453;5–279;5–419;5–477;5–380;6–373;6–413;6–496;6–462;6–343;6–472;6–279;6–297;6–448;6–492;6–313;6–474;6–340;6–485 |
| 798 | 1–461;1–465;5–452;5–425;5–478 |
| 800 | 1–395;1–500;1–450;1–491;1–302;1–367;1–432;1–454;68–577 |
| 802 | 1–444;1–179 |
| 803 | 1–424;1–394;1–466;1–456;1–418 |
| 804 | 1–448;1–422;1–392;1–416 |
| 805 | 1–453;1–484;1–456 |
| 806 | 1–309;17–510 |
| 809 | 1–376;21–129;21–129 |
| 811 | 1–270;1–520;1–117 |
| 813 | 1–191,1–191 |
| 815 | 1–474;1–399;1–465;110–489;110–464;110–263;110–279;110–543 |
| 817 | 1–437;1–413;1–485;5–507;6–265;6–436;6–438;6–434;6–381 |
| 818 | 27–510;28–519;28–512;28–517;28–497;28–510;28–512;28–511;28–333;28–515;28–526;28–510;28–488;29–520;30–517;31–316;31–385;31–504;31–509;31–520;31–406;31–494;31–504;31–496;31–511;31–488;31–493;31–524;31–513;31–488;31–488;31–497;31–395;31–337;31–506;31–512 |
| 819 | 17–482;24–512;27–526;28–510;28–517;28–463;28–510;28–488;28–515;28–511;28–333;28–510;28–519;28–512;28–482;28–497;29–520;29–463;30–517;30–483;31–496;31–513;31–478;31–511;31–504;31–478;31–458;31–494;31–316;31–477;31–496;31–509;31–520;31–504;31–488;31–493;31–524;31–497;31–488;31–478;31–442;31–488;31–476;31–337;31–506;31–512 |
| 820 | 1–331;51–332;51–332;51–332 |
| 824 | 1–144;1–351 |
| 826 | 1–466;1–264 |
| 827 | 1–309;1–374;1–255;1–420 |
| 832 | 1–372;1–461;1–281;1–461;1–486;1–486;1–492;1–494;1–479 |
| 834 | 1–224;180–269;180–650 |
| 836 | 1–431;1–486 |
| 839 | 1–272;51–278;51–433;51–482;51–397;51–537;51–537 |
| 842 | 1–403;14–513 |
| 843 | 1–432;74–536 |
| 844 | 1–434;29–526 |
| 846 | 1–431;6–367;6–164;6–503;6–432;6–413;6–424;6–495;6–422;6–369;8–430;8–410;8–409;8–403;8–462 |
| 848 | 1–408;32–308;32–476;32–484 |
| 849 | 1–367;1–491;1–518;1–466;1–505;1–478;1–494;1–492;1–513;1–432 |
| 850 | 1–474;22–377 |
| 851 | 1–431;1–492;1–164 |
| 852 | 1–474;1–370 |
| 854 | 1–402;1–489;7–499;15–344;16–473 |
| 855 | 1–296;1–428;1–484;1–484;1–411 |
| 856 | 1–471;1–473;36–376;36–409;76–440 |
| 857 | 1–426;1–502;1–321 |
| 859 | 1–481;1–382 |
| 860 | 1–344;52–508 |
| 861 | 1–489;1–390;–465;1–349;15–390;35–148;40–367;40–146;40–504;41–440;41–160;41–506;41–382;41–157;41–386;41–490;41–535 |
| 862 | 1–484;1–502;1–390;1–504;1–409;2–435;2–287 |
| 864 | 1–280;1–483;1–355;1–429;1–448;8–302 |

TABLE II-continued (Tiling path)

| Seq Id No. | Positions of biological 5'ESTs |
|---|---|
| 865 | 1–324;1–415;1–451;1–478;1–557;1–481;1–518 |
| 867 | 1–471;1–484;1–463;1–496;1–303;1–373;1–101;4–387;4–398;4–472;4–428;4–366;4–466 |
| 868 | 1–471;1–484;1–463;1–303;1–373;1–491;1–101;4–387;4–366;4–472;4–428;4–466 |
| 871 | 1–444;1–467;1–443 |
| 873 | 1–210;1–413;1–430;27–79;27–506;27–521;27–432;27–478;27–498;27–509;27–504;27–453;27–101;27–287;27–510;27–493;27–483;27–507;27–101;27–505;27–444;27–506;28–506;28–509;28–465;28–505;28–423;28–478;28–476;28–507;28–490;28–502;28–502;28–431;28–542;28–365;28–506;28–454;28–477;28–280;28–495;28–415;28–478;28–458;28–464;28–284;28–516;28–225;28–491;28–439;29–515;29–411;30–435;33–466;33–499;33–515;35–328;50–285;50–506;50–517;50–517;54–507;54–505 |
| 878 | 1–337;1–473;1–408;1–472 |
| 880 | 1–410;1–422;1–447;1–464;1–450 |
| 881 | 1–351;1–301;11–252;11–442;11–372;15–361;28–276;28–337;28–305;29–500;29–165;29–177;29–429;29–100;29–178;29–165;29–165;29–152;29–110;29–173;29–512;30–439;30–165;30–151;30–506;30–322;30–482;30–178;30–165;30–452;30–141;30–258;30–165;30–294;31–165;31–425;31–158;31–178;31–165;40–272;40–272;40–272;87–323;88–536;226–623;226–695;226–304;226–681;226–688;226–624;226–708 |
| 882 | 1–489;1–449 |
| 883 | 1–295;7–93;17–245;41–508;41–542;41–445 |
| 885 | 1–484;1–309;1–455;1–474;1–321 |
| 886 | 1–456;1–499;1–420;5–200 |
| 887 | 1–455;1–347 |
| 888 | 1–452;1–428;1–272;2–436 |
| 890 | 1–460;1–471;1–525 |
| 892 | 1–517;1–335;1–368;1–514;1–92;1–246;1–385 |
| 893 | 1–431;1–479 |
| 894 | 1–478;20–433;20–437;21–318;37–456;48–119;48–113;51–548;52–240;59–504 |
| 897 | 1–441;8–467 |
| 898 | 1–445;1–159;1–366;1–453 |
| 902 | 1–498;1–477;1–438 |
| 904 | 1–481;1–537;1–443;1–539 |
| 905 | 1–326;1–314;1–368;1–321;1–332;1–365;1–369;1–365;1–365 |
| 906 | 1–485;1–304 |
| 907 | 1–417;1–464;1–449;–462;1–422 |
| 908 | 1–469;1–454 |
| 909 | 1–467;49–419;50–506;50–546;55–381;66–480;67–486;67–573;67–563;68–543;68–467;68–567;68–523;68–511;68–542;68–559;68–544;68–559;68–549;68–530;68–566;68–514;68–559;68–505;68–438;68–707;71–561;71–561;71–568;76–591;76–412;76–612;76–613;83–419;83–620;83–505;83–634;86–607 |
| 910 | 1–467;49–419;55–381;66–480;67–486;68–467;68–438;68–500;72–604;76–412;83–419;83–500 |
| 911 | 1–314;1–452;1–392;9–295;9–317 |
| 913 | 1–304;1–387;1–413;1–405 |
| 915 | 1–245;1–240;1–159 |
| 917 | 1–274;1–181 |
| 918 | 1–439;1–443;1–427;1–333;1–452;1–410;1–462;1–460 |

TABLE II-continued

(Tiling path)

| Seq Id No. | Positions of biological 5'ESTs |
|---|---|
| 919 | 1–517;1–439;1–443;1–427;1–333;1–505;1–452;1–481;1–410;1–513;1–504;1–456 |
| 921 | 1–374;2–346;2–526 |
| 923 | 1–474;1–370 |
| 924 | 1–404;1–434 |
| 925 | 1–367;1–198;36–373;36–474;36–459;36–521;36–519;36–438;461–898;461–900 |
| 926 | 1–466;1–512;1–522 |
| 929 | 1–338;40–324;42–540;42–538;42–547;42–445;46–500;46–539 |
| 930 | 1–478;1–486 |
| 931 | 1–402;1–413;67–458 |
| 932 | 1–509;1–529;1–484 |
| 933 | 1–438;1–469;1–443;1–501;1–472 |
| 936 | 1–458;1–504 |
| 937 | 1–474;1–429;1–372;2–525;2–443;2–482;2–415;2–472;2–398;2–472;2–480;2–488;2–510;3–443;3–414;3–479;3–456;3–427;3–451;3–477;3–461;27–512;27–486;27–335;27–499;27–601;27–506;27–467;27–331;27–267;27–484 |
| 938 | 1–397;1–462;1–495;1–462 |
| 939 | 1–494;1–489;1–468;1–491;1–513;1–388;1–514;1–486;1–488;1–484;1–521;1–486;1–383;1–401;1–487;1–511;1–490;1–497;1–478;1–483;1–209 |
| 940 | 1–494;1–489;1–468;1–491;1–513;1–388;1–514;1–539;1–486;1–484;1–488;1–486;1–383;1–401;1–487;1–511;1–490;1–497;1–478;1–483;1–209 |
| 941 | 1–463;1–557 |
| 942 | 1–223;1–479 |
| 943 | 1–351;1–476;1–475 |
| 944 | 1–529;20–488 |
| 945 | 1–253;1–263;1–502;1–511;1–463;1–502;1–284;1–369;6–605 |
| 946 | 1–488;1–420;1–479 |
| 949 | 1–482;32–460;32–186;32–510;32–510;32–422;32–507;32–484;32–519;32–333;32–529;32–424;34–533;38–392;38–557;38–482;38–418 |
| 950 | 1–50;1–55;1–353 |
| 951 | 1–446;1–424;1–515 |
| 952 | 1–355;1–508;1–463 |
| 953 | 1–466;5–421;5–433;5–449;5–466 |
| 954 | 1–454;1–476 |
| 955 | 1–274;6–506 |
| 956 | 1–440;12–440;12–428 |
| 957 | 1–227;1–144;1–295;1–435;15–366;144–572;144–628 |
| 958 | 1–525;1–419 |
| 959 | 1–375;1–497;1–370;1–424;1–402;1–363;1–400;1–337;1–437;1–448 |
| 960 | 1–502;1–273;1–317 |
| 961 | 1–525;1–398;1–405;1–461;1–453;1–481;1–467;1–504;1–450;1–510;11–455 |
| 962 | 1–284;1–444;1–323 |
| 963 | 1–334;27–165 |
| 966 | 1–311;1–258;1–309;1–311;1–311;1–307;1–289;1–301;1–296;1–308;1–292;1–298;1–298;1–289;1–301 |
| 968 | 1–437;1–499;34–511;34–548;34–526;34–473;34–496;34–479;34–529;34–496 |
| 969 | 1–495;1–405;1–375;1–491 |
| 971 | 1–492;3–466 |
| 972 | 1–458;1–402;1–420;1–346;1–416;1–471 |
| 973 | 1–412;1–425;1–464;1–472;1–201;1–366;10–137 |
| 974 | 1–219;1–282 |
| 975 | 1–322;24–290 |
| 976 | 1–475;1–479;318–452;318–452;318–452 |
| 977 | 1–385;1–410;1–381;22–366;22–219;46–514 |
| 978 | 1–462;1–463;1–489;1–493;1–414;1–379;1–445;1–473 |
| 979 | 1–427;1–459;1–166;1–334;1–459;1–367 |
| 980 | 1–104;1–481 |
| 981 | 1–405;1–503;1–394;1–415;1–253 |
| 984 | 1–473;1–528;1–477;1–540 |
| 985 | 1–482;1–439 |
| 987 | 1–429;1–410 |
| 988 | 1–488;22–492;31–201;32–473 |
| 989 | 1–380;1–490;1–504;1–501;1–507;1–508;4–369 |
| 992 | 1–497;23–549 |
| 993 | 1–465;1–466;1–388;1–433;1–565;1–290;1–471;1–487;1–487;1–190;1–469;2–320 |
| 994 | 1–453;2–464;2–438;2–528;2–459;2–445;2–486;2–519;2–454;2–338;2–359;2–477;2–58;5–495;8–424;8–445;8–518;8–494;8–392;8–367;8–459;8–434;8–488;9–56;47–533;47–367;47–529 |
| 998 | 1–476;3–342 |
| 1002 | 1–470;1–527;1–391;1–462;1–584;1–412;1–193;1–469;1–53;1–495;1–487;–482;3–152;3–156 |
| 1003 | 1–377;1–211;1–520;1–466;1–395;1–507;1–452;1–486;1–425;1–360;1–410;1–96;1–478;1–387 |
| 1004 | 1–403;1–490 |
| 1005 | 1–418;20–452 |
| 1006 | 1–453;1–469;1–474;1–463 |
| 1030 | 1–461;1–474;4–107;25–222;65–360;65–400;66–310;66–36 1;66–358;66–214 |
| 1031 | 1–478;2–467;2–483;2–106;3–471;3–460;3–556;24–221;54–503;54–539;54–515;64–359;64–399;65–499;65–360;65–357;65–309;65–213 |
| 1032 | 1–537;1–537;67–165 |
| 1033 | 1–425;1–422;1–390 |
| 1035 | 1–455;1–358 |
| 1036 | 1–110;1–447;1–391 |
| 1037 | 1–317;1–450;1–424 |
| 1038 | 1–319;1–453 |
| 1040 | 1–510;1–481;1–488;1–520;1–503;1–477;1–295;1–405;1–491 |
| 1042 | 1–436;1–479 |
| 1043 | 1–532;4–463;4–269;4–188;6–103 |
| 1044 | 1–516;1–382 |
| 1045 | 1–471;1–470 |
| 1048 | 1–380;2–496;22–490 |
| 1051 | 1–488;1–443;1–461;1–467;1–516;1–469;1–503;1–295;1–422;1–467;1–446;1–209;1–468;1–445;1–440;1–484;1–92 |
| 1054 | 1–325;1–449;1–405;1–457;1–71;1–230;1–406;1–449 |
| 1055 | 1–242;1–228;1–242;1–220;1–242;1–210;1–242 |
| 1056 | 1–369;1–462;1–431;1–486;1–340 |
| 1058 | 1–443;1–450;81–141 |
| 1059 | 1–567;1449;1–509 |
| 1061 | 1–418;6–382 |
| 1062 | 1–265;1–164;1–181;1–245;1–76;1–268;1–70;1–97;1–264;1–142;1–54;1–126;1–242;1–268;81–402 |
| 1065 | 1–486;1–473;1–466 |
| 1071 | 1–316;1–283;1–269;1–298;1–299;1–305;1–338;1–306;1–282;1–331;1–239;31–455;31–387;39–125;39–529;39–237;39–522 |
| 1074 | 1–463;–433;1–302;48–557;48–564;48–342;77–550;77–433;77–485;77–498 |
| 1075 | 1–483;1–492;1–424 |
| 1076 | 1–315;1–480 |
| 1078 | 1–480;1–353 |
| 1079 | 1–480;4–491;4–336;4–490;4–493;4–491;4–475;4–470;4–470;4–538;4–491;4–491;4–435;4–394;22–476 |
| 1081 | 1–279;1–201;20–444 |
| 1082 | 1–480;31–410;31–400;31–415;31–251 |

TABLE II-continued

(Tiling path)

| Seq Id No. | Positions of biological 5'ESTs |
|---|---|
| 1083 | 1–490;–55;28–396;31–446;42–403;42–413 |
| 1084 | 1–415;7–417 |
| 1085 | 1–369;4491;6–419;7–485;15–376;15–386 |
| 1088 | 1–148;1–191;2–129;2–150;2–145;2–138;3–149;3–150;27–149;27–123;27–123;28–29;28–144;28–129;28–131;28–129;28–149;28–140;29–129;30–149;31–143;32–148;33–148;33–144;33–183;33–134;33–150;33–150;33–141;33–149;33–137;33–191;33–151;33–147;33–150;33–179;33–134;33–254;33–150;33–149;33–150;33–148;33–150;33–91;33–131;33–122;33–87;33–151;33–149;33–151;33–149;33–150;33–135;33–105;33–150;33–138;33–135;33–151;33–144;34–93;34–150;34–138;34–150;34–129;34–135;34–145;34–149;34–140;34–149;34–148;34–179;34–148;34–131;34–142;34–139;34–140;35–148;35–150;35–135;35–140;35–108;36–136;36–150;36–141 |
| 1089 | 1–484;1–397;1–413;40–519;40–468;40–523;40–204;40–514;40–502;40–526;40–507;40–509;40–528;40–515;40–540;40–394;40–472;40–524;40–491;40–499;40–453;40–416;40–491;40–518;40–532;40–493;40–534;40–512;40–539;40–488;40–515;40–491;40–536;40–518;42–551;106–252;106–582;107–501;107–544;107–577;107–546 |
| 1090 | 1–321;1–318;1–201;1–333;1–333;1–333;1–332;1–329;1–329;1–344;1–333;1–121;1–309;1–346;1–330;1–330;1–345 |
| 1091 | 1–328;1–330;1–489;1–492;1–476;1–518;1–475;1–477;1–590;1–468;1–511;1–468;1–532;1–590;1–142;1–476;1–501;1–486;1–356;1–492;1–624;1–518;1–265;1–94;1–590 |
| 1092 | 1–478;1–484 |
| 1093 | 1–493;1–495;1–139;1–394 |
| 1094 | 1–480;1–494;1–479;1–378;1–505;1–486;1–513;1–453;6–347;9–485;9–454;9–504;9–506;17–117;30–168;30–507;30–506;30–407 |
| 1097 | 1–534;1–534;1–550;1–439;1–398;1–550 |
| 1107 | 1–465;28–481;28–437;28–492;28–492;28–329;29–373 |
| 1109 | 1–87;1–484 |
| 1113 | 1–484;1–468;1–482;1–433;1–481;1–457 |
| 1119 | 1–248;4–64 |
| 1120 | 1–615;4–538;4–325;4–561;4–615 |
| 1122 | 1–559;12–75 |
| 1123 | 1–141;1–360;1–399 |
| 1124 | 1–497;1–463;–480;13–506;31–239;31–518;31–524;31–482;31–190;31–479;37–328;37–328;37–212;37–292;37–328;37–522;37–335;38–496;38–543;38–312;61–506;61–526;66–547;66–509;66–486;66–503;66–543;80–551;111–547 |
| 1125 | 1–64;1–440;1–484;1–447;1–470;1–477 |
| 1128 | 1–502;1–456 |
| 1132 | 1–528;2–307 |
| 1134 | 1–454;1–506;1–293 |
| 1135 | 1–473;1–491;1–495;1–449;1–438;1–468;45–495;105–564 |
| 1137 | 1–460;1–268;25–524;33–408 |
| 1140 | 1–63;21–479 |
| 1141 | 1–485;1–482;1–341;1–466;1–494 |
| 1144 | 1–75;1–462;1–208;1–236;1–436;1–351;1–487;28–515;28–516 330;1–151;1–435;1–153;1–227;1–365;1–395;1–264;1–382;1–372;1–269;1–244;1–410;1–353;1–344;1–468;1–273 |
| 1145 | 1–239;1–238 |
| 1146 | 1–343;1–337 |
| 1147 | 1–484;83–528 |
| 1148 | 1–448;1–483 |
| 1149 | 1–440;1–429;4–85;6–504 |
| 1151 | 1–503;1–366;1–473;74–529;74–526 |
| 1156 | 1–494;1–130;1–208;1–266 |
| 1157 | 1–537;1–269;1–557;1–292;1–503;21–361 |
| 1158 | 1–335;1–458;1–127;1–268;1–269 |
| 1160 | 1–132;15–205;25–147;56–536 |
| 1170 | 1–447;1–301;1–457;1–228;1–502;1–466;1–499;1–443;1–434;1–519;1–456;1–321;1–477;1–488;1–459;1–404;1–395 |
| 1172 | 1–497;1–494;T–445;1–505;1–488;1–512;1–498;1–495;1–504;1–502;1–461;1–60;1–500;1–498;1–437;1–445;1–522;1–459;1–477;1–371;1–460;1–522;1–511;1494;1–502;1–440;1–499;1–427;10483;1–194;1–436;1–422;1–453;1–402;1–377;1–552;1–210;1–564;1–239;1–209;1–456;1–465;1–498;1–393;1–559;1–460;1–494;1–469;1–460;1–469;1–494;1–501;1–478 |
| 1173 | 1–469;1–413;1–357;1–469 |
| 1174 | 1–386;1–425;1–208;1–471;1–482;1–476;1–359;1–498;–467 |
| 1175 | 1–505;1–390 |
| 1177 | 1–388;1–531;1–442 |
| 1178 | 1–437;1–488;1–490;1–526 |
| 1179 | 1–468;1–391;1–490;1–468;1–340;1–150;1–433;1–371;385–915 |
| 1180 | 1–542;3–480;4–495;4–517;6–490;6–498;6–536;6–488;6–482;6–407;6–498;6–476;6–290;6–480;6–476;6–491;6–465;6–271;6–557;6–474;6–514;6–494;6–74;6–423;6–536;6–416;6–480;6–488;6–474;6–69;6–450;6–406;6–74;6–550;6–550;6–69;13–497;13–534;13–69;13–69;13–292;13–488;13–461;13–515 |
| 1181 | 1–388;1–477;2–448;136–581;136–648;151–604;151–474;151–598;151–679;151–584;151–691;159–530;159–646;159–620;159–658;159–591;166–502;166–639 |
| 1182 | 1–396;1–520;1–503;1–436;1–364;1–567 |
| 1185 | 1–458;1–448;1–446;1–248;1–599;1–371;1–525;1–361;1–533;1–470;1–424;1–465;1–391;1–413;1–447;1–346;1–362;1–441;16–566;16–453;23–495;23–495;23–490;23–491;23–520;25–496;26–431;26–469;28–558;28–505;28–516;28–524;28–554;28–487;28–515;28–516 |
| 1186 | 2–536;2–415;2–502;2–466;2–415;2–525;2–421;3–502;3–548;3–425;3–524;3–472;3–300;3–494;3–494;3–438;3–502;3–505;3–502;3–502;3–494;3–472;3–505;3–269;3–492;3–418;3–355;3–471;3–505;3–525;3–494;3–494;3–236;3–494;3–337;3–505;3–439;3–492;3–502;3–502;3–406;3–523;3–473;3–536;3–57;3–493;3–403;3–456;3–479;3–419;3–502;3–302;3–494;3–525;3–439;3–356;3–337;4–302;5–536;5–505;5–492;5–415;5–361;5–476;5–481;5–502;5–494;5–543;5–476;5–525;5–522;5–337;5–412;6–502;6–536;6–505;6–422;6–502;6–493;6–494;6–492;6–536;6–525;6–422;6–467;6–408;6–478;6–502;6–543;6–525;6–456;6–465;6–415;6–472;6–358;6–502;6–525;6–264;6–473;6–525;6–327;6–502;6–426;6–400;6–426;6–481;6–502;6–213;6–509;6–525;6–425;6–213;6–412;6–361;6–416;6–477;6–522;6–71;6–333;6–426;6–543;6–492;6–543;6–401;6–213;6–536;6–213;6–415;6–418;6–529;6–400;6–415;6–415;6–503;6–213;6–467;6–493;6–424;6–544;6–351;6–459;6–472;6–416;6–505;6–483;6–75 |
| 1187 | 1–470;1–510;2–69;2–382;9–354;31–457 |
| 1188 | 1–77;1–122;1–90;1–108;2–472 |
| 1189 | 1–60;4–408;4–472;4–458;4–445 |

TABLE II-continued (Tiling path)

| Seq Id No. | Positions of biological 5'ESTs |
|---|---|
| 1190 | 1–63;5–380;5–528;5–449;5–477;5–492;5–536;5–386;5–386;5–445 |
| 1191 | 1–438;1–476;1–398;1–437;1–255;1–472;1–467 |
| 1192 | 1–553;1–475 |
| 1193 | 1–574;1–480 |
| 1195 | 1–479;1–375;1–458;1–477 |
| 1196 | 1–454;1–454;31–405;31–447;31–489;31–505;31–543;36–554;36–521 |
| 1197 | 1–262;12–476;16–377;17–448;17–482 |
| 1198 | 1–270;1–461 |
| 1200 | 1–486;1–429;1–472 |
| 1202 | 1–512;1–472 |
| 1203 | 1–486;1–750;1–234;1–198;1–491;1–459;1–531;1–392;1–388;1–357;1–440;1–471; 208;1–460;1–439;2–150;3–423;3–328;3–161;3–392;3–347;3–368;3–192 |
| 1204 | 1–534;17–207;17–383;17–176;17–407;17–438;18–506;18–474;18–249;18–223;18–501;18–213;18–454;18–475;18–455;18–372;18–407;18–403;18–486;18–165 |
| 1207 | 1–464;1–469;1–491;1–498;1–452;1–398;11–464;11–440;11–476;11–444;11–361;11–473;11–507 |
| 1208 | 1–457;1–424;2–424;2–373;2–396;2–424;33–325 |
| 1209 | 1–396;2–468;2–424;2–373;2424;2–424;5–487;33–456;33–325 |
| 1210 | 1–512;15–440;35–555;35–601;35–550;35–144;38–500;42–321;42–443;42–550;42–301;42–446;42–480;42–550;42–437;42–158;42–541;42–536;42–490;42–550;42–550;42–550;42–523;42–437;42–547;42–435;42–545;42–550;42–552;42–447;42–456;42–387;42–550;42–550;42–547;42–541;42–543;42–547;42–391;42–395;42–500;42–553;42–547;42–547;42–533;42–498;42–480;42–553;42–543;55–550;59–601;63–534;63–601;63–319;63–308;63–588 |
| 1214 | 1–409;3–549 |
| 1215 | 1–479;1–492;1–412;1–294;1–439;1–473;1–464;1–524;1–498;1–478;–482;1–449;5–456;6–436;6–317 |
| 1216 | 1–446;1–505 |
| 1217 | 1–328;102–350;102–309 |
| 1221 | 1–476;1–440;1–486 |
| 1228 | 1–534;19–477;19–530;19–426;19–594;19–482 |
| 1229 | 1–284;71–533;71–579 |
| 1230 | 1–504;1–504 |
| 1231 | 1–488;1–438;1–517;1–465;41–473;41–517;41–473 |
| 1233 | 1–238;1–474 |
| 1234 | 1–459;72–489 |
| 1236 | 1–453;1–369;1–431;1–474;1–471;2–451;21–473;30–485;59–234;231–482 |
| 1237 | 1–454;1–442;1–438;1–443;1–438;1–442;1–433;1–441;1–433;1–437;1–280;1–261;1–336;1–455;1–437;1–437;1–429;2–454;20–195;192–443 |
| 1238 | 1–349;1–470;1–407;–491;20–177;20–536 |
| 1239 | 1–468;1–468;1–461;1–451;47–162 |
| 1240 | 1–567;1–287;1–459;1–456 |
| 1243 | 1–423;1–437;36–541;36–541;40–453 |
| 1245 | 1–375;1–508;1–516;1–473;1–525;1–437;1–475;1–475;1–522;1–436;1–451;1–462;1–310;1–498;1–481;1–489;1–314;1–427;1–485;1–241;35–478;35–388;35–518;35–526;35–527;36–503;36–545;36–533;39–479;41–526;43–461 |
| 1246 | 1–386;1–461;1–478;1–477 |
| 1247 | 1–486;1–504;1–253 |
| 1248 | 1–305;1–471;1–412;5–411;7–474;7–517;9– |

| Seq Id No. | Positions of biological 5'ESTs |
|---|---|
| 1250 | 1–488;1–411;16–526;16–500;16–380;16–439;16–524;16–486;16–497;16–468;16–296;16–531;16–485;16–277;16–453;16–486;16–280;16–277;16–275;20–451;20–135;20–509;20–507;20–505;20–435;20–452;20–484;20–406;20–496;20–381;20–505;20–460;20–459;20–504;20–505;21–537;21–525;21–519;21–402;21–530;21–501;21–489 |
| 1251 | 1–467;1–475;1–453;1–437;1–477;1–478;1–371;1–363;1–548;1–375;1–441;3–461;3–475;3–497;3–221;3–361;3–477;3–505;3–272;3–484;3–502;8–465;8–463;8–362;8–501;8–469;8–504;8–376;8–484;8–483;8–464;8–464;8–481;8–466;8–463;8–504;8–339;8–481;8–516;8–474;8–480;8–500;8–490;8–379;8–496;8–437;8–496;8–473;8–531;8–435;8–389;8–468;8–500;8–464;9–545;9–482;9–480;9–409;9–481;9–496;9–313;9–397;9–351;9–494;10–481;10–447;10–481;10–180;10–536;10–371;10–339;10–481;10–501;10–375;10–568;10–434;10–464;10–464;10–428;10–461;10–484;10–382;10–371;10–476;10–161;10–491;10–161;10–498;10–548;10–464;10–453;10–424;10–502;10–477;10–466;10–496;10–354;10–505;10–451;10–484;10–345;10–363;10–513;10–540;10–522;10–233;10–356;10–149;10–464;10–312;10–485;10–465;10–500;10–459;10–336;10–468;10–520;10–522;10–518;10–465;10–406;10–502;10–436;10–468;10–453;10–438;10–518;10–480;10–496;10–499;10–315;10–191;10–479;10–371;10–482;10–486;10–506;10–496;10–382;10–475;10–481;10–436;10–460;10–472;10–524;10–400;10–296;10–136;10–463;10–482;10–533;10–192;10–443;10–480;10– |
| 1252 | 1–375;1–363;1–432;1–371;3–221;3–361;3–272;8–432;8–376;8–379;8–362;8–432;8–389;8–339;9–351;9–313;9–409;9–397;10–363;10–382;10–424;10–432;10–428;10–371;10–371;10–132;10–339;10–233;10–345;10–161;10–161;10–406;10–400;10–324;10–426;10–356;10–312;10–336;10–149;10–375;10–191;10–315;10–180;10–371;10–492;10–354;10–382;10–432;10–296;10–136;10–192;10–267;10–82;10–363;10–432;10–432;10–426;10–243;10–161;10–313;10–410;10–364;10–351;10–432;10–420;10–350;10–161;10–74;10–163;10–85;10–390;10–430;10–390;11–363;11–424;12–271 |
| 1253 | 1–271;1–220;7–335;9–160;9–131;9–323;9–179;9–160;9–232;9–335;9–295;9–73;9–135;9–242;9–162;9–477;9–335;9–148;9–84;9–191;9–160;9–528;9–190;9–314;9–266;9–8;9–160;11–270 |
| 1258 | 1–439;1–454;1–453;1–451;1–306 |
| 1259 | 1–444;–401;1–458;1–525;1–468;1–401;1–454 |
| 1260 | 1–501;35–516;35–554;35–532;35–510;35–514;37–381;45–514;54–534;54–51;54–531;54–346;54–278 |
| 1261 | 1–216;1–459;5–181;5–184;5–171;5–171;5–171;5–184;5–181;5–181;5–68;5–184;5–184;5–651;5–181;5–181;5–180;5–184;5–184;5–171;5–184;5–184;5–181;5–151;5–179;5–180;5–184;5–184;5–180;5–184;5–184;5–164;5–160;5–184;5–181;5–126;5–114;5–378;5–181;5–184;5–184;5–86;36–229;36–226;36–226;36–226;36–229;36–229;36–222;36–226;36–229;36–229 |
| 1262 | 1–90;1–73;1–491 |

TABLE II-continued

(Tiling path)

| Seq Id No. | Positions of biological 5'ESTs |
|---|---|
| 1264 | 1–353;1–409;1–465;1–490;1–357;1–409 |
| 1265 | 1–475;9–540 |
| 1267 | 1–409;1–428;38–516;59–255;59–261;59–260;59–483;59–260 |
| 1268 | 1–498;19–501;21–496;21–465;21–565;21–612;21–469;27–545;28–516;44–482;44–536;44–517;47–549;47–529;47–458;51–434 |
| 1269 | 1–379;1–544 |
| 1270 | 1–492;1–497;1–480 |
| 1273 | 1–435;1–312 |
| 1275 | 1–447;1–479;1–480;1–390;1–476;1–480;78–519 |
| 1276 | 1–430;1–473;1–540 |
| 1277 | 1–461;1–496 |
| 1279 | 1–178;35–482;35–439;35–482;35–413;35–463;36–176 |
| 1280 | 1–472;1–474;51–519;51–527;51–536;51–470;143–274;145–603 |
| 1281 | 1–472;1–492;1–478 |
| 1282 | 1–450;1–451;1–433;1–465;1–474;1–484;1–512;1–458;1–469 |
| 1283 | 1–440;1–435;1–459;1–353;1–479;1–459;1–416;1–420;1–463;1–445;1–468;1–479;122–282;122–519 |
| 1284 | 1–476;1–423;1–369 |
| 1286 | 1–463;1–301;1–457;1–266;1–483;1–518 |
| 1287 | 1–444;1–490;1–437;1–431;1–439 |
| 1289 | 1–420;1–340;1–420;8–338 |
| 1290 | 1–484;1–475;1–499;1–512;1–498 |
| 1293 | 1–484;1–441 |
| 1295 | 1–463;3–459;3–445;3–458;3–462;25–349;25–392;25–467 |
| 1296 | 1–245;21–486;21–428;25–427;27–249;40–333;40–458;40493;40–475;42–475;42–468;52–452 |
| 1298 | 1–218;1–264;1–472;1–332 |
| 1299 | 1–225;6–105 |
| 1300 | 1–562;2–518;2–505;2–506;3–452 |
| 1301 | 1–446;–291;6–489;6–457;6–350;6–354;6–354;15–501;16–417;16–373;16–224;16–364;16–443;16–491;16–456;16–213;16–274;19–443 |
| 1302 | 1–443;1–399;1–453;142–576;171–567;171–441;171–585;173–534;173–607;173–619;173–596;173–638;173–320;173–639 |
| 1303 | 1–349;1–530;13–445;13–502;32–522;32–597;33–464 |
| 1304 | 1–96;1–381;1–459;1–511 |
| 1305 | 1–471;1–464 |
| 1306 | 1–457;10–482;10–484;10–413 |
| 1307 | 1–387;1–485;1–480 |
| 1308 | 1–339;1–221;3–280;24–96;26–249 |
| 1311 | 1–487;1–447 |
| 1312 | 1–407;1–236;1–269;1–90;–344;1–475;1–460;1–454;1–459;1–416;1–362;1–440;4–454;4–80;17–511;17–295;17–388;17–423;17–82;17–465;17–439;17–467;17–501;17–474;17–516;17–479 |
| 1313 | 1–471;1–347 |
| 1314 | 1–455;6–468;6–504 |
| 1318 | 1–505;1–450 |
| 1319 | 1–562;1–462;1–444;1–428 |
| 1321 | 1–470;27–414;33–227 |
| 1326 | 1–453;1–438;1–54;1–457;1–511;1–176;1–443;1–457;1–509;1–106 |
| 1327 | 1–474;1–469;1–480;2–72;3–293 |
| 1328 | 1–472;1–463 |
| 1329 | 1–411;1–431;1–357;1–444;1–453;1–378 |
| 1330 | 1–480;1–498 |
| 1337 | 1–479;1–480 |
| 1339 | 1–432;5–512;5–247;5–297;18–502;18–512;21–339 |
| 1343 | 1–523;1–453;1–495;1–463;1–415;1–365;1–500;2–415;2–283;2–922;2–442;28–413;28–531;28–922;28–495;28–431;28–504;28–341;28–505;28–417;28–247;28–350;31–340;31–488;31–504;31–339;31–514;31–496;31–501;31–335;31–529;31–487;31–494;31–450;31–546;31–247;31–210;31–495;31–531;31–495;31–532;31–507;31–522;31–504;31–481;31–343;31–480;31–533;31–435 |
| 1344 | 1–82;4–417 |
| 1345 | 1–361;273–692;273–666;273–698;273–358;276–628;278–646;278–694;279–699;279–697;279–654;279–675;279–338;279–643;279–696;279–656;279–697;279–699;279–699;279–698;279–699;279–699;279–646;279–390;279–644;279–693;279–666;279–688;279–699;279–699;279–372;279–699;279–694;279–474;279–684;279–628;279–684;279–696;279–699;279–657;279–695;279–697;279–687;279–696;279–661;279–690;279–692;279–699;279–697;279–699;280–654;280–556;280–614;280–692;280–802;280–683;280–591;280–666;280–483;280–692;280–699;280–599;280–699;280–555;280–562;280–699;280–600;280–390;280–655;280–445;280–681;280–580;280–699;280–613;280–644;280–681;280–690;280–699;280–696;280–680;280–717;280–370;280–696;280–694;280–556;280–675;280–626;280–699;280–685;280–380;280–665;280–674;280–684;280–370;280–666;280–598;280–685;280–699;280–699;280–642;280–579;280–696;280–730;280–677;280–640;280–794;280–696;280–614;280–613;280–696;280–726;280–680;280–692;280–675;280–640;280–376;280–672;280–614;280–699;280–692;280–698;280–697;280–691;280–699;280–685;280–332;280–696;280–677;28 |
| 1346 | 1–361;273–357;276–609;278–626;279–338;279–631;279–553;279–393;279–605;279–620;279–391;279–633;279–466;279–626;279–619;279–471;279–613;279–632;279–629;279–647;279–370;280–473;280–633;280–574;280–392;280–629;280–594;280–546;280–540;280–378;280–618;280–374;280–562;280–594;280–495;280–439;280–611;280–368;280–592;280–539;280–368;280–540;280–585;280–603;280–561;280–368;280–630;280–578;280–616;280–471;280–594;280–592;280–620;280–550;280–616;280–579;280–332;280–494;280–518;280–384 |
| 1347 | 1–397;26–519;26–463;28–382;28–382;30–582;30–142;30–457 |
| 1348 | 1–456;1–400;1–563;2–400;3–434 |
| 1355 | 1–414;1–402;1–492;1–529;1–619;1–533;1–532 |
| 1356 | 1–1108;1–509;380–876 |
| 1357 | 1–327;1–343;1–380;1–323 |
| 1358 | 1–337;1–455;1–509;1–337;1–403;1–481;1–257;1–494;1–523;1–465;1–466;1–412;1–249 |
| 1359 | 1–488;5–518 |
| 1360 | 1–275;1–263;1–264;1–486 |
| 1361 | 1–445;1–822 |
| 1362 | 1–489;1–483;1–450;1–477;2–434;2–445;2–478;2–536;2–376;2–495;2–442;2–498;2–473;2–460;2–234;2–277;2–414;2–484;2– |

TABLE II-continued (Tiling path)

| Seq Id No. | Positions of biological 5'ESTs |
|---|---|
|  | 64;2–404;2–419;3–449;3–438;12–442;12–412;12–642;39–502;39–481;39–536;39–533;39–348;39–514 |
| 1363 | 1–469;86–318;86–361;86–148 |
| 1364 | 1–465;1–489 |
| 1365 | 1–379;1–259;1–432;1–567 |
| 1366 | 1–324;38–504;38–529;43–551;46–499;46–496;47–502;47–464;47–511;47–586;47–555;47–511;47–485;48–433;48–490;96–556;125–639;178–634 |
| 1367 | 1–71;2–131;2–127;19–487 |
| 1368 | 1–462;1–498 |
| 1369 | 1–617;1–216;60–492 |
| 1371 | 1–483;31–511 |
| 1375 | 1–473;1–490;18–394 |
| 1376 | 1–476;1–409 |
| 1377 | 1–256;12–336;12–367;12–487;12–106;12–411;12–359;12–109;12–403;12–409;12–315;12–308;12–388;12–351;12–384;12–390;12–361;12–346;12–385;12–349;12–221;13–349;13–359;13–363;14–209;14–359;14–147 |
| 1378 | 1–278;1–511 |
| 1379 | 1–570;1–368;56–388 |
| 1382 | 1–482;31–579 |
| 1384 | 1–436;32–496;32–500;32–518;32–557;32–509;78–539;78–902 |
| 1386 | 1–289;1–289;1–254;1–333;3–372;23–216 |
| 1387 | 1–61;1–456;1–508;34–473;34–476 |
| 1388 | 1–488;1–61;1–479;1–492 |
| 1389 | 1–613;1–388;1–499;1–475 |
| 1391 | 1–649;1–803;2–342;22–389 |
| 1392 | 1–385;1–471;171–540 |
| 1393 | 1–365;1–498 |
| 1395 | 1–101;1–340 |
| 1397 | 1–165;1–201;1–466;1–430;1–204;1–463;2–181;2–493 |
| 1398 | 1–263;1–477;1–487;1–421;1–490;1–393 |
| 1402 | 1–469;1–496 |
| 1403 | 1–382;2–507;2–524;2–416;2–460 |
| 1404 | 1–79;1–484 |
| 1405 | 1–294;1455;1–320;1–279;178–481 |
| 1406 | 1–500;1–445;1–389;1–769 |
| 1407 | 1–495;1–496;1–322;1–487;1–568;1–436 |
| 1408 | 1–448;1–328;1474;1–415;1–485;1–424;1–461;1–134;1–393;1–426;1–506;1–269;1–472;1–483;1–503;1–463;1–473;3–459;3–434;7–515;7–500;7–500;7–441;7–260;7–532;7–386 |
| 1409 | 1–457;1–465;1–421;1–354;1–466;1–411;1–431;1–368;1–81;1–397;1–465;1–417;1–462;1–433;1–434;1–471;1–465;1–442;1–422;1–458;1–462;1–472;1–433;1–451;20–470;26–459;26–475;26–453;26–441;26–471;26–444;26–449;26–422 |
| 1410 | 1–291;1–552 |
| 1412 | 1–475;4–381;15–451;15–440 |
| 1415 | 1–112;7–507;8–526;8–499;8–507;8–581;8–464;8–428;8–508;8–522;8–509;8–432;8–464;8–507;8–482;8–508;8–433;8–476;8–507;8–435;8–297;8–482;8–181;8–313;8–272;8–528;8–528;8–463;8–475;8–528;8–477;10–528;10–537;10–568;10–528;10–363;10–583;10–522;10–461;10–380;10–528;10–509;10–509;10–522;10–472;10–477;10–522;10–497;10–398;10–568;10–522;10–522;10–477;10–508;10–508;10–528;10–453;10–531;10–469;10–508;10–526;10–507;11–360;11–508;11–303;11–507;11–507;11–482;11–562;11–576;11–562;11–482;11–556;12–509;12–363;12–482;13–331;13–511;13–499;13–407;13–482;13–482;14–497;14–362;14–535;14–507;14–480;14–522;14–531;14–482;14– |

| Seq Id No. | Positions of biological 5'ESTs |
|---|---|
|  | 316;14–522;15–577;30–453;30–522;30–467;30–576;30–507;30–482;30–526;30–509;30–140;30–577;30–527;30–556;30–509;30–477;30–556;30–513;30–517;30–427;30–482;30–296;30–499;30–556;30–556;30–397;30–109;30–241;30–528;30–435;30–522;30–556;30–499;30–469;30–315;30–577;31–528;31–526;31–507;31–562;31–482;31–574;31–359;31–510;31–517;31–522;31–528;31–389;31–529;31–507;31–497;31–508;31–407;31–287;31–508;31–464;31–507;31–577;31–507;31–57 |
| 1393 | 1–365;1–498 |
| 1395 | 1–101;1–340 |
| 1397 | 1–165;1–201;1–466;1–430;1–204;1–463;2–181;2–493 |
| 1398 | 1–263;1–477;1–487;1–421;1–490;1–393 |
| 1402 | 1–469;1–496 |
| 1403 | 1–382;2–507;2–524;2–416;2–460 |
| 1404 | 1–79;1–484 |
| 1416 | 1–309;1–396;1–199;1–309;1–404;1–389;1–382;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–102;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–105;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106;5–106 |
| 1417 | 1–353;1–420 |
| 1418 | 1–472;1–65;31–83;31–83;32–82;351–531 |
| 1419 | 1–354;1–509;1–437;1–370;157–510;157–510;157–510;157–513;157–447;157–504;157–421;157–505;157–510;157–488;157–510;157–486;157–510;157–522;157–486;157–523;157–510;157–487;157–525;157–510;157–492;157–492;157–503;157–522;157–510;157–506;157–506;157–473;157–510;157–510 |
| 1420 | 1–484;1–474;1–122;1–490 |
| 1421 | 1–484;5–86;37–493;52–264;52–480;52–493;54–430;54–524;54–539 |
| 1422 | 1–520;1–520 |
| 1425 | 1–544;1–237 |
| 1426 | 1–481;67–670 |
| 1430 | 1–495;1–456;1–473;1–471 |
| 1431 | 1–293;1–592 |
| 1432 | 1–466;39–540;39–553;43–531;43–545 |
| 1434 | 1–424;1–476;1–500 |
| 1435 | 1–466;1–510;1–481;1–449;1–418;1–472;1–450;1–460;1–386 |
| 1437 | 1–466;1–291;1–497 |
| 1440 | 1–443;307–587 |
| 1446 | 1–351;1–484;1–432;1–421 |
| 1447 | 1–470;1–256 |
| 1448 | 1–424;1–461 |
| 1453 | 1–92;15–457;15–686 |
| 1454 | 1–285;2–457;3–403 |
| 1455 | 1–454;1–501;21–388;21–112;21–266;21–355;35–506 |

TABLE II-continued

(Tiling path)

| Seq Id No. | Positions of biological 5'ESTs |
|---|---|
| 1458 | 1–437;2–281 |
| 1461 | 1–368;1–335;1–92;1–246;1–474 |
| 1462 | 1–469;1–373 |
| 1463 | 1–446;1–830;79–412 |
| 1465 | 1–410;1–600;15–478;16–494;16–473;16–510;16–475;16–445;16–489;17–433;17–382;17–623 |
| 1466 | 1–457;1–425 |
| 1468 | 1–487;1–487 |
| 1470 | 1–460;1–474;1–505 |
| 1471 | 1–493;1–76;1–484;41–515;41–603 |
| 1472 | 1–353;68–486;69–135;69–357;69–278;69–372;69–459;95–480;95–177 |
| 1473 | 1–348;1–387 |
| 1477 | 1–1111;1–449 |
| 1478 | 1–353;69–516;69–357;69–278;69–372;69–135;95–177 |
| 1480 | 1–51;1–375;1–116;1–305;1–105;7–161;7–113;7–226;7–468;7–118;7–335 |
| 1483 | 1–504;1–474;1–612;1–76;1–482;1–486;1–227;1–468;1–495;1–513;1–483;36–466 |
| 1484 | 1–365;1–450;1–110 |
| 1485 | 1–144;19–429;19–440;32–329;32–495;32–512;32–510;32–512;33–464;33–510;33–506 |
| 1487 | 1–160;2–420;2–424;2–349;2–373;2–217;7–485;12–409 |
| 1488 | 1–520;1–296;1–242;1–295;1–296 |
| 1489 | 1–407;1–436 |
| 1490 | 1–678;1–433;1–499;1–394 |
| 1491 | 1–453;1–329 |
| 1493 | 1–391;1–496 |
| 1495 | 1–407;5–490;5–350;5–445;5–495;5–499;5–448;5–462;5–393;5–468;5–480 |
| 1496 | 1–453;1–510;1–466 |
| 1497 | 1–450;1–475;1–474;1–465;1–463;1–291;1–540;1–463;1–426;1–479 |
| 1498 | 1–488;1–776 |
| 1502 | 1–478;1–485 |
| 1513 | 1–362;1–364;1–297;40–484 |
| 1515 | 1–358;1–335;3–320 |
| 1516 | 1–474;1–521;1–435;1–499;1–421;1–425;1–514;1–456;1–482;1–358;1–498;1–437;1–482;1–481;1–509;1–543;1–467;1–486;1–423;1–510;1–474;1–367;1–514;1–469;1–485;1–515;1–486;1–543;1–449;1–513;1–482;1–447;1–191;1–460;1–439;1–415 |
| 1517 | 1–456;30–487;31–439;37–564;280–752 |
| 1519 | 1–480;1–485;1–493;1–509;1–338;1–425;1–484;1–472;1–419;1–502;1–482;1–457;1–506;1–487;1–476;1–479;1–479;1–468;1–479;77–415 |
| 1521 | 1–532;1–377;1–419;1–430;1–485 |
| 1522 | 1–279;11–147;11–339;11–169;11–151;11–163;11–106;11–501;11–418;11–276;11–281;11–107;11–135;11–195;11–131;54–477 |
| 1524 | 1–444;1–354;1–438 |
| 1525 | 1–452;14–512;33–495 |
| 1526 | 1–277;11–337;11–149;11–145;11–167;11–161;11–193;11–104;11–133;11–129;11–105;11–279;11–274;52–515;52–541;52–492;52–534;52–545;52–518;52–531;52–516;52–434;52–589;52–490 |
| 1527 | 1–566;1–295;1–356 |
| 1532 | 1–459;1–232 |
| 1533 | 1–416;1–509 |
| 1534 | 1–475;1–502 |
| 1535 | 1–532;97–597 |
| 1536 | 1–491;4–99 |
| 1538 | 1–496;1–394 |
| 1539 | 1–345;1–501;1–437 |
| 1540 | 1–464;1–524;1–406;1–442 |
| 1543 | 1–478;1–465;1–922;1–475;1–492;1–529;1–488 |
| 1546 | 1–496;1–499;1–477;6–392;6–534;6–535;16–499;16–506;16–290;20–286;52–518;53–492;58–519 |
| 1548 | 1–260;1–496 |
| 1551 | 1–506;1–508;1–459 |
| 1552 | 1–502;2–471;2–463;2–378;2–478;2–400;2–494;2–512;3–139;3–466;3–139;3–139;3–402;3–504;3–503;3–456;3–139;3–465;3–453;3–399;3–471;3–448;3–139;3–456;3–139;3–272;3–139;3–478;3–496;3–537;3–467;3–482;3–139;3–466;3–466;3–265;3–506;3–139;3–139;3–386;3–478;3–521;3–139;4–380;4–469;8–467;40–468;40–520 |
| 1553 | 1–415;1–459;1–679;1–254;1–485;1–385;1–573;1–441;1–385;1–377;1–422;1–423;1–485;1–385 |
| 1555 | 1–546;1–477;1–419 |
| 1557 | 1–466;1–235;1–492 |
| 1558 | 1–339;36–540 |
| 1562 | 1–486;1–490;1–498;1–493;1–331;1–483;1–384;1–409;1–411;1–411;1–485;1–444;1–506;1–440;1–433;1–499;1–398;1–500;1–500;1–524;1–479 |
| 1563 | 1–438;1–487;1–473;1–395;2–474;3–400;3–326;4–456;4–330;4–474;6–442;6–513;6–461;6–243;7–430;7–246;8–432;8–357;8–487;8–482;8–443;8–502;8–442;8–484;8–413;8–480;8–486;8–457;8–481;8–345;8–495;8–495;8–492;8–509;8–507;8–418;8–458;8–491;8–479;8–491;8–458;8–479;8–486;8–401;8–446;8–382;8–481;8–446;8–495;8–437;8–491;8–479;25–455;25–512;25–478;25–475;25–499;25–488;25–486;25–486;25–507;25–488;25–495;25–490;25–486;25–494;25–492;25–451;25–505;25–491;25–495;25–492;25–496;25–515;25–506;25–499;25–488;25–485;25–492;25–449;25–479;25478;25–485;25–380;25–486;25–457;25–480;26–500;91488 |
| 1564 | 1–438;1–487;1–473;1–395;2–474;3–326;3–400;4–474;4–456;4–330;6–442;6–461;6–243;7–246;7–430;8–357;8–500;8–413;8–487;8–443;8–432;8–499;8–442;8–486;8–492;8–480;8–437;8–457;8–481;8–498;8–345;8–503;8–491;8–479;8–482;8–484;8–458;8–491;8–479;8–486;8–491;8–446;8–446;8–382;8–481;8–418;8–458;8–495;8–401;25–491;25–486;25–485;25–475;25–488;25–485;25–457;25–380;25–488;25–495;25–478;25–451;25–494;25–492;25–495;25–492;25–495;25–495;25–478;25–495;25–488;25–486;25–486;25–449;25–479;25–492;25–490;25–455;25–486;25–480;26–497;91–522;91–488 |
| 1567 | 1–460;1–451;3–448;3–521 |
| 1569 | 1–546;1–371;1–505;1–673;1–427;1–450;1–496 |
| 1570 | 1–222;1–421;1–509 |
| 1571 | 1–307;1–482 |
| 1574 | 1–552;1–566 |
| 1575 | 1–248;1–503 |
| 1578 | 1–352;1–334;1–404 |
| 1580 | 1–462;1–507;1–215;1–468;1–510;1–410;1–459;1–470 |
| 1582 | 1–131;6–487 |
| 1585 | 1–481;1–492 |
| 1586 | 1457;1–499 |
| 1587 | 1–74;1–52;1–154;39–492 |
| 1588 | 1–484;1–484;7–106 |
| 1591 | 1–470;22–375;22–219;22–427;22–277;22–447;22–417;22–73;22–412;22–461;22–176;22–374;22–95;44–486;44–332 |
| 1592 | 1–471;22–492;22–510;22–218;22–426;22–509;22–276;22–494;22–512;22–506;22– |

TABLE II-continued (Tiling path)

| Seq Id No. | Positions of biological 5'ESTs |
|---|---|
| | 507;22–518;22–446.22–411;22–460;22–373;22–95;22–374;22–416;22–509;22–513;22–175;22–512;22–507;44–331 |
| 1593 | 1–472;1–611 |
| 1594 | 1–511;1–427;1–393;1–444 |
| 1596 | 1–71;1–79;1–79;1–71;1–71;1–79;1–71;1–71;1–71;1–71;1–71;1–71;1–79;1–79;1–71;1–68;1–79;1–71;1–79;1–71;1–79;1–71;28–534;28–538;28–526;28–454;28–444;28–514;28–473;28–540;28–87;28–278;28–492;28–535;28–409;28–485;28–488;28–477;28–411;28–348;28–472;28–496;28–436;28–523;28–531;28–349;28–537;28–514;28–534;28–505;28–496;28–506;28–514;28–540;28–535;28–457;28–496;28–127;28–506;28–539;28–523;28–534;28–444;28–514;28–421;28–492;28–493;29–493;29–411;29–523;30–514;30–257;30–473;30–354;30–464;30–411;30–412;30–535;30–514;30–415;30–514;30–462;30–514;30–392;30–536;30–493;30–431;30–514;30–455;30–514;30–514;30–444;30–534;30–536;30–464;30–514;30–514;30–496;30–536;30–532;30–523;30–333;30–514;30–506;30–514;30–436;30–473;30–529;30–405;30–378;30–496;30–465;30–459;30–539;30–514;30–506;30–493;30–464;30–537;30–314;30–493;30–473;30–540;30–436;30–460;30–361;30–514;30–412;30–541;30–492;30–492;30–538;30–349;30–374;31–420;31–539;31–536;31–496;31–490;31–534;31–541;31–492 |
| 1599 | 1–425;262–780 |
| 1600 | 1–462;1–322;1–432;30–527;30–527;30–355 |
| 1601 | 1–427;1–465 |
| 1602 | 1–373;–400;–440;1–458;62–464;62–341;113–561 |
| 1603 | 1–456;1–452;14–377;14–466;23–536;23–452;54–555;54–462;54–105;54–488 |
| 1604 | 1–324;242–678;252–672 |
| 1606 | 1–409;64–583;64–489;64–545;64–279;64–526;64–479;64–527;64–558;64–529;64–314;64–544;64–563;64–503;64–551;64–441;64–557;64–562;64–563;64–266;64–409;64–471;64–474;64–478;64–496;64–524;64–503;64–537;64–466;64–522;64–567;64–550;75–353;75–490;75–435;77–570;77–524;77–458;77–316;77–460;77–563;77–581;77–497;77–335;77–272;77–566;77–460;77–503;77–460;77–476;77–563;77–562;77–562;77–541;77–522;77–496;77–561;77–524 |
| 1607 | 1–494;1–480;1–506 |
| 1610 | 1–324;1–491;1–432 |
| 1611 | 1–430;1–394 |
| 1613 | 1–478;1–433 |
| 1615 | 1–481;1–494;1–504;1–509;1–480;1–511;1–500;1–467;1–438;1–504;1–481;1–513;1–385;1–418;1–378 |
| 1616 | 1–954;1–367;1–468;1–465 |
| 1617 | 1–482;1–483;1–363 |
| 1620 | 1–412;1–472 |
| 1621 | 1–423;54–499 |
| 1622 | 1–377;1–495;14–526;14–449;14–475;14–284;14–491;14–483 |
| 1624 | 1–477;1–403;1–302;1–410 |
| 1625 | 1–179;1–393;1–486;1–291;1–483;1–177;1–338;1–521 |
| 1626 | 1–437;1–463 |
| 1627 | 1–429;1–504;1–195;1–508 |
| 1629 | 1–348;1–332 |
| 1630 | 1–143;1–486 |
| 1631 | 1–472;1–472 |
| 1632 | 1–478;1–429;1–485;6–408;7–468;11–484;11–407;13–233;25–504;26–313;26–508;26–436;26–494;26–456;26–521;26–503;26–474;26–545;26–471;26–471;28–502;28–457;28–483;28–499;28–446;28–477;34–430 |
| 1634 | 1–485;1–464 |
| 1635 | 1–245;21–431;21–492;25–430;25–509;27–249;39–529;40–533;40–334;40–460;40–519;40–480;40–493;40–528;40–493;40–570;40–493;40–546;42–508;42–524;42–481;42–527;42–502;42–470;52–454 |
| 1638 | 1–428;5–437 |
| 1640 | 1–450;1–484 |
| 1642 | 1–163;1–456 |
| 1643 | 1–308;1–461;1–461;1–499;1–387;1–465;1–369;1–289;1–279;1–498;1–357;1–404;1–285;1–298;1–438;1–444;1–282;1–277;1–80;1–247;1–355;1–451;–311;1–600 |
| 1646 | 1–488;1–462;1–466;1–282;1–458;1–461;1–462;1–325;1–333;1–464 |
| 1647 | 1–201;–201;2–74;2–74;2–201;2–370;2–74;2–74;3–175 |
| 1649 | 1–403;16–483;30–575;44–568;44–535;44–542;44–527;44–568;44–564;44–182;44–405;44–407;44–535;44–420;44–568;44–205;44–581;44–568;44–539;44–406;44–563;44–526;44–250;44–494;44–449;44–525;48–527;51–474;51–559;51–143;51–438;60–574;104–419;117–218;117–568;119–571;119–568;119–542;119–453;119–575;119–575;120–454;120–185;120–576;120–412;123–558;150–413;150–505;150–581;150–579 |
| 1650 | 1–384;1–412;1–413 |
| 1652 | 1–222;1–449;1–458;1–473;1–400;1–385;1–473 |
| 1653 | 1–278;1–493;1–506;1–517 |
| 1654 | 1–429;1–477;1–478;1–505;1–480 |
| 1655 | 1–452;1–474;1–204;1–467 |
| 1658 | 1–276;1–380;2–398;85–542;85–584;85–554;93–367;93–637;93–470 |
| 1659 | 1–262;1–443;1–58;1–491;1–197;4–459;15–485;17–414;25–552;25–513 |
| 1660 | 1–227;10–422;10–451 |
| 1663 | 1–374;1–581 |
| 1664 | 1–105;1–145;4–489;4–477;4–489;4–737;4–438;4–375;4–498;6–356;6–491;6–407;6–505;6–487 |
| 1665 | 1–485;1–480 |
| 1666 | 1–430;1–641;88–515;88–568;88–566;90–571;135–374 |
| 1667 | 1–105;1–474;1–145;1–456 |
| 1669 | 1–520;1–329;2–473;2–481;2–484;2–423;2–483;2–520;2–422;2–444;2–222;2–470;2–445;2–438;2–525;2–483;2–286;2–480;2–445;2–447;2–483;2–352;2–505;2–447;2–520;2–482;2–585;2–520;2–421;2–223;2–267;2–449;2–478;2–447;2–485;2–464;2–483;2–444;2–452;2–451;2–505;2–523;2–447;2–483;2–505;2–514 |
| 1670 | 1–267;39–267 |
| 1671 | 1–105;1–459;1–145;4–489;4–455;4–531 |
| 1672 | 1–219;1–395;1–458;1–471 |
| 1677 | 1–583;2–601;2–505;2–523;2–490;2–501;2–549;2–95;2–353;2–377;2–581;2–510;2–461;2–554;2–467;2–525;4–469;4–467;4–435;4–449;4–470;4–244;5–412;16–448;39–405;39–501;39–493;39–518;39–500;39–501;39–513;39–595;39–317;41–437;41–562;41–520;41–549;41–560;55–495;68–378 |
| 1678 | 1–398;1–418;1–399;1–407;1–415;1–408;1–401;1–398 |

TABLE II-continued (Tiling path)

| Seq Id No. | Positions of biological 5'ESTs |
|---|---|
| 1680 | 1–376;1–352;1–94;3–243;38–55;38–686;38–316;67–377 |
| 1682 | 1–517;19–213 |
| 1683 | 1–433;68–484;68–485;68–463;68–465;68–485;68–484;68–484;68–484;68–484;68–461;68–467;68–452;68–445;68–467;68–483;68–411;68–461;68–460;68–473;68–477;68–484 |
| 1685 | 1–461;1–691 |
| 1687 | 1–390;1–517 |
| 1696 | 1–577;1–469 |
| 1704 | 1–503;1–621 |
| 1705 | 1–486;1–438;1–288;1–440;1–544;1–353;1–478;1–289;1–318;1–456;1–273;1–352;1–509;1–453;1–443;1–436;2–444 |
| 1706 | 1–489;1–312 |
| 1707 | 1–443;43–421;43–509;64–270;72–542 |
| 1709 | 1–347;1–509 |
| 1711 | 1–509;1–495;1–468;20–479;24–239;27–509;27–336;27–501;30–501;37–485;38–508 |
| 1714 | 1–305;1–481;1–434 |
| 1717 | 1–396;1–437;1–496;1–487 |
| 1718 | 1–476;1–429 |
| 1719 | 1–403;28–476;28–419;28–46;28–442;28–447;28–425;28–406;28–506;39–430 |
| 1720 | 1–511;1–401 |
| 1721 | 1–421;1–350;1–1062;1–355 |
| 1723 | 1–492;1–365;1–323;1–498;1–246;1–351;1–443;1–389;1–271 |
| 1726 | 1–474;1–494 |
| 1727 | 1–457;1–567 |
| 1733 | 1–483;1–466;1–485;1–499;1–479;1–466;1–465;1–483;1–467;1–471;1–492;1–568;1–416;1–498;1–500 |
| 1734 | 1–383;1–510;1–540 |
| 1736 | 1–476;1–505;1–465;1–477;1–477;1–481 |
| 1737 | 1–557;1–617;1–416;1–545;1–712 |
| 1738 | 1–575;1–501;1–649 |
| 1740 | 1–296;1–296;1–296;1–296;1–296;1–296;1–296;1–292;1–296;1–292;1–296;1–292;1–296 |
| 1741 | 1–289;1–478;1–478 |
| 1743 | 1–440;1–440;1–441;1–487 |
| 1744 | 1–512;1–416 |
| 1745 | 1–482;1–767 |
| 1750 | 1–498;1–453;1–486;6–483;6–492;6–365;6–540;6–485;6–465;6–484;6–423;6–486;6–521;6–465;6–514;6–453;6–506;6–489;6–433;6–492;6–478;6–506;6–486;6–465;6–434;6–492;6–484;6–498;6–257;8–464;8–453;18–492;18–492;18–435;18–453;18–431;37–541;40–353;40–525;40–492;40–531;40–511;40–344;40–113;40–529;40–540;40–542;40–541;40–550;40–550;40–492;40–531;41–453;56–571;56–498;56–543;56–559;56–543;56–438;56–531;56–548;56–544;56–542;56–554;56–549;56–587;56–547;56–560 |
| 1754 | 1–462;1–438;1–475 |
| 1755 | 1–466;1–487 |
| 1757 | 1–528;1–700 |
| 1758 | 1–517;8–224 |
| 1759 | 1–409;1–418;3–117 |
| 1760 | 1–127;8–105;9–492;9–186;9–229 |
| 1761 | 1–475;1–455 |
| 1765 | 1–301;1–544;1–374 |
| 1770 | 1–460;1–358;1–421 |
| 1771 | 1–421;1–664 |
| 1772 | 1–414;1–474;1–196;1–581;1–496 |
| 1773 | 1–472;1–50;1–51 |
| 1775 | 1–425;1–483;1–497;1–502;1–476;1–470;1–470;1–467;1–507;1–480;1–464;1–407;1–502;1–379;1–480;1–477;1–499;1–359;1–335;1–488;1–489;1–469;1–496;1–417;1–517;1–496;1–498;1–392;1–480;1–488;1–546;1–505;1–393;1–497;1–272;1–464;1–503;1–520;1–434;1–497;1–467;1–458;1–488;1–462;1–262;1–378;1–463;1–507;1–86;1–452;1–502;1–445;1–444;1–393;1–497;1–368;1–359;1–505;1–464;1–480;1–505;1–386;1–435;1–423;1–50;1–475;1–392;1–493;1–452;1–509;1–500;1–500;–393;1–431;1–556;1–498;1–505;1–489;1–392;1–468;1–489;1–369;1–502;1–435;1–377;1–398;1–409;1–421;1–496;1–467;1–51;1–470;1–499;1–509;1–480;1–439;1–480;1–543;1–502;1–516;1–429;1–491;1–487;1–435;1–500;1–502;1–274;1–393;1–413;1–494;1–464;1–489;1–452;1–328;1–488;1–535;1–554;1–482;1–488;1–464;1–414;1–385;1–469;1–358;1–386;1–392;1–493;1–495;1–386;1–237;1–515;1–339;1–480;1–386;1–240;1–504;2–375;2–456;5–379 |
| 1777 | 1–441;1–462 |
| 1782 | 1–512;1–385 |
| 1783 | 1–297;1–297;8–714;8–493;8–380;8–296;16–297;66–474 |
| 1786 | 1–622;1–509 |
| 1787 | 1–296;1–231;1–304;1–294;1–304;1–308;1–308;1–304;1–308;1–269;1–304;1–304;1–308;1–308;1–308;1–308;1–308;1–304;1–304;1–304;1–304;1–308;1–308;1–304;1–304;1–308 |
| 1788 | 1–435;1–190;1–497 |
| 1791 | 1–518;1–499;1–504;1–508;1–548;1–121;1–450;1–493;1–445;1–500;1–452;1–529;1–417;1–487;1–488;1–499 |
| 1792 | 1–514;1–542;1–517;1–525;1–468;1–558;1–517;1–483;1–502;1–441;1–558;1–160;1–512;1–558;1–428;1–523;1–558;1–517;1–536 |
| 1794 | 1–420;1–477;1–470 |
| 1795 | 1–513;1–477;13–389;16–489;20–462 |
| 1796 | 1–413;1–302;24–433;24–446;24–416;52–462;52–413;52–412;66–554 |
| 1797 | 1–497;1–497;1–331 |
| 1799 | 1–503;1–462;1–486 |
| 1801 | 1–269;12–444;58–465 |
| 1802 | 1–465;1–448;1–509 |
| 1803 | 1–521;55–499;64–385;72–522;72–402;72–580;72–560;72–479;72–534;72–573;72–524;94–548;95–565;95–407;95–510;95–514;95–540;95–594;95–578;95–521;95–601;95–581;95–540;95–606;99–375;99–559;99–642;99–629;99–494;99–242;99–598;99–565;99–575;99–272;99–559;99–590;99–617;99–590;99–586;99–629;99–585;99–474 |
| 1806 | 1–502;1–483;1–500;3–499;6–459;6–484;6–491;6–504;6–460;6–510;6–503;28–438;28–472;28–344;28–500;28–387;28–479;28–500;28–476;28–491;28–439;29–460;29–438;29–387;29–379;29–504;29–451;29–460;29–458;29–460;29–289;31–503;32–506;33–500;33–460;33–404;33–489;39–327;42–504;48–486;48–490 |
| 1808 | 1–469;1–280;1–456;10–77;10–75;10–75;10–77;10–75;10–75;10–75;10–77;10–75;10–75;10–75;10–77;10–77;10–75;10–75;10–77;10–77;10–75;10–75;10–77;10–77;10–75;10–75;10–75;10–77;10–77;10–75;48–411;55–471;55–421;55–459;57–398;66–526;76–418;97–518;99–478;103–475 |
| 1812 | 1–382;1–490;1–473 |
| 1814 | 1–534;1–712 |
| 1815 | 1–516;3–434 |

TABLE II-continued (Tiling path)

| Seq Id No. | Positions of biological 5'ESTs |
|---|---|
| 1818 | 1–450;1–519 |
| 1819 | 1–453;–234;3–425;5–485;5–298;5–222;5–491;5–359;5–463;5–286;5–485;5–429;5–388;6–423;6–472;6–351;6–484;6–286;6–305;6–458;6–321;6–382;6–348;6–495;6–482 |
| 1820 | 1–439;1–580 |
| 1822 | 1–486;1–579;1–476;13–187;15–85;15–85;15–85;15–85;15–354;15–85;16–118 |
| 1824 | 1–482;1–460 |
| 1827 | 1–331;17–381;17–428;17–428;51–338;56–402;57–547;57–306 |
| 1828 | 1–446;19–642;19–500 |
| 1830 | 1–449;1–462 |
| 1833 | 1–429;1–517 |
| 1835 | 1–459;1–527;3–558;38–615;38–443;38–478;38–462;68–545;68–513;68–559 |
| 1836 | 1–454;1–458 |
| 1837 | 1–473;1–437;1–486;1–373;1–262;1–438 |
| 1839 | 1–454;1–451;1–466;1–484;1–440;1–452;1–564;1–454;1–445;24–467 |
| 1842 | 1–476;1–455 |
| 1845 | 1–384;9–478;36–491;36–425;15–577;115–444;115–642;115–642;115–463;115–537;115–626;115–546;142–652;142–641 |
| 1847 | 1–461;1–461 |
| 1848 | 1–462;1–456 |
| 1850 | 1–504;1–526 |
| 1852 | 1–517;1–487;1–452 |
| 1854 | 1–428;1–671;18–508;19–437;21–504;21–595;21–517;21–593;21–494;21–436;21–522;21–514;21–463;21–384;21–443;21–533;21–488;39–415;39–425;66–558 |
| 1856 | 1–440;64–436;64–488;64–404;64–474;64–155;64–385;64–504;64–480;64–507;64–510;74–510 |
| 1859 | 1–408;1–465;1–452 |
| 1860 | 1–78;1–302;1–477;1–477;1–471;1–456;1–326;1–463;1–443;1–454;1–450;1–444;1–477;1–462;1–237;1–354;1–477;1–477;1–444;1–482;1–439;1–480;1–459;1–457;1–431;1–443;1–338;1–314;1–477;1–57;1–460;1–367;1–462;1–263;1–477;1–476;1–435;1–487;1–227;1–433 |
| 1862 | 1–490;1–612 |
| 1863 | 1–463;1–492;1–204;1–344;1–469;1–457;1–464;1–492;1–468;1–498;1–230;1–352;1–391;1–465;1–457;4–596;4–406;24–487;28–458;28–529;28–31 5;28–526;28–529;29–509;33–520;33–529 |
| 1864 | 1–362;1–468;1–411 |
| 1866 | 1–216;1–436;1–500;1–334;2–418;2–503;9–273 |
| 1867 | 1–430;371–836;373–765;373–870;373–771;374–773;374–870;375–871;376–882;376–865;376–824;378–771;378–763;378–773;378–876;391–764;394–773;394–748;396–702;396–871;401–880;401–826;401–773;401–773;401–768;401–722;401–881;401–934;401–909;401–761;401–900;401–754;401–810;401–884;401–899;401–886;401–899;401–752;401–773;401–765;401–800;401–872;401–772;401–799;401–891;401–871;401–876;401–811;401–836;401–871;404–881;404–764;404–894;404–844;404–888;404–862;404–774;404–889;404–872;404–773;406–764;407–882;407–861;407–674;409–880;409–865;409–884 |
| 1869 | 1–447;1–476 |
| 1870 | 1–498;1–509;1–480 |
| 1873 | 1–487;1–487;1–470;108–604;108–540;536–935 |
| 1874 | 1–501;1–450;1–417;1–448;1–508;1–514 |
| 1875 | 1–514;1–480;1–533;1–726 |
| 1877 | 1–496;–294;1–667 |
| 1879 | 1–395;78–493 |
| 1881 | 1–212;2–195;2–471;14–457;14–171;14–113;16–192 |
| 1884 | 1–485;1–406;1–331;1–483;3–488;51–487;51–521 |
| 1887 | 1–501;1–515;1–450;1–417;1–448;1–510 |
| 1891 | 1–522;1–479;44–201;44–600;44–640 |
| 1892 | 1–146;1–443 |
| 1893 | 1–284;1–497;1–431;14–436;61–477 |
| 1900 | 1–491;1–498 |
| 1901 | 1–264;1–559 |
| 1904 | 1–447;1–501 |
| 1905 | 1–540;1–406;1–419;1–464;1–453 |
| 1906 | 1–486;56–158 |
| 1907 | 1–424;1–470;1–413;1–474 |
| 1909 | 1–499;22–396 |
| 1913 | 1–463;1–386;1–397;1–509;1–394;1–393;1–405;1–411;1–487;1–467;1–458;1–465;1–472 |
| 1914 | 1–456;1–322 |
| 1918 | 1–453;1–83;1–419 |
| 1919 | 1–470;1–471 |
| 1920 | 1–524;1–535;1–663 |
| 1923 | 1–234;1–208;1–198;2–150;3–192;3–388;3–161 |
| 1925 | 1–418;1–487 |
| 1930 | 1–404;1–486;1–488;4–468;4–477;4–168;8–352;8–439;8–428;8–367;8–474;8–324 |
| 1934 | 1–530;1–475 |
| 1936 | 1–293;4–386;41–265;41–438;41–402;41–468;41–650;41–400 |
| 1945 | 1–654;1–413;18–491;19–422;21–487;2–578;21–500;21–576;21–421;21–477;21–505;21–497;21–370;21–448;21–430;21–516;21–471;39–410;39–400 |
| 1947 | 1–492;1–1013;1–468;1–193;1–355;1–544;1–481;1–485;1–452;1–442;1–491 |
| 1950 | 1–442;1–477;1–450;1–481;3–533 |
| 1951 | 1–260;1–304;1–427 |
| 1955 | 1–447;1–495;1–432;1–475;1–506 |
| 1957 | 1–439;1–486 |
| 1960 | 1–552;30–501;30–410 |
| 1961 | 1–485;1–531;1–385;1–435;160–668 |
| 1962 | 1–435;1–493;1–508;1–440 |
| 1963 | 1–74;1–83;5–482;7–427;8–482;8–468 |
| 1964 | 1–325;1–427;1–534 |
| 1965 | 1–442;1–490;1–477;1–450;1–486 |
| 1967 | 1–350;1–473;1–393;1–548 |
| 1968 | 1–511;162–531;162–609 |
| 1969 | 1–708;1–486;428–708 |
| 1970 | 1–496;47–209 |
| 1971 | 1–483;171–488;171–482;171–430;171–483 |
| 1972 | 1–440;1–474;1–407;1–484;1–570;1–495;1–519;1–415;1–366;1–444;1–542;1–429;1–251;1–198;1–373;1–418;1–466;1–402;1–452;1–377;1–483;1–563;1–306;1–484 |
| 1973 | 24–427;24–446;24–429;24–175;24–445;24–446;26–326;26–442;26–404;26–442;27–440;27–326;31–446;31–446;31–456;31–462;33–249;33–450;33–206;33–447;33–442;33–440;33–424;33–442;33–467;33–444;33–430;33–447;33–444;33–440;33–437;33–444;33–444;33–442;33–426;33–448;33–303;33–451;33–444;33–290;33–442;33–448;33–447;33–448;33–440;33–110;33–441;33–441;33–459;33–442;33–442;33–442;33–442;33–461;33–424;33–444;33–441;33–440;33–430;33–449;33–282;33–448;33–442;33–458;33–442;33–417;33–461;33–416;33–463;33–444;33–447;33–417;33–457;33–442;33–444;33– |

TABLE II-continued (Tiling path)

| Seq Id No. | Positions of biological 5'ESTs |
|---|---|
| | 431;33–441;33–423;33–421;33–406;33–436;33–413;33–459;33–429;33–462;34–446;36–447;36–447;36–423;36–447;36–447;36–464;36–423;36–447;36–428;36–292 |
| 1974 | 1–374;1–391;2–137;2–261;2–137;2–137;2–137;2–137;2–137;2–137;2–380;2–137;2–391;2–268;2–137;2–137;2–137;2–125;3–376;37–502 |
| 1975 | 1–470;1–426 |
| 1976 | 1–394;1–398;1–398 |
| 1977 | 1–276;1–478 |
| 1978 | 1–439;1–439;1–358;1–491 |
| 1979 | 1–450;1–381;1–91;1–396 |
| 1980 | 1–278;7–370;80–345;97–340 |
| 1982 | 1–470;1–471 |
| 1983 | 1–441;1–512;1–230;1–396;1–489;1–437;1–456;1–490;1–489 |
| 1984 | 1–408;14–405;320–731;320–686;320–809;320–733;320–704;320–782;320–451;320–747;320–786;320–834;320–792;320–734;320–777;320–726;514–717 |
| 1985 | 1–507;1–455 |
| 1993 | 1–281;1–486;1–444 |
| 1994 | 1–482;1–451;1–372 |
| 1995 | 1–503;1–479;1–540;3–621 |
| 1997 | 1–474;1–468;1–477;2–452;2–237;34–439 |
| 1998 | 1–463;5–543;5–463 |
| 2000 | 1–497;1–487 |
| 2003 | 1–464;1–456;1–464;1–345;1–480;1–463;18–475;49–567 |
| 2004 | 1–454;11–466;11–474;11–474;11–355;11–490;11–473;28–485 |
| 2005 | 1–256;1–511;1–427;2–376;2–419;2–256;3–471;3–473;3–491;3–493;3–464;3–417;3–446;3–261;3–213;3–494;3–280;3–424;3–425;3–350;3–491;3–428;3–471;3–401;3–459;3–500;3–464;3–446;3–355;3–417;3–416;3–493;3–403;3–464;3–626;3–468;3–446;3–467;3–418;3–471 |
| 2006 | 1–422;1–423;1–464;1–357;2–468;2–412;2–447;2–250;2–455;2–455;2–464;2–468;2–453;2–463;4–502;4–452;4–487;14–447;14–420;14–424;36–336;36–109;36–345;37–445;52–427;273–800 |
| 2007 | 1–46;1–432 |
| 2008 | 1–260;1–495 |
| 2009 | 1–494;2–518;2–518;3–434;6–478;7–497;7–434;10–471;10–498;11–215;13–449;32–495;32–502;32–449;32–499;32–478;32–503;32–517;32–506;33–497;33–400;33–522;33–449;33–505;33–517;33–497;33–520;33–495;33–519;33–492;34–501;34–493;34–495;34–501;34–476;34–513;34–478;34–515;34–489;34–497;36–449;36–511;38–494;38–492;38–498;38–475;38–496;38–502;38–494;38–496;38–501;38–508;38–519;38–188;38–520;38–426;38–495;38–501;38–492;38–440;38–449;38–510;38–499;38–478;38–478;38–497;38–478;38–495;38–395;45–504;45–498;45–495;45–478;45–510;45–473;45–519;46–493;47–426;49–497;49–476;49–505;49–491;50–473;50–502;50–508;50–520;50–510;50–408;50–492;50–449;50–504;50–502;50–510;50–470;51–497;55–370;55–520;55–519;55–277;70–512;78–508;78–497;78–510;78–496;78–510;78–478;78–505;78–478;78–489;78–504;78–501;78–520;78–510;78–507;78–522;78–513;78–513;78–513;78–496;78–487;78–510;78–394;78–20 1;78–507;78–505;78–510;78–520;78–497;78–284;78–355;78–509 |
| 2010 | 1–419;1–421;1–370;1–419;1–404;1–421;1–418;1–420;1–419 |

TABLE II-continued (Tiling path)

| Seq Id No. | Positions of biological 5'ESTs |
|---|---|
| 2011 | 1–514;1–508;1–472;1–509;1–428;1–484;1–498;1–478;1–455 |
| 2017 | 1–497;1–506;1–517;1–489;12–401;12–346;12–517;12–453;12–227;12–381;12–223;12–260;18–585;21–507;23–510;23–532;33–524;33–603;33–454;34–469;34–456;34–229;34–527;34–520;34–521;34–525;34–517;34–475;34–349;34–455;34–537;34–546;34–409;34–438;34–557;34–351;34–506;34–457;34–493;34–523;34–418;34–482;34–635;34–473;34–355;34–532;34–531;37–358;37–502;37–518;37–508;37–545;40–377;40–497;43–516;44–528;45–507;46–596;52–363;64–252;64–544;67–546;166–617;226–635;226–583 |
| 2018 | 1–502;8–468;11–481;11–455;11–456 |
| 2019 | 1–432;1–603;1–67 |
| 2020 | 1–389;1–473 |
| 2021 | 1–491;1–515;1–420;1–486;1–445;1–84;1–435;1–474;1–503;1–491;1–479;1–444;1–439;1–497;1–341;1–472;1–405;1–494;1–497 |
| 2024 | 1–594;2–365;2–489;2–477 |
| 2028 | 1–255;1–345 |
| 2029 | 1–462;1470;1–422;1–380 |
| 2030 | 1–534;1–427 |
| 2034 | 1–482;1–463;1–500;1–506 |
| 2035 | 1–468;1–492 |
| 2036 | 1–473;1–573;1–587 |
| 2037 | 1–143;1–55;1–507 |
| 2038 | 1–466;1–365 |
| 2040 | 1–475;1–497;1–501 |
| 2042 | 1–430;29–494 |
| 2043 | 1–483;1–464 |
| 2044 | 1–220;9–131;9–179;9–160;9–232;9–73;9–162;9–160;9–242;9–135;9–481;9–58;9–148;9–191;9–84;9–160;9–190;9–160;9–81 |
| 2046 | 1–386;1–462;1–462 |
| 2048 | 1–516;1–526;1–223 |
| 2050 | 1–440;1–457;1–482 |
| 2051 | 1–539;1–464;1–521;11–487;11–397;11–507;11–538;11–510;11–429;11–476;11–462;22–453;25–450;25–387;25–530 |
| 2053 | 1–462;182–666;182–477;227–733;412–820 |
| 2055 | 1–279;1–662;1–481 |
| 2067 | 1–461;1–236 |
| 2068 | 1–466;312–617 |
| 2069 | 1–446;1–503;1–435 |
| 2075 | 1–460;1–558 |
| 2082 | 1–602;219–665;219–670;219–616;219–665;219–513;219–672;219–665;219–658;219–524;219–671;219–640;219–634;219–642;219–601;219–669;219–673;219–664;219–665;219–663;219–665;219–664;219–664;219–661;219–665;219–658;219–677;219–662;219–616;219–665;219–671;221–669;221–673;221–665;221–660;221–625;221–673;221–670;221–673;221–591;221–578;221–667;221–666;221–672;221–667;221–673;221–440;221–669;221–655;221–668;221–665;221–640;221–685;221–657;221–580;221–640;221–675;221–493;221–434;221–670;221–654;233–657 |
| 2090 | 1–448;1–390;1–363;1–356;1–415;1–480;1–415 |
| 2100 | 1–466;1–481;1–486;1–435;1–501;1–492;1–309;1–480;1–453;1–484;1–313;1–451;1–501;1–457;1–448;1–505;1–438;1–375;1–439;1–424;1–477;1–476;1–490;1–478;1–420;1–505;1–503;1–482;1–96;1–300;1–503;1–488;1–501;1–434;1–470;1–491;1–305;1–479;1–488;1–483;1–461;1–501;1– |

TABLE II-continued

(Tiling path)

| Seq Id No. | Positions of biological 5'ESTs |
|---|---|
| | 501;1–436;1–501;1–397;1–375;1–505;1–394;1–475;1–459 |
| 2121 | 1–406;24–407;95–241;95–240;95–240;95–241;95–179;95–236;95–402 |
| 2123 | 1–396;1–533 |
| 2132 | 1–388;1–371;1–376;3–335 |
| 2144 | 1–451;1–533 |
| 2156 | 1–600;1–478;1–471;1–510 |
| 2167 | 1–512;1–476;1–479;1–481;1–473;1–464 |
| 2170 | 1–192;1–489;1–532;1–297;1–505 |
| 2174 | 1–315;2–543;2–444;2–469;2–462;2–564;2–479 |
| 2187 | 1–428;9–451 |
| 2189 | 1–488;1–503 |
| 2194 | 1–455;1–266;1–320;1–394;18–404;18–487 |
| 2195 | 1–455;1–266;1–320;1–394;18–404;18–568 |
| 2198 | 1–439;1–439 |
| 2200 | 1–205;1–413;1–506;1–475;1–544;1–393;1–476;1–543 |
| 2209 | 1–397;3–475;405–892 |
| 2210 | 1–499;1–486 |
| 2218 | 1–426;1–510 |
| 2220 | 1–341;1–473 |
| 2239 | 1–482;1–482;1–370;1–401;1–508 |
| 2256 | 1–428;25–507;25–514;25–517;25–516;25–537;25–508;25–553;25–453;25–475;25–510;25–518;25–525;25–472 |
| 2258 | 1–428;25–508;25–453;25–475;25–472 |
| 2260 | 1–470;1–395;1–315;1–404;1–472;1–472;1–460;1–460 |
| 2261 | 1–345;1–460;1–428 |
| 2262 | 1–283;1–599;1–497 |
| 2282 | 1–466;1–495;1–471;1–456;1–451;1–501;1–537;1–414;1–468;1–430;1–426 |
| 2312 | 1–425;1–468 |
| 2334 | 1–428;1–360;1–443 |
| 2351 | 1–387;86–616 |
| 2355 | 1–479;1–339;1–413 |
| 2356 | 1–181;1–407;1–476;1–488;1–404;1–470;1–477;1–488 |
| 2360 | 1–376;26–190;26–540 |
| 2366 | 1–478;1–531;1–478;1–513 |
| 2367 | 1–494;1–357;1–534;5–212;5–551;5–311;5–558;5–500;5–398;5–372;5–505;5–496;5–358;5–507;5–554;5–499;5–510;5–374;5–221;5–389;5–373;5–340;6–543;6–389;6–366;6–108;6–339;6–136;6–537;6–560;6–393;6–389;6–533;6–492;6–199;6–551;6–388;6–73;6–500;6–510;6–388;6–388;6–507;6–559;6–540;6–505;6–565;6–68;6–309;6–374;6–290;6–136;6–558;6–366;6–537;6–537;6–213;6–507;6–403;6–487;6–136;6–374;6–494;6–136;6–499;6–236;6–496;6–374;6–542;6–321;6–561;6–507;6–321;6–374;6–275;6–299;6–193;6–512;6–489;6–356;6–368;6–494;6–384;6–226;6–366;6–308;6–497;6–385;6–137;6–501;6–374;6–340;6–559;6–138;6–496;6–136;6–506;6–382;6–490;6–120;6–494;6–374;6–134;6–134;6–511;6–338;6–374;6–333;6–540;6–493;6–503;6–136;6–507;6–511;6–374;6–374;6–374;6–558;6–533;6–499;6–235;6–128;6–500;6–386;6–134;7–290;7–294;7–503;7–200;7–373;7–374;8–213;9–385;11–340;11–145;11–558;11–537;11–339;11–509;11–272;11–554;11–496;11–558;11–134;11–558;11–199;11–507;11–489;11–496;11–403;11–292;11–312;11–235;11–558;11–355;11–507;11–546;11–147;11–389;11–339;11–374;11–554;11–300;11–138;11–300;11–5 |
| 2368 | 1–350;1–148;1–437;1–472 |
| 2369 | 1–441;1–489;1–489 |
| 2370 | 1–348;1–427;1–454;1–294;2–220 |
| 2371 | 1–388;1–371;1–388;1–374;1–387;1–50 |
| 2372 | 1–474;12–474;22–481;22–510;22–455;22–462;46–502;46–552;121–556;138–531 |
| 2373 | 1–523;1–427;1–497;1–413;1–471;1–457;1–470;1–517;1–458;1–497 |
| 2376 | 1–430;1–520;1–472 |
| 2379 | 1–528;1–488;1–442;1–531;1–458;1–528;1–528;1–515;1–515;1–534;1–534;1–507;1–515;1–515;1–530;1–528;1–515;1–528;1–507;1–514;1–528;1–489;1–473;1–415;1–515;1–507;1–512;1–534;1–515;1–515;1–529;1–515;1–515;1–429;1–515;1–435;1–507;1–528;1–531;1–534;1–503;1–531;1–528;1–458;1–527;1–481;1–507;1–515;1–514;1–531;1–530;1–529;1–528;1–515;1–485;1–515;1–515;1–531;1–507;1–515;1–502;1–515;1–425;1–473;1–534;1–379;1–515;1–524;1–531;1–443;1–423;1–479;1–458;1–507;1–376;1–499;1–386;1–458;1–528;1–517;1–515;1–515;1–421;1–454;1–515;1–531;1–423;1–507;1–530;1–529;1–531;1–516;1–515;1–507;1–392;1–531;1–515;1–514;1–515;1–515;1–502;1–514;1–478;1–482;1–499;1–531;1–433;1–454;1–380;1–463;1–54;1–534;1–531;4–507 |
| 2384 | 1–459;1–432;1–456;1–249;1–455;1–170;1–239;1–429;1–247;1–246;1–84;1–247;1–244;1–232;1–239;1–246;1–415;1–243;1–389;1–319;1–226;1–430;1–372;1–84;1–456;1–397;1–85;1–379;1–456;1–389;1–84;1–154;1–200;1–198;1–456;1–93;1–265;1–153;1–239;1–212;1–93;1–242;1–355;1–420;1–389;1–385;1–395;1–383;1–456;1–52;1–170;1–75;1–247;1–322;1–343;1–443;1–250;1–456;1–103;1–105;1–105;1–104;1–429;1–264;1–389;1–56;1–295;1–154;1–245;1–245;1–267;1–225;1–219;1–264;1–104;1–395;1–120;1–456;1–246;1–264;1–459;1–73;1–250;1–247;38–434;211–649;211–626;222–467;302–660 |
| 2387 | 1–355;1–439;1–447;1–517;1–488;1–488 |
| 2390 | 1–445;1–523;1–471;1–477;1–489;1–354;1–445 |
| 2392 | 1–489;369–856 |
| 2396 | 1–349;1–487;57–497 |
| 2397 | 1–370;1–513;1–584;1–529;1–485;1–580;1–579;1–489;1–505;1–488;1–464;1–467;1–423;1–529;1–318;1–314 |
| 2400 | 1–396;1–459 |
| 2401 | 1–487;10–348;10–407;10–442;10–256;10–217;10–442;16–457 |
| 2407 | 1–496;1–339 |
| 2408 | 1–171;1–374 |
| 2410 | 1–360;1–451;1–468;1–460 |
| 2411 | 1–437;1–465;2–248;2–392;2–515;2–476;2–287;2–472;2–244;2–385;2–183;2–480;2–427;2–96;2–75;2–535;2–445;2–168;2–287;2–472;2–244;2–385;2–183;2–480;2–427;2–96;2–75;2–535;2–445;2–168;2–558;2–485;2–117;2–296;2–519;2–123;2–483;2–516;2–444;2–340;2–519;2–298;2–529;2–239;2–445;2–91;2–503;2–366;2–477;2437;2–325;2–350;2–334;3–210;3–119;4–284;4–502;4–483;4–491;4–337;4–471;4–234;232–762;333–392;410–781;490–845;490–857 |
| 2414 | 1–458;2–447;19–548;26–416 |
| 2416 | 1–426;1–199;1–199;1–199;3–64;3–306;3–226;5–208;75–488;75–490 |
| 2417 | 1–41;14–408;322–739;322–693;322–814;322–741;322–711;322–790;322–454;322–755;322–794;322–800;322–742;322–785;322–734;518–723;534–930 814;322–741;322–711;322–790;322– |

TABLE II-continued

(Tiling path)

| Seq Id No. | Positions of biological 5'ESTs |
|---|---|
| | 454;322–755;322–794;322–800;322–742;322–785;322–734;518–723;534–930 |
| 2418 | 1–489;1–369 |
| 2419 | 1–220;101–505 |
| 2421 | 1–345;1–476 |
| 2423 | 1–501;1–491;6–463 |
| 2424 | 1–347;1–251 |
| 2425 | 1–480;1–488 |
| 2426 | 1–506;1–398;1–475;1–444 |
| 2427 | 1–492;13–447;17–516;18–442;18–445;18–475;18–480;18–481;18–491;18–256;18–445;18–478;18–306;19–464;21–474;21–425;22–495;22–478;22–481;23–404;26–437;32–506 |
| 2431 | 1–433;1–520;1–469;1–380;1–542;1–476;1–433;1–511;1–309;1–465 |
| 2432 | 1–482;1–489;20–490 |
| 2433 | 1–158;1–376;1–377;1–537 |
| 2435 | 1–461;1–388;1–557;1–337;1–490 |
| 2436 | 1–380;21–493;32–471;32–336 |
| 2438 | 1–422;1–433 |
| 2439 | 1–496;1–581;1–489 |
| 2440 | 1–265;1–522;1–480;1–456;1–432 |
| 2442 | 1–401;1–444 |
| 2445 | 1–472;1–504 |
| 2446 | 1–367;1–430 |
| 2447 | 1–229;19–485 |
| 2452 | 1–196;1–461;1–230;1–309;1–467;1–425;1–437;1–449;1–417;1–460;1–465 |
| 2453 | 1–480;18–450;18–514;18–465;18–562;18–330;18–520;18–476;18–432;18–375;18–494;18–406;18–426;18–468;18–494;18–522;18–435;18–554;18–220;18–368;18–466;18–469;18–428;18–543;18–129;18–477;18–466;18–234;18–417;18–502;18–469;18–513;18–560;18–553;18–388;18–435;18–433;18–525;18–446;18–514;33–506;34–489;34–502;34–369;34–571;34–410;34–397;34–516;34–448;34–506;34–569;34–480;34–259;34–336;34–571;34–421;34–563;34–450;34–514;34–531;34–261;34–536;34–525;34–551;34–506;34–565;34–96;38–371;49–505;49–510;49–131;49–242;49–525;49–453;49–571;49–530;49–469;49–543;49–544;49–518 |
| 2454 | 1–434;1–551;83–285;83–194;83–299;99–323;99–323;99–161;114–196;114–307 |
| 2462 | 1–484;1–498;1–490 |
| 2464 | 1–250;1–499 |
| 2465 | 1–434;1–478;1–498;1–389 |
| 2466 | 1–453;18–378;18–489;18–483;18–386 |
| 2467 | 1–399;1–205;1–358;1–383;1–511;1–385 |
| 2468 | 1–314;1–465;1–408;1–493;1–441;1–292;1–492 |
| 2469 | 1–452;41–358 |
| 2470 | 1–263;1–381;1–293;1–422;1–553;1–556;2–462;2–382;2–200;2–473;2–429 |
| 2471 | 1–362;1–396;1–457 |
| 2475 | 1–527;1–501 |
| 2478 | 1–270;1–266;1–266;1–86;1–255;1–268;1–270;1–267;1–467 |
| 2479 | 1–323;1–360;1–357 |
| 2481 | 1–537;1–483 |
| 2482 | 1–343;1–479 |
| 2484 | 1–514;1–449;1–342 |
| 2485 | 1–430;1–458;1–459;1–469;1–102;6–259;7–532;7–464;7–331;7–348;8–443;8–488;8–282;8–422;8–472;8–582;8–419;8–55;8–330;8–437;8–55;13–433;50–547;50–525;50–507;50–547;50–561;50–533;50–524;50–531;50–530;50–319;53–549;53–552;53–545;53–524;53–417 |
| 2486 | 1–406;1–420 |
| 2487 | 1–549;3–410;3–526;3–507;3–541;3–276;3–506;3–518;3–378;3–435;3–489;3–542;3–509;3–518;3–276;3–317;3–462;3–548;4–308;4–436;4–542;4–518;4–180;4–498;4–526;4–492;4–461;4–462;4–462;4–462;4–462;4–518;4–512;4–510;4–167;4–509;4–498;4–489;4–324;4–332;4–462;4–430;4–494;4–462;4–526;4–518;4–480;4–498;4–543;4–493;4–489;4–410;4–526;4–518;4–518;4–509;4–526;4–526;4–495;4–526;4–461;4–481;6–498;6–393;6–548;6–509;6–122;6–518;6–526;6–542;6–549;6–551;6–317;6–410;6–435;6–506;6–435;6–325;6–492;6–498;6–462;6–442;6–332;6–507;6–549;6–509;6–518;6–546;6–526;6–548;6–410;6–462;6–460;6–462;6–462;6–526;6–492;6–495;6–317;6–533;6–518;6–462;6–506;6–518;6–402;6–548;6–545;6–509;6–518;6–461;6–484;6–496;6–541;6–509;6–498;6–462;6–489;6–440;6–493;6–283;6–435;6–286;6–427;6–489;6–518;6–481;6–526;6–410;6–462;6–497;6–507;6–492;6–461;6–518;6–518;6–518;6–544;6–498;6–143;6–526;6–332;6–462;6–506;6–480;6–443;6–435;6–526;6–461;6–462;6–492;6–380;6–376;6–518;6–526;6–462;6–518;6–551;6–462;6–498;6–526;6–494;6–460;6–462;6–308;6–518;6–462;6–518;6–462;6–542;6–489;6–54 |
| 2489 | 1–344;1–410;1–241 |
| 2490 | 1–406;1–493;1–358 |
| 2492 | 1–533;1–377 |
| 2493 | 1–50;1–50;1–453;397–895 |
| 2494 | 1–561;1–498;1–339;1–404;1–377;1–494;1–477;1–462;1–453;1–508;1–486;1–498 |
| 2496 | 1–486;1–458 |
| 2497 | 1–491;295–793 |
| 2499 | 1–503;322–780 |
| 2500 | 1–278;1–300;1–291;1–290;1–277;1–240;1–278;1–300 |
| 2502 | 1–391;1–405;1–392 |
| 2503 | 1–377;1–453;1–457;1–476;1–334;1–316 |
| 2505 | 1–428;15–509;15–431;15–519;15–463;15–448;15–432;15–493;15–281;21–492;21–543;21–443 |
| 2506 | 1–479;1–507 |
| 2508 | 1–468;1–479;1–465;1–477;1–442;1–465;1–471;1–469;1–449;1–368;1–479;1–479;1–467;1–465;1–468;1–411;1–479;1–423;1–479;1–466;1–464;1–479;1–472;1–376;1–464;1–488;1–269;1–465;1–464;1–479;1–467;1–407;1–479;1–479;1–479;1–464;1–410;1–479;1–466;1–465;1–479;1–488;1–391;1–431;1–277;1–464;1–463;1–479;1–468 |
| 2510 | 1–489;32–423 |
| 2511 | 1–508;1–407;1–447;1–491;1–258;1–504 |
| 2516 | 1–317;1–553 |
| 2520 | 1–486;27–498;37–495;37–511;37–518;37–507;37–517;37–518;37–525;37–516;38–507 |
| 2522 | 1–436;1–452;1–394 |
| 2523 | 1–510;1–538;1–430;1–469;1–367;1–482;1–492;1–509;1–520;1–470;17–380;17–370;17–519 |
| 2524 | 1–510;1–492;1–600;1–430;1–469;1–367;1–482;1–509;1–520;1–470;17–555;17–380;17–370;17–519 |
| 2528 | 1–495;1–473;1–442;1–513;1–475;1–492 |
| 2529 | 1–358;1–494;1–77;1–128;1–490;1–228;1–493;1–429;1–481;1–483;1–326;1–257;1–504;1–507;1–501;1–525;1–508;1–257 |
| 2530 | 1–444;1–500;1–448;1–393;1–496;1–232 |
| 2535 | 1–463;1–381 |
| 2539 | 1–448;27–484 |

TABLE II-continued (Tiling path)

| Seq Id No. | Positions of biological 5'ESTs |
|---|---|
| 2540 | 1–575;1–402;1–388;2–467;2–508;2–327;13–398;41–552;70–546;70–497;74–566;74–560;131–224;131.224;131–224;131–224;131–224;131–224;520–985 |
| 2541 | 1–508;1–418 |
| 2542 | 1–484;1–484 |
| 2543 | 1–544;1–496;1–496 |
| 2544 | 1–224;1–408;1–450 |
| 2545 | 1–499;27–498;38–519;48–545;51–525;51–538;51–504;51–514;51–520;65–564;65–356;69–558;69–558;69–486;69–537;69–563;72–566;81–549;81–559;81–558;82–549;83–564;83–547;83–557;83–529;83–561;83–561;83–563;83–581;83–584;83–572;83–568;83–235;83–563;84–567;85–567;85–571;85–542;85–557;85–280;85–535;86–566;86–579;87–557;91–575;91–435;91–545;95–557;127–569 |
| 2546 | 1–428;1–429;1–438;1–428;1–433;1–433;1–412;1–428;1–418;1–386;1–399 |
| 2548 | 1–497;1–397 |
| 2550 | 1–337;1–478;1–467;1–370;1–395 |
| 2553 | 1–374;1–390 |
| 2560 | 1–361;28–503;28–407;28–438;28–450;28–420;28–503;28–505 |
| 2562 | 1–472;22–491;57–539;57–504;57–522;57–589;57–578;57–541;57–573;57–522 |
| 2564 | 1–243;3–513;3–424 |
| 2566 | 1–349;1–482;1–459;1–69;5–510 |
| 2568 | 1–256;1–483;1–466;40–460 |
| 2571 | 1–483;1–475 |
| 2572 | 1–452;1–162 |
| 2574 | 1–359;1–530;362–786;362–554;362–798;362–834 |
| 2575 | 1–530;1–455 |
| 2576 | 1–456;6–77 |
| 2577 | 1–98;1–94;8–493;8–497;8–479;31–253;48–534;48–517 |
| 2578 | 1–98;1–94;8–493;8–497;8–479;31–253;43–534;48–517 |
| 2579 | 1–496;1–497;3–501;3–501;3–556;3–453 |
| 2580 | 1–430;6–352;6–427;6–473;6–622;6–473;6–391;6–399;6–318;6–391;6–331;6–458;6–520;6–472;6–419;6–513 |
| 2582 | 1–436;1–450 |
| 2584 | 1–489;1–439;1–144;1–295;1–468;1–227;15–366;16–506;18–513;141–596;141–510;141–647;144–615;144–603;147–631 |
| 2587 | 1–490;1–496;1–502;1–463;2–388;2–458;2–491;2–549;2–508;2–447;2–511;2–455;2–497;2–473;2–486;2–242;2–64;2–417;2–432;2–427;2–287;3–451;3–462;12–425;12–455;39–546;39–549;39–527;39–494;39–515;39–560;39–355 |
| 2589 | 1–321;1–422;1–482;1–492 |
| 2591 | 1–368;1–462;1–499;3–533;3–216;3–279;3–465;37–541;37–454 |
| 2592 | 1–272;92–574;92–563;92–554;92–575;94–558;94–573 |
| 2593 | 1–490;1–439 |
| 2594 | 1–485;1–233;1–479;1–486;1–99;1–383;1–433;1–522;1–500;1–453;1–475 |
| 2596 | 1–489;1–330;1–473;1–506;1–493;1–459;1–467 |
| 2598 | 1–479;1–504 |
| 2599 | 1–506;1–386;1–290;16–480 |
| 2605 | 1–508;1–538;1–444 |
| 2608 | 1–355;39–409;55–447;55–444;55–447;55–447;55–447;55–436;55–447;55–447;55–418;55–447;55–441;55–447;55–447;55–447;55–422;55–432;55–305;55–447;55–424;55–432;55–373;55–447;55–379;55–447;55–447;55–447;55–432;55–443;55–447;55–385;55–443;55–416;55–423;55–447;55–447;55–443;55–420;55–447;55–465;55–437;55–445;55–432;55–447;70–466;70–454;70–446;70–453;70–447;72–450;72–466;72–419;72–467;72–471;72–466;76–454;77–440;77–439;77–466;77–465;77–451;77–466;80–467;80–447;80–467;80–454;80–454;92–459;104–447;104–440;104–453;104–465;104–448;104–441;104–458;104–454;104–466;104–461;104–454;106–456;138–466;138–454;138–466;138–386;138–466;138–443;138–471;138–466;138–420;138–446;138–466 |
| 2612 | 1–420;180–664;189–629;189–664;189–659;189–656;189–607;189–720;189–654;192–631;192–422;193–492;193–679;193–631;193–455;193–625;193–607;193–642;193–631;193–648;193–551;193–683 |
| 2613 | 1–421;1–468;1–487;1–466;58–552;58–551;71–556 |
| 2614 | 1–450;266–747;275–747;275–739;275–690;275–742;275–712;275–803;275–737;278–714;278–505;279–714;279–575;279–762;279–538;279–708;279–690;279–725;279–714;279–731;279–634;279–766 |
| 2617 | 1–460;09–578;109–165 |
| 2618 | 1–510;1–511;1–461;2–378;3–267;8–472 |
| 2619 | 1–483;23–400;23–209;25–77;51–386;51–489;51–476;51–428;54–346;56–570;63–554;63–545;63–533;97–619 |
| 2620 | 1–488;1–472 |
| 2622 | 1–429;14–241 |
| 2623 | 1–351;1–428;1–434;1–326;1–432;1–436;1–433;1–424;1–437;1–432;1–421;1–431;1–435;1–317;1–436;1–437;1–433;1–433;1–421;1–262;1–433;1–339;1–432;1–427;1–394;1–414;1–435;1–391;1–244;1–384;1–437;1–331;1–425;1–424;1–437;1–430;1–427;1–431;1–319;1–416;1–128;1–432;1–425;1–425;1–421 |
| 2635 | 1–488;1–312;1–439 |
| 2638 | 1–158;1–243;1–388;1–367;1–388;1–384;1–371;1–375;1–371;1–386;1–371;1–360;1–388;1–363;1–371;4–153;14–113;14–113;16–234;16–174 |
| 2642 | 1–444;1–367 |
| 2644 | 1–487;1–471;1–493 |
| 2647 | 1–493;1–436;1–433;1–459;1–522;1–493;1–107;1–483;1–327 |
| 2651 | 1–347;1–354;1–346;1–355;1–357 |
| 2652 | 1466;1–238;1–464;1–467;1–440;1–483;1–440;1–453;1–472;15–457;18–483;18–529;18–504;18–495;18–545;18–421;18–372;18–424;18–492;18–447;18–534;18–100;18–534;18–529;18–511;18–305;18–586;18–304;18–555;18–534;18–472;18–239;18–584;18–499;19–487;21–551;26–528;26–513;26–485;26–486;26–513;26–440;26–547;26–557;26–372;26–533;26–532;26–504 |
| 2654 | 1–472;1–435 |
| 2655 | 1–425;7–512 |
| 2656 | 1–400;1–406;1–389;1–395;1–407;1–407;250–372 |
| 2657 | 1–461;1–450 |
| 2658 | 1–97;20–414 |
| 2660 | 1–300;1–455;2–407;3–484;3–331;3–175;3–289;3–459;3–454;3–355;3–253;3–274;3–204;3–335;3–305;3–388;3–333;3–311;3–455;4–111;6–367;6–379;6–459;6–224;6–237 |
| 2663 | 1–489;2–489;2–481;2–361 |

TABLE II-continued (Tiling path)

| Seq Id No. | Positions of biological 5'ESTs |
|---|---|
| 2664 | 1–490;1–381;1–483 |
| 2665 | 1–430;1–470;1–461 |
| 2667 | 1–483;1–445;1–447;1–491 |
| 2668 | 1–425;36–462;60–553;60–503;60–535;60–429 |
| 2669 | 1–485;1–453 |
| 2671 | 1–481;25–495;25–505;25–510;91–510;91–503;95–481;98–496;98–301;99–491;99–189;99–502;102–458;102–510;102–261;102–231;102–508;102–478;102–508;102–508;102–509;102–355;102–509;102–499;102–508;102–495;102–508;102–508;102–423;102–413;102–508;102–187;102–510;102–468;102–502;102–508;102–508;102–370;102–510;102–490;102–510;102–508;102–366;102–494;102–510;102–510;102–458;102–509;102–487;102–509;102–504;102–509;102–439;102–508;102–510;102–508;102–456;102–509;102–502;102–502;102–285;102–481;102–489;102–260;102–508;102–508;102–510;102–504;102–508;102–507;102–508;102–508;102–188;102–499;102–510;102–509;102–510;102–510;102–510;102–497;102–508;102–507;102–502;102–493;107–502;107–510;107–602;107–509;107–357;107–496;107–567;107–571;107–493;107–509;107–491;107–510;107–607;107–540;108–509;108–424;108–254;119–479;119–509;119–493;119–443;119–510;119–483;119–483 |
| 2672 | 1–346;1–320;1–293;1–335;1–288;1–222;1–333;1–348;1–227;1–327;1–330;1–348;1–282;1–204;1–479;2–92;5–134;5–90;5–91;5–163;5–188;5–164;10–425;11–157 |
| 2673 | 1–452;1–422;4–207;5–95;8–137;8–167;8–364;8–261;8–329;8–276;8–345;8–272;8–319;8–362;8–93;8–278;8–94;8–364;8–166;8–191;13–263;14–160;14–330;25–349 |
| 2675 | 1–530;1–481;1–384;1–498;1–391;1–448;1–446;1–613;1–497;1–400;1–482;1–392;1–439;1–627;1–481;1–440;1–446;1–489;1–496;1–499;1–748;1–374;1–550;1–125;1–495;1–499;1–530;1–486;1–446;1–553;1–329;1–613;1–446;1–477;1–400;1–499;1–631;1–496;1–446;1–406;1–446;1–481;1–487;1–549;1–624;1–498;1–477;1–624;1–344;1–542;1–543;1–613;1–556;1–542;1–551;1–543;1–315;1–499;1–431;1–425;1–427;1–205;1–497;1–499;1–446;1–613;1–324;1–543;1–496;1–543;1–499;1–553;1–551;1–613;1–494;1–609;1–486;1–599;1–497;1–481;1–484;1–488;1–439;1–552;1–617;1–431;1–613;1–287;1–211;1–495;1–374;1–539;1–415;1–497;1–484;1–506;1–599;1–312;1–415;1–487;1–477;1–495;1–481;1–599;1–491;1–486;1–387;1–371;1–359;1–428;1–534;3–398;8–641 |
| 2677 | 1–417;1–497;1–393;1–456 |
| 2679 | 1–410;1–481;1–448 |
| 2680 | 1–461;1–520;1–465;1–469;1–455;1–455;1–425;1–500;1–475;1–461;1–461;1–460;1–451;1–487;1–495;1–396 |
| 2681 | 1–461;1–460;1–461;1–461;1–451;1484;1–466;1–465;1–455;1–455;1–425;1–396 |
| 2682 | 1–53;1–152;1–481 |
| 2683 | 1–403;1–381;1–403;19–596;19–584;19–417;19–584;19–472;19–471;19–540 |
| 2690 | 1–422;1–491;1–436 |
| 2691 | 1–507;1–373;11–466 |
| 2693 | 1–510;1–522 |
| 2694 | 1–429;15–266;16–572;33–150 |

TABLE II-continued (Tiling path)

| Seq Id No. | Positions of biological 5'ESTs |
|---|---|
| 2697 | 1–364;1–392 |
| 2698 | 1–229;1–461 |
| 2699 | 1–499;1–479;1–499 |
| 2702 | 1–403;1–481 |
| 2703 | 1–411;1–474;1–511;2–497 |
| 2704 | 1–464;1–384 |
| 2707 | 1–404;1–481;1–451;1–426;1–483 |
| 2709 | 1–474;1–424 |
| 2710 | 1–473;1–446 |
| 2711 | 1–419;1–457;1–483;1–419;1–501;1–489;1–196;1–440;1–513;1–185;1–512;1–511 |
| 2713 | 1–385;1–417;1–482;1–440;1–469;1–171;1–484;1–197;1–469;1–471;1–501;1–352;158–250 |
| 2717 | 1–490;1–337;1–514 |
| 2718 | 1–463;1–521 |
| 2720 | 1–327;1–481 |
| 2721 | 1–497;1–490;1–449 |
| 2722 | 1–459;1–340;1–426;1–61 |
| 2723 | 1–433;49–495;61–260;71–457 |
| 2727 | 1–458;1–583 |
| 2728 | 1–302;1–253;45–545;45–508;45–438;45–229;45–462;45–460;45–450;45–485;45–453;45–141;45–485;45–509;45–509;45–430;45–321;45–385;45–257;45–438;45–487;45–487;45–501;45–450;45–485;45–503;45–471;45–569;45–518;45–510;45–510;45–310;45–506;45–439;45–504;45–408;45–465;45–471;45–288;45–493;45–485;45–278;45–239;45–496;45–459;45–485;45–510;45–501;45–340;45–453;45–430;45–215;45–508;45–459;45–440;45–309;45–482;45–510;45–458;45–485;45–509;45–510;45–475;45–256;45–496;45–342;45–498;45–510;45–503;45–499;45–508;45–472;45–394;45–509;45–505;45–510;45–509;45–472;45–485;45–509;45–500;45–415;45–369;45–461;45–322;45–482;45–430;45–458;45–493;45–243;45–325;45–485;45–438;45–216;45–461;45–441;45–485;45–456;45–510;45–375;45–510;45–489;45–485;45–483;45–510;45–332;45–464;45–503;45–263;45–477;45–509;45–327;45–485;45–278;45–428;45–317;45–467;45–531;45–485;45–507;45–488;45–568;45–415;45–442;45–495;45–510;45–509;46–489;46–474;46–459;47–469 |
| 2729 | 1–484;1–480;1–481;1–549;1–297 |
| 2731 | 1–166;1–279 |
| 2732 | 1–425;82–477;82–415 |
| 2734 | 1–414;212–554;212–543 |
| 2735 | 1–481;1–461 |
| 2739 | 1–492;1–449;1–467 |
| 2740 | 1–372;1–471;1–462;1–454;33–470;33–462;37–475;37–413;37–407;38–549;38–504;38–374;38–473;38–522;38–484;40–459;42–469 |
| 2743 | 1–503;1–465;1–502;1–497;1–501;1–488;1–332;1–500;1–443;1–478;1–511;1–546;1–461;1–501;1–458;1–484;1–488;1–498;1–433;1–505;1–500;1–318;1–505;1–499;1–222 |
| 2744 | 1–346;1–484;1–368 |
| 2745 | 1–516;1–389;2–534;4–500 |
| 2748 | 1–472;1–390 |
| 2750 | 1–489;31–595;31–607;38–529;41–509;41–313;41–350;45–192 |
| 2754 | 1–256;1–445;1–447;1–447;1–145;1–441;1–443 |
| 2756 | 1–481;1–482 |
| 2759 | 1–235;1–466;1–509;1–464;24–459;43–563 |
| 2760 | 1–417;1–497;1–516;65–670 |
| 2761 | 1–379;1–414;1–493;1–335;1–493;1–457;1–471;1–64;1480;1–152;1–480;1–398;1– |

TABLE II-continued (Tiling path)

| Seq Id No. | Positions of biological 5'ESTs |
|---|---|
| | 389;1–439;1–284;1–471;1–480;1–420;1–321;1–494;1–471;1–471;1–457;1–492;1–480;1–328;29–501 |
| 2762 | 1–472;4–86 |
| 2763 | 1–485;4–86;17–539 |
| 2765 | 1–509;1–357;124–209 |
| 2766 | 1–356;23–399;23–408;23–407;23–404;23–406;23–407;23–415;23–415;23–410;24–407;24–271;24–375;24–204;24–403;24–399;25–403;25–390;27–389;36–436;36–429;41–389;43–416;43–402;43–402;43–414;43–407;43–416;43–402;43–402;43–394;43–143;43–416;43–355;64–403;64–387;73–416 |
| 2767 | 1–424;1–421;1–408;1–197 |
| 2768 | 1–356;23–399;23–408;23–404;23–415;23–410;23–415;23–407;23–406;23–407;24–271;24–399;24–407;24–403;24–204;24–375;24–423;25–390;25–403;27–389;41–389;43–421;43–402;43–419;43–143;43–402;43–420;43–414;43–402;43–407;43–394;43–402;43–355;64–403;64–387;73–421 |
| 2769 | 1–356;5–518;22–482;23–408;23–399;23–407;23–404;23–407;23–415;23–410;23–406;23–415;24–407;24–271;24–375;24–204;24–403;24–399;25–390;25–403;25–536;27–524;27–470;27–523;27–425;27–389;28–507;41–389;41–496;41–496;41–450;41–496;41–456;41–496;43–414;43–402;43–416;43–416;43–407;43–402;43–355;43–402;43–402;43–416;43–43;43–394;46–488;46–541;46–449;46–532;46–526;46–526;46–524;46–556;64–403;64–545;64–536;64–387;73–416 |
| 2772 | 1–85;12–84;12–98;12–99;12–139;12–180;12–85;12–159;18–149;18–149;18–98;44–157;44–157;45–157;45–157;45–157;45–506;45–154;45–134;45–157;45–154;45–135 |
| 2773 | 1–426;19–119;19–516;19–454;19–138;19–294;20–435;20–426;20–494;54–495 |
| 2777 | 1–222;1–506;1–422 |
| 2779 | 1–468;1–471 |
| 2780 | 1–496;1–502;1–412;1–295;1–472;1–100;1–109 |
| 2782 | 1–136;1–246;1–200;6–234;15–459;15–519 |
| 2783 | 1–435;3–488 |
| 2785 | 1–414;1–498;1–420;1–397;1–384;1–396;1–485;1–397;1–403;1–342;13–527;47–451;47–423;47–523;47–424 |
| 2786 | 1–430;1–320 |
| 2787 | 1–443;1459;1–184;1–451;1–527;1–459;1–376 |
| 2790 | 1–314;2–477;2–434;2–459;2–477;2–487;2–433;2–268;2–402 |
| 2791 | 1–53;6–483;11–442;11–172;11–256;18–93;18–93;18–93;18–93;18–93;18–93;18–93;18–93;18–93;18–93;18–93;18–93;18–93;18–93 |
| 2792 | 1–163;–903 |
| 2794 | 1–501;1–481;1–376;1–477;1–429;1–434;1–492 |
| 2807 | 1–98;1–82;1–98;1–474;1–451;1–425;1–96;1–98 |
| 2813 | 1–484;370–795;370–795;471–811;471–832;471–818;471–832;471–816;471–604;471–822;471–818 |
| 2815 | 1–194;1–148;2–200;2–129;2–145;2–150;2–138;3–149;3–150;27–123;27–149;27–123;28–129;28–144;28–129;28–131;28–129;28–140;28–149;29–129;30–149;31–143;31–200;32–148;33–148;33–134;33–148;33–149;33–151;33–150;33–141;33–149;33–150;33–134;33–193;33–137;33– |

| Seq Id No. | Positions of biological 5'ESTs |
|---|---|
| | 147;33–151;33–179;33–150;33–152;33–183;33–200;33–144;33–200;33–150;33–91;33–150;33–407;33–122;33–87;33–144;33–149;33–149;33–138;33–151;33–135;33–105;33–150;33–150;33–150;33–135;33–131;34–93;34–145;34–151;34–138;34–151;34–129;34–135;34–148;34–149;34–140;34–149;34–179;34–131;34–148;34–142;34–139;35–140;35–148;35–150;35–200;35–135;35–140;35–108;36–136;36–150;36–141 |
| 2816 | 1–468;1–383;1–336;1–462;1–440;1–501;1–473;1–398;1–443;1–298;1–355;1–312;1–171;1–395;1–443;1–483;1–430;1–148;1–171;1–566;1–485 |
| 2820 | 1–427;91–621;566–1035 |
| 2822 | 1–494;11–509 |
| 2823 | 1–273;1–515;1–396 |
| 2825 | 1–524;3–502 |
| 2827 | 1–386;1–460;1–476 |
| 2828 | 1–337;4–491;4–263;4–415;4–516;4–485;4–483;4–503;4–493;4–483;4–425;4–478;4–336;4–464;4–327;4–494;4–466;4–427;4–467;4–484;4–494;4–53;4–412;4–487;4–464;4–507;4–406;4–464;4–474;4–415;4–493;4–439;4–447;4–184;4–410;4–490 |
| 2832 | 1–68;13–483;13–480;13–450;13–427;13–410;13–450;13–466;28–625 |
| 2834 | 1–418;1–418;1–391;1–319;1–416;1–417;1–369;1–403;1–405;1–393;1–410;8–483;8–444;8–508;25–406 |
| 2836 | 1–542;14–430;14–145 |
| 2838 | 1–462;1–462;1–517 |
| 2839 | 1–330;73–333;73–469;73–469;73–301 |
| 2844 | 1–201;23–500;23–358;23–129 |
| 2845 | 1–299;1–388;1–459;1–502;1–406;1–443;1–422;10–475;10–250;16–216;16–513;16–520;16–521;16–425;16–496;16–495;32–501;32–526;32–511;32–428;33–242;33–508;33–349;33–515;33–456;33–494;33–511;33–248;33–456;33–357;33–434;33–498;33–309;33–507;33–534;34–401;34–539;34–519;34–459;35–471;35–458;35–423;36–500;37–456;37–524;37–384;37–227;37–311;37–481;37–456;37–397;37–443;37–511;37–539;37–144;37–551;37–500;37–512;37–475;37–512;37–521;37–481;37–540;37–519;37–415;42–409;42–543;60–310;60–521;60–567;60–416;60–512;60–416;60–556;61–505;61–475;61–521;61–526;61–531;61–557;69–477 |
| 2849 | 1–428;1–521 |
| 2852 | 1–268;1–240;1–449;1–413;1–512;1–75;1–322;1–387;1–502;1–430;1–165 |
| 2853 | 1–404;1–436;1–292;1–436;1–420;1–436;1–436;1–307;5–449;6–483 |
| 2854 | 1–473;3–410;42–263;42–522;42–444;42–450 |
| 2855 | 1–112;1–217;1–203;1–313;16–527;17–319;17–242;17–244;17–79;32–225;32–114 |
| 2856 | 1–458;15–434;26–528 |
| 2860 | 1–324;1–504;1–408;1–500;1–416;1–509 |
| 2863 | 1–60;2–435;2–491;3–424;3–477;3–471;3–73;3–599;3–474;3–388;3–253;3–490;3–396;3–577;42–289;43–501;43–594;43–512;46–465;46–465;46–465;46–500;46–595;46–456;46–304;46–548;46–450;46–465;46–465;46–465;46–465;46–501;46–461;46–450;46–465;46–465;46–465;46–465;46–424;46–592;46–465;46–461;46–543 |
| 2864 | 1–495;3–394 |
| 2865 | 1–420;1–497 |
| 2866 | 1–494;1–366 |
| 2867 | 1–179;1–539;1–458;1–395 |

TABLE II-continued

(Tiling path)

| Seq Id No. | Positions of biological 5'ESTs |
|---|---|
| 2868 | 1-513;334-713;334-414 |
| 2869 | 1-374;1-476;1-457;1-457 |
| 2870 | 1-280;1-485;1-418;1-394;1-396;1-382;1-396;4-493;4-357;4-405;4-490;4-399;4-445;4-221;4-462;4-406;9-492;25-519;25-487;25-492;27-531;27-520;27-50;27-372;27-486;27-479;27-400;27-249;27-444 |
| 2873 | 1-524;5-362;5-362 |
| 2874 | 1-462;1-460;1-486;1-408;1-464;1-45 227;1-477;1-426;1-466;1-486;1-486;1-397;1-447;1-306;1-474;1-471;1-447;1-486;1-476;1-311;1-465;1-486;1-445;1-459;1-461;1-486;1-421;1-446;1-257;1-473;1-420;1-251;1-449;1-486;1-323;3-486;3-373 |
| 2876 | 1-485;-484;-486 |
| 2877 | 1-706;1-363;1-481 |
| 2878 | 1-489;8-531 |
| 2879 | 1-240;1497;1-502;1-476 |
| 2880 | 1-482;1-295 |
| 2881 | 1-346;1-380;1-433;1-293;1-337;1-514;1-433;1-394;1-575;1-400;1-513;1-505;1-506;1-494;1-424;1-363;1-333;1-270;1-477;1-482;1-326;1-204;1-438;1-399;1-330 |
| 2884 | 1-511;1-493;1-408;1-560;1-441;1-259 |
| 2887 | 1-451;1-503;1-353;1-473 |
| 2888 | 1-447;3-551;3-504;3-460;3-399;23-548;28-507;28-423 |
| 2891 | 1-480;2-317;2-399;2-489;2-62 |
| 2892 | 1-303;13-446;13-499;13-486;13-414;13-490;13-480 |
| 2893 | 1-452;1-452;1-336;1-380;1-452;1-459;1-442;1-194 |
| 2894 | 1-492;1-470;1-489;1-547;1-471;1-501;1-441;1-280;1-311;1-317;1-471;1-497;1-499;1-292 |
| 2896 | 1-230;3-461;363-644 |
| 2899 | 1-505;1-503;1-511;1-279;1-203 |
| 2900 | 1-486;1-90 |
| 2902 | 1-317;1-440;1-470;-433;1-432;249-721;249-603 |
| 2904 | 1-474;1-486;1-506;1-495;1-476;1-438;1-484 |
| 2905 | 1-474;1-467;1-473 |
| 2907 | 1-308;103-523;103-276 |
| 2908 | 1-503;1-453;1-468;1-502;1-539;1-371;1-455;1-482;1-500;1-503;1-505;1-503;1-389;1-506;1-472 |
| 2911 | 1-490;1-490;4-424;4-508;4-89;4-484;4-473;4-531;4-401;4-506;4-463;5-312;15-444 |
| 2912 | 1-438;64-475 |
| 2913 | 1-459;1-483 |
| 2914 | 1-307;103-482;103-571;103-275;103-434 |
| 2916 | 1-426;1-426;1-425;1-431;1-429;1-271;1-432;1-133;1-372;1-384;1-436;1-420;1-357;1-410;1-452 |
| 2919 | 1-486;49-537;50-575;50-502 |
| 2920 | 1-454;1-317 |
| 2921 | 1-462;1-480;2-457;2-481;2-432;2-492;19-490;19-342;19-492;19-480;22-465 |
| 2922 | 1-479;1-518;1-484 |
| 2924 | 1-467;217-610;217-582;217-607;217-615 |
| 2925 | 1-363;2-413;4-240;4-414;4-317;4-265;4-423;4-423;4-443;4-411;4-393;4-369;4-167;4-507;4-447;4-438;4-348;4-417;4-380;4-449;4-301;4-514;4-499;4-423;5-418;7-328 |
| 2926 | 1-483;1-463;1-408 |
| 2927 | 1-464;1-577 |
| 2928 | 1-489;1-474 |
| 2931 | 1-122;1-117;2-61;2-405;2-347;2-169;2-479;4-119;4-92;4-122;226-500;226-496;226-496;226-496;226-496;226-446;226-496;226-496;226-500;226-496;226-358;226-500;226-496;226-496;226-501;226-496;226-496;226-496;226-496;226-496;226-496;226-496;226-501;226-496;226-496;226-496;226-496;226-496;226-496;226-496;226-496;226-370;226-501;226-496;226-496;226-496;226-501;226-496;226-496;226-496;226-501;226-496;226-496;226-496;226-496;226-496;226-496;226-496;393-669;393-664;397-709;397-706;397-693;397-708;397-690;397-709;397-706;397-693;397-686;397-690;397-694;397-709;397-706;397-693;397-693;397-681 |
| 2932 | 1-528;1-308;1-581 |
| 2933 | 1-372;2-369;3-474;16-324;16-339;16-324;16-324;16-477;16-135;16-328;16-300;16-422;16-328;16-324;16-339;16-433;16-339;16-530;16-215;16-324;16-324;16-339;16-474;16-230;16-339;16-335;16-339;16-339;16-327;16-328;16-448;16-342;16-324;16-121;16-328;16-230;16-133;16-324;16-339;16-327;16-328;16-321;16-467 |
| 2934 | 1-486;1-269 |
| 2936 | 1-464;1-300;1-456 |
| 2937 | 1-396;1-117;1-381;1-406;1-515;1-467 |
| 2938 | 16-491;16-611;16-396;16-491;16-497;16-474;27-410;27-443;27-494;27-465;27-492;28-507;28-281;28-249;29-574;29-566;30-484;30-547;30-558;30-505;30-426;30-330;30-493;30-536;30-491;30-585;30-493;30-145;30-427;30-429;30-386;30-491;30-505;30-467;30-462;30-410;30-459;30-423;30-466;30-197;30-504;30-499;30-444;30-462;30-625;30-448;30-556;30-507;30-462;30-462;30-462;30-538;30-410;30-447;30-504;30-537;30-463;30-322;30-642;30-636;30-480;30-503;30-253;30-503;30-405;30-504;30-430;30-512;30-603;30-483;30-379;30-398;30-515;30-410;30-542;30-443;30-497;30-459;30-507;30-523;30-442;30-416;30-449;30-510;30-415;30-469;30-459;30-506;30-427;30-513;30-486;30-463;30-449;30-418;30-504;30-502;30-578;30-503;30-398;30-507;30-458;30-451;30-324;30-504;30-399;30-458;30-491;30-453;30-504;30-398;30-501;30-462;30-495;30-483;30-432;30-483;30-530;30-462;30-625;30-512;30-470;30-518;30-504;30-510;30-426;30-504;30-498;30-491;30-477;30-491;30-494;30-500;30-334;30-396;30-397;30-507;30-574;30-492;30-459;30-457;30-492;30-502;30-504;30-522;30-444;30-374;30 |
| 2940 | 1-117;1-122;2-169;2-161;2-405;2-479;2-347;4-119;4-122;4-92;226-496;226-496;226-446;226-496;226-496;226-500;226-496;226-496;226-501;226-500;226-496;226-496;226-496;226-501;226-496;226-496;226-496;226-496;226-358;226-496;226-496;226-501;226-496;226-496;226-496;226-501;226-496;226-496;226-496;226-500;226-496;226-496;226-496;226-496;226-501;226-496;226-496;226-496;226-370;226-496;226-496;226-496;393-664;393-669;393-687;393-687 |
| 2941 | 1-493;1-438;1-252 |
| 2943 | 1-506;1-509;1-491 |
| 2944 | 1-422;1-369;1-465;1-402;1-414 |

TABLE II-continued (Tiling path)

| Seq Id No. | Positions of biological 5'ESTs |
|---|---|
| 2945 | 1–489;12–347;17–398;17–372;17–67;17–493;17–229;17–362;17–424;17–430;17–481;17–164;17–378;17–489;17–161;17–481;42–350;62–489;62–489;64–278;69–516;69–518;69–486;69–492;69–510;69–487;69–325;69–521;69–161;71–145;71–494;71–531;71–543;71–489;71–502;80–537 |
| 2947 | 1–490;1–538 |
| 2949 | 1–488;1–434;1–404;1–440;3–355;3–330;3–411;3–403;3–492;3–505 |
| 2951 | 1–502;1–506;1–483 |
| 2952 | 1–415;80–470;80–525;80–410 |
| 2959 | 1–590;1–294 |
| 2962 | 1–499;1–453 |
| 2963 | 1–455;31–539 |
| 2964 | 1–499;1–364;1–334;1–483;1–403;1–469 |
| 2966 | 1–452;1–421 |
| 2968 | 1–388;46–118;49–284;51–462;56–397;56–402;56–411;71–462;71–390;71–217;74–462;77–415;85–462;85–399;85–235;85–401;85–425;85–291;85–303;85–392;85–409;85–416;86–405;86–399;90–460;95–236;95–575 |
| 2969 | 1–520;1–387 |
| 2970 | 28–507;28–527;28–480;28–541;28–550;28–408;28–581;28–463;28–562;28–533;28–440;28–489;28–543;43–531;48–555;50–158;50–550;50–342;50–547;50–572;50–158;50–480;88–578;135–631 |
| 2971 | 1–488;1–491 |
| 2974 | 1–409;1–517;1–260;1–482;1–443 |
| 2976 | 1–470;1–377 |
| 2978 | 1–473;1–508;1–234;1–517;1–515;1–427 |
| 2979 | 1–303;1–490 |
| 2980 | 1–122;1–467;9–484;9–456 |
| 2981 | 1–466;1–405;3–539;5–403;8–496;11–510;12–501;12–517;12–494;12–503;12–472;12–447;12–494;12–499;12–516;12–495;12–481;12–524;12–517;12–530;12–317;12–527;12–494;12–466;12–496;13–447;13–504;13–531;13–530;14–501;14–467;15–407;15–495;15–548;15–478;15–522;15–480;15–493;15–472;15–480;15–462;15–462;15–460;15–488;15–462;15–442;15–369;15–300;15–426;15–461;15–577;15–574;15–519;15–504;15–558;15–488;15–472;15–477;15–508;15–390;15–472;15–463;15–539;15–472;15–481;15–567;15–404;15–321;15–379;15–490;15–496;18–518 |
| 2984 | 1–501;1–490;1–493;1–451;1–461 |
| 2985 | 1–423;1–491;1–338;1–404;1–462;2–450;358–783 |
| 2986 | 1–502;1–459;1–484 |
| 2989 | 1–374;1–478 |
| 2990 | 1–419;1–482 |
| 2991 | 1–451;1–422;18–549;18–449;19–442 |
| 2995 | 1–465;1–446;1–438;10–483;10–482;10–509;10–437;10–494;10–466;10–437;10–472;10–472;10–475;10–473 |
| 2996 | 1–354;5–466 |
| 2997 | 1–359;1–460;1–461;1–467;1–444;1–486;1–469;1–486;1–467;1–483;1–482;1–370;1–334;1–443;1–442 |
| 2998 | 1–449;1–546 |
| 3001 | 1–578;28–467;28–447;28–512;28–474;28–439;28–450;28–525;28–473;28–519;28–458;104–559;104–507;104–584;104–579;104–452;104–579;104–513;104–548 |
| 3002 | 1–483;2–482 |
| 3003 | 1–518;2–480;4–123;4–297;4–317 |
| 3005 | 1–437;1–468;1–414;1–485;1–421;1–436;1–493;7–504;7–452;7–420;35–334;35–486;35–454;35–458;35–348;35–538;35–475;35–549;35–535;35–538;35–457;35–533;35–486;35–509;35–486;35–469;35–439;35–529;35–422;35–418;35–457;35–277;35–466;35–523;35–491;35–502;35–557;35–434;35403;35–335;35–519;35–454;35–454 |
| 3006 | 1–327;1–306;1–263;1–148;1–169;23–388;29–161 |
| 3007 | 1–357;1–493;1–359;1–450;1–453;1–522;1–411;1–470;1–509;1–451;1–386;14–525;14–523;22–500;22–127;39–548;41–538;53–501;53–485 |
| 3008 | 1–358;1–360;22–127;24–513 |
| 3010 | 1–507;1–451;1–173;1–455;1–422 |
| 3011 | 1–462;213–604;217–704 |
| 3012 | 1–205;13–505 |
| 3013 | 1–97;1–479;1–556;1–441;1–486;2–556;2–351;11–337;15–481;15–479;15–476;15–485;15–165;15–351 |
| 3014 | 1–320;12–467 |
| 3016 | 1–497;8–513;12–324 |
| 3017 | 1–469;1–448 |
| 3018 | 1–372;1–531;1–406 |
| 3019 | 1–459;1–610 |
| 3021 | 1–530;1–43 |
| 3022 | 1–54;1–436 |
| 3023 | 1–494;1–483;1–470;1–473 |
| 3024 | 1–472;1–474;1–488;1–275 |
| 3025 | 1–425;40–524;40–505;40–523;40–311;40–383;40–582;40–520;40–534;40–513;40–460;40–548 |
| 3027 | 1–807;1–604 |
| 3029 | 1–503;1–483;1–487;1–503;1–510;1–497;1–510;1–454;1–472;1–482;1–494;1–488;1–450;1–533;1–428 |
| 3030 | 1–472;1–505;1–440;1–370;1–485;1–382;1–464;1–316;1–468;1–493;1–470;1–467;1–493 |
| 3031 | 1–520;1–489 |
| 3032 | 1–585;1–495 |
| 3034 | 1–337;1–493;1–463;1–321;1–230;1–148;1–402;1–490;1–431;1–554;1–431;1–478;1–448;1–487;1–464;1–459;1–387;1–486;1–387;1–377;1–444;1–167;2–188;2–471;37–573;37–328;37–566;37–573;37–371 |
| 3036 | 1–87;1–135;17–375 |
| 3037 | 1–462;1–96 |
| 3038 | 1–584;1–410;1–226 |
| 3039 | 1–436;1–456;1–472;6–483 |
| 3041 | 1–374;1–373;1–382;4–241;20–265;20–524;20–152;20–382;20–523;20–378;20–135 |
| 3044 | 1–474;1–491;1–290 |
| 3046 | 1–450;1–477;1–313;1–387 |
| 3047 | 1–539;272–690;272–691;272–669;272–671;272–691;272–690;272–690;272–690;272–690;272–667;272–673;272–658;272–651;272–673;272–689;272–617;272–667;272–666;272–679;272–683;272–690 |
| 3049 | 1–536;–326;1–397;30–470;30–544;30–465;30–467;38–518;38–485;38–527;38–535;56–540;56–563;56–547;56–436;58–439;62–466;152–547;152–321 |
| 3053 | 1–438;1–475;311–787 |
| 3056 | 1–335;3–185;4–503 |
| 3057 | 1–121;1–425;1–468;1–335 |
| 3058 | 1–479;1–558;1–495 |
| 3059 | 1–481;1–469 |
| 3060 | 1–453;1–108;2–494;2–410;2–415;2–110;3–119;3–122 |
| 3061 | 1–493;1–493;15–406;15–479;15–484;15–236;15–523;15–505;25–188 |
| 3064 | 1–519;1–488 |
| 3066 | 1–456;22–375;22–432 |

TABLE II-continued (Tiling path)

| Seq Id No. | Positions of biological 5'ESTs |
|---|---|
| 3067 | 1–266;1–417;4–517;4–79;29–468;29–393;29–443;29–561;29–471;50–551 |
| 3068 | 1–395;1–438;1–463;1–433;1–436;1–415;1–435;1–463 |
| 3069 | 1–460;1–394;1–338;1–464;1–468;1–416;1–411;1–513;1–415;1–404 |
| 3070 | 1–420;28–484 |
| 3071 | 1–196;1–473 |
| 3072 | 1–389;5–434;5–360;5–222;5–449;9–423;37–452;37–120;37–233;37–438 |
| 3076 | 1–400;1–500;1–494 |
| 3084 | 1–326;1–498;1–314;1–472;1–485;1–439;1–528;1–441;1–471;1–483;1–498;1–357;1–502;1–462;1–500;1–299;1–502;1–500;1–329;1–429;1–210;1–497;1–470 |
| 3085 | 1–199;1–279 |
| 3086 | 1–458;1–513 |
| 3087 | 1–259;1–391;1–390;1–392;1–387;1–328;1–387;1–208;1–391;1–379;1–390;1–390;1–388;1–388;1–371 |
| 3093 | 1–490;1–478;1–330;1–421 |
| 3094 | 1–478;1–505;1–435 |
| 3096 | 1–469;1–168;1–239;1–498;1–423;1–294;1–425;1–365;1–399;1–505;1–497;1–498;1–482;1–476;1–499;1–508;1–503;1–345;1–505;1–254 |
| 3099 | 1–364;1–482;1–209;27–79;27–286;27–101;27–101;28–493;28–501;28–515;28–502;28–224;28–484;28–533;28–283;28–471;28–484;28–362;28–279;28–504;28–493;28–331;29–407;29–470;35–323;50–284;50–423 |
| 3103 | 1–490;1–489 |
| 3104 | 1–87;1–458;1–501 |
| 3107 | 1–542;1–498;1–294;1–540;1–484;1–454;1–509 |
| 3109 | 1–451;1–460;1–478;1–477;1–500;1–442;–430;1–537;1–438 |
| 3111 | 1–246;2–454;2–64;2–442;2–454;2–491 |
| 3112 | 1–255;1–255;2–480 |
| 3114 | 1–525;1–187;1–487;1–357 |
| 3115 | 1–475;1–189 |
| 3116 | 1–492;1–509;1–495;1–197 |
| 3117 | 1–482;1–428;1–477;1–369;1–367;1–498 |
| 3118 | 1–357;1–509 |
| 3121 | 1–428;1–418;1–313;8–267;9–451;9–451;10–459;37–513;43–452;43–582;43–568;43–515;43–423;43–565;43–481;43–546;43–582;43–557;43–554;43–551;43–521;43–311;51–532;51–528;51–527;51–466;51–466;51–479;51–522;51–519;51–541;51–350;51–459;51–363;51–556;51–519;51–502;51–552;51–535;51–515;51–487;51–487;51–423;51–552;51–563;51–525;51–519;51–536;51–519;51–515;51–557;51–384;51–540;51–549;51–632;51–486;51–231;51–260;51–354;51–356;53–578;54–538;60–515;60–445;60–480 |
| 3122 | 1–428;1–418;1–313;8–267;9–451;9–451;10–459;37–513;43–452;43–568;43–582;43–557;43–612;43–565;43–551;43–554;43–546;43–423;43–515;43–521;43–481;43–582;51–527;51–466;51–519;51–522;51–479;51–528;51–350;51–563;51–502;51–466;51–459;51–363;51–532;51–384;51–519;51–556;51–515;51–535;51–515;51–487;51–616;51–487;51–423;51–541;51–552;51–519;51–525;51–519;51–536;51–552;51–557;51–540;51–549;51–486;51–231;51–260;51–356;51–354;53–578;54–538;60–515;60–445;60–480 |
| 3124 | 1–454;1–479 |
| 3125 | 1–454;1–492 |
| 3126 | 1–483;254–707 |
| 3127 | 1–488;1–382;1–411;1–503;1–56;1–488 |
| 3128 | 1–479;1–462;1–123;1–205;1–130;1–443 |
| 3130 | 1–497;1–106;1–467;1–477 |
| 3133 | 1–473;1–410;1–469;1–487;1–491;1–506;–494;1–504;1–436;1–516;1–341;1–513;1–255;1–414;1–452;4–494;5–482;5–510;5–448;5–472;5–426;5–426;6–504;6–458;6–517;6–450;13–506;13–474;38–493;38–544;38–528;38–531;39–525;39–511;39–532;39–516;39–472;39–535;39–461;39–532;39–479;39–527;39–511;39–522;39–222;39–480;39–179;39–532;39–504;39–454;39–492;39–532;39–515;39–521;39–510;39–451;39–529;39–162;39–525;39–525;39–339;39–487;39–501;39–483;39–529;39–518;39–516;39–534;39–525;39–522;39–516;39–526;39–226;39–517;39–546;39–510;39–205;39–441;39–509;39–507;41–485;44–451;78–544;80–461;80–509;80–541 |
| 3138 | 1–489;1–464 |
| 3139 | 1–435;97–596 |
| 3142 | 1–438;1–428 |
| 3143 | 1–513;1–492 |
| 3144 | 2–491;2–491;2–465;2–459;2–292;2–302;2–491;2–412;2–55;2–509;2–448;2–474;2–473;2–484;2–505;2–404;2–498;2–505;2–490;2–416;2–488;2–508;2–164;2–484;2–364;2–506;2–548;2–510;2–481;2–519;2–485;2–485;2–487;2–421;2–484;2–464;2–445;2–357;2–249;2–422;2–490;2–501;2–448;2–447;2–490;2–482;2–482;2–328;2–487;3–455;4–503;10–462;10–320;10–493;10–509;10–504;10–481;10–447;12–473;14–509;17–506;18–482;22–231;35–342;35–514;35–487;35–511;35–484;35–411;35–459;35–493;37–510;38–380;40–106;40–523;41–463;41–509;41–504;41–484;41–482;41–511;41–493;41–538;41–447;41–113;41–520;41–517;42–420;44–518;44–509;44–515;44–161;44–526;44–509;44–483;44–504;49–525;59–497;59–537;73–517 |
| 3145 | 1–465;47–480;47–597;47–473;47–575;56–601;56–493;56–487;56–570;56–574;56–501;56–725;56–286;56–500;59–491;89–587;89–473;89–473;89–191;89–575;89–587;89–479;89–460;89–473;89–473;89–501;89–479;89–479;89–490;89–464;89–463;89–493;89–493;89–196;89–597;89–224;89–460;89–459;89–602;89–500;89–481;89–473;89–492;89–232;89–489;89–441;89–493;90–528;90–606;90–490;91–473;98–501;101–501 |
| 3146 | 1–86;1–414;1–476;1–465;30–401 |
| 3147 | 1–467;1–476;1–488;1–408;1–479;43–500 |
| 3148 | 1–455;1–452;–462 |
| 3149 | 1–382;1–376;1–627;1–165;1–436;10–334;10–410;0–60;10–289;13–410;13–463;13–293;3–469;13–390;13–420;13–449;3–375;13–449;13–399;13–498;354;13–139 |
| 3150 | 1–484;14–559;402–864 |
| 3151 | 1–461;51–568;61–518;61–479;61–493;61–446;61–431;61–655 |
| 3152 | 1–89;1–351;1–430;2–484;2–475 |
| 3153 | 1–361;1–383;1–435;1–459 |
| 3155 | 1–340;1–448;1–464;1–505;1–491 |
| 3156 | 1–502;1–469;1–468;4–473;5–467;5–414;45–490;45–114;45–554;45–591;45–600;45–571;45–528;45–554;45–540;45–559;45–464;45–526;45–554;45–550;45–461;45–516;45–485;45–555;45–476;45–540;45–517;45–551;45–559;45–551;45–516;45– |

TABLE II-continued

(Tiling path)

| Seq Id No. | Positions of biological 5'ESTs |
|---|---|
| | 515;45–605;45–518;45–605;45–545;45–542;45–540;45–308;45–549;45–494;45–441;45–555;45–545;45–520;45–526;45–529;45–602;45–559;45–498;45–471;45–549;45–546;45–557;45–546;45–559;45–536;45–502;45–502;45–494;45–555;45–519;45–465;45–559;45–516;45–534;45–589;45–231;45–516;45–557;45–510;45–545;45–556;45–581;45–529;45–543;45–502;45–572;45–529;45–544;45–526;45–555;45–539;45–554;45–519;45–531 |
| 3157 | 1–124;1–317;1–366;5–321;5–392;185–409;185–409 |
| 3158 | 1–470;1–464;1–482;1–464 |
| 3159 | 1–406;1–124;1–486;1–317;1–461;1–524;1–436;1–366;1–489;1–418;5–451;5–321;5–392;34–528;34–471;39–479;40–511 |
| 3160 | 1–127;1–321;1–467;1–488;1–424;1–371;1–442;5–325;5–457;5–397;11–494;34–477;39–485 |
| 3162 | 1–398;1–433;1–482;1–161;1–490;1–394;1–463;1–394;1–494;1–455;1–332;1–361;1–490;1–484;1–490 |
| 3163 | 1–466;71–478;71–475 |
| 3164 | 1–443;1–467;1–480;1–508;1–491 |
| 3165 | 1–426;1–463;1–498;1–353;1–439;1–486 |
| 3166 | 1–479;20–538 |
| 3168 | 1–471;21–468;21–420 |
| 3169 | 1–490;1–475 |
| 3170 | 1–563;1–447;3–484;3–218;3–445;9–485;9–550;9–397 |
| 3171 | 1–459;1–489 |
| 3172 | 1–503;1–277;93–598;113–583;113–545;161–694;175–640;221–661;221–712;222–324;222–771;222–709;222–712;222–659;222–466;222–691;222–713;222–558;222–692;222–716;222–717;250–751;250–746;250–744;250–735;250–639;250–732;256–784;347–826 |
| 3173 | 1–376;1–455 |
| 3175 | 1–484;1–202;1–426 |
| 3176 | 1–482;1–457 |
| 3177 | 1–431;1–482 |
| 3178 | 1–441;1–434;1–412;1–441;1–368;1–443;1–435;1–447;1–441;2–406;9–435;9–406;12–432;12–250;12–438;12–435;12–441;12–431;12–435;12–403;12–291;12–440;12–441;12–258;13–317;13–497 |
| 3179 | 1–485;33–400;33–353;33–309 |
| 3181 | 1–461;4–380;4–451;4–517;5–243 |
| 3182 | 1–470;1–501;1–510;1–248;1–393;1–516;1–362;1–496;1–475;1–491;1–489;1–473;1–577;1–468;1–499;1–473;2–479;2–496;2–509;2–517;31–254;48–485 |
| 3183 | 1–349;3–434;3–447;3–356;3–439;3–434;3–433;3–437;3–414;3–494;3–434;3–451;3–439;3–437;3–404;3–446;3–428;3–355;3–420;3–447;3–406 |
| 3186 | 1–454;1–501;1–539;1–474;1–474;1–460;1–539 |
| 3187 | 1–478;1–520;1–497;1–415 |
| 3188 | 1–196;1–254;1–74;1–52;1–153;7–411;7–444;23–309 |
| 3192 | 1–438;1–446;1–66;22–517;30–302;30–527;34–324 |
| 3193 | 1–495;1–757;1–455 |
| 3194 | 1–406;1–479;1–474;1–413;1–462;1–503;1–439;–387 |
| 3195 | 1–484;1–388;1–486 |
| 3196 | 1–482;1–489;1–410 |
| 3197 | 1–494;1–473 |
| 3199 | 1–496;1–401 |
| 3204 | 1–375;1–526;1–331;1–405;25–442;25–510;25–526;25–508;25–509;30–495;35– |
| | 531;36–517;36–442;36–517;36–532;36–404;36–435;36–532;37–484;37–478;37–517;42–517;42–406;42–478;42–403;43–403;43–380;43–499;43–526;44–477;44–517;44–484;52–480;57–483;57–347;57–538;58–516;58–498;58–517 |
| 3205 | 1–455;1–533;1–453;1–461;1–474;1–490;1–517 |
| 3208 | 1–381;5–518;6–478 |
| 3209 | 1–505;17–413 |
| 3211 | 1–75;26–403;57–385;57–345;57–419;98–344;98–577 |
| 3215 | 1–474;1–344 |
| 3217 | 1–413;1–453;1–469;1–526;1–500;1–448;1–501;1–454;1–413;31–328 |
| 3219 | 1–480;1–509;1–480;1–475;1–444;1–477 |
| 3221 | 1–354;1–492 |
| 3223 | 1–411;1–141;1–136;1–220;1–419;1–517 |
| 3225 | 1–473;1–471;1–321;1–497;1–459 |
| 3226 | 1–432;50–333;98–536;98–564;98–573;99–511;126–601;134–576 |
| 3227 | 1–185;1–420;1–476;1–403;1–516 |
| 3228 | 1–513;1–184;1–377 |
| 3230 | 1–455;1–471;1–321;1–473;2–483;2–454;6–459;6–458;9–509;9–548;11–360 |
| 3231 | 1–321;5–522;5–539;8–514;8–443;11–360 |
| 3232 | 1–487;1–523 |
| 3236 | 1–342;6–465;6–516;6–580;6–469;6–411;6–354;56–524;56–513 |
| 3237 | 1–342;20–499 |
| 3238 | 1–489;1–347;1–587 |
| 3239 | 1–484;1–473;1–454;1–493;1–321;1–483;1–485;173–614;178–576;179–600;179–346;179–597;198–600;208–725;216–748;216–303;216–707;216–665;217–736 |
| 3240 | 1–468;1–397;1–371 |
| 3241 | 1–488;1–487;1–457;1–486;1–321;1–496;1–476;173–620;78–581;179–345;179–690;179–599;216–303;216–671 |
| 3242 | 1–490;1–461;1–71;1–290;1–440;1–454;1–382;1–460;3–334;6–525 |
| 3243 | 1–466;1–465 |
| 3245 | 1–367;1–597 |
| 3248 | 1–445;19–508;19–500 |
| 3249 | 1–499;1–489 |
| 3250 | 1–494;1–134;1–503;1–199;1–484;1–461;1–444;22–108;27–158;27–268;27–167;27–98;27–94;27–229;27–82;27–125;27–230;27–257;27–123;27–248;27–215;27–268;27–182;27–150;27–112;27–231;27–201;27–212;27–257;35–120;37–130;37–218;37–237;40–149;40–245;40–186;60–115;60–159;60–254;60–172 |
| 3251 | 1–199;1–134;1–430;22–108;27–257;27–230;27–212;27–273;27–158;27–229;27–269;27–94;27–248;27–268;27–98;27–125;27–257;27–167;27–150;27–201;27–456;27–12;27–215;27–231;27–82;27–123;27–182;35–120;37–28;37–237;37–130;40–186;40–149;40–245;60–172;60–159;60–254;60–115 |
| 3252 | 1–199;1–134;22–108;27–98;27–167;27–248;27–182;27–123;27–158;27–94;27–215;27–257;27–229;27–269;27–125;27–268;27–230;27–387;27–257;27–231;27–201;27–212;27–82;27–50;27–112;35–120;37–130;37–237;37–218;40–149;40–245;40–524;40–474;40–507;40–186;60–172;60–115;60–254;60–159;72–507 |
| 3253 | 1–199;–134;22–108;27–67;27–98;27–381;27–158;27–248;27–257;27–380;27–229;27–396;27–474;27–125;27–231;27–230;27–381;27–352;27–201;27–123;27–257;27–268;27–182;27–94;27–150;27– |

TABLE II-continued (Tiling path)

| Seq Id No. | Positions of biological 5'ESTs |
|---|---|
| 3254 | 112;27–268;27–82;27–212;27–215;35–120;37–130;37–218;37–237;40–149;40–245;40–186;60–172;60–159;60–115;60–254 1–473;1–512;2–135;2–515;2–200;2–441;2–478;2–410;2–407;2–439;2–362;2–473;23–386;23–109;28–517;28–510;28–533;28–468;28–478;28–505;28–530;28–168;28–515;28–506;28–99;28–366;28–409;28–546;28–445;28–524;28–546;28–283;28–437;28–451;28–505;28–435;28–521;28–533;28–434;28–432;28–533;28–473;28–467;28–385;28–533;28–552;28–503;28–533;28–446;28–419;28–507;28–432;28–505;28–431;28–448;28–518;28–321;28–546;28–502;28–514;28–546;28–493;28–288;28–495;28–358;28–552;28–511;28–510;28–479;28–159;28–449;28–546;28–455;28–431;28–455;28–468;28–474;28–432;28–469;28–462;28–471;28–505;28–384;28–467;28–513;28–466;28–434;28–409;28–505;28–419;28–471;28–441;28–412;28–435;28–357;28–495;28–517;28–435;28–505;28–514;28–419;28–480;28–434;28–531;28–513;28–276;28–521;28–443;28–432;28–499;28–258;28–459;28–411;28–546;28–415;28–510;28–528;28–230;28–431;28–552;28–552;28–321;28–468;28–410;28–446;28–449;28–419;28–505;28–513;28–435;28–450;28–511;28–420;28–126;28–450;28–514;28–496;28–455;28–546;28–503;28–364;28–546;28–446;28–398;28–546;28–95;28–513;28–515;28 |
| 3258 | 1–468;67–533 |
| 3259 | 1–464;1–463 |
| 3264 | 1–344;1–445;1–469 |
| 3265 | 1–460;1–435 |
| 3266 | 1–103;1–86;1–507;1–511;1–505;1–486;1–362;1–278;1–426;1–458;1–471;1–402;1–479;1–158;1–483;1–481;2–482 |
| 3269 | 1–447;1–496;1–503;1–490 |
| 3271 | 1–494;7–92;7–427;7–220;7–93;7–509;7–491;7–56;7–92;8–529;8–473;9–154 |
| 3273 | 1–401;1–381 |
| 3275 | 1–461;25–325;32–399;32–407;47–185;47–400;47–364;47–378;47–240 |
| 3276 | 1–302;4–465;8–499;8–470;8–384;8–376;8–465;25–501;25–217;25–162;25–377;25–500;25–593;25–355;25–341;25–513;146–627 |
| 3277 | 1–420;20–475 |
| 3280 | 1–308;1–478;1–215;1–311;1–505 |
| 3281 | 1–468;1–513 |
| 3282 | 1–444;1–479;1–444;1–461;1–246;1–486 |
| 3283 | 1–470;1–338;1–555;1–450 |
| 3285 | 1–353;7–468 |
| 3287 | 1–423;253–479 |
| 3288 | 1–452;9–482 |
| 3290 | 1–488;1–484;1A01;1–480;1–478;1–393;1–417;1–428;1–463;1–453;1–489;1–401;1–481;1–482;1–458;1–439;1–480;1–480;1–411;1–476;1–480;1–465;1–411 |
| 3293 | 1–460;1–460 |
| 3295 | 1–53;1–477;1–551;1–469;1–499;1–500;1–159;1–280;1–482;1–507;1–499;1–502;1–493;1–463;1–481;1–453;1–573;1–442;1–457;83–561 |
| 3297 | 1–376;1–468;1–509;1–449;1–442;1–122;3–465;11–468;11–449;11–418;1–354;11–462;11–490 |
| 3301 | 1–438;1–542;1–391;1–440;1–288;1–430 |
| 3305 | 1–399;1–427;4–441;4–407;5–454;11–407;21–441;22–449;22–423;22–432;31–453;31–405;38–243;40–127;43–379;43–460;43–255;43–420;43–407;43–400;43–300 |
| 3306 | 1–478;1–472 |
| 3308 | 1–98;1–435;1–524;1–488 |
| 3309 | 1–308;1–309;1–306 |
| 3311 | 1–444;2–75;2–75;3–435 |
| 3312 | 1–135;1–932 |
| 3319 | 1–361;1–338;5–556;8–501 |
| 3321 | 1–496;1–599 |
| 3322 | 1–213;1–222;1–402;1–397;1–75;1–75;1–456;1–473;1–359;1–397;1–437;106–292;106–282 |
| 3323 | 1–326;1–367;1–468;1–176;1–406;1–342;1–479;1–142 |
| 3325 | 1–329;2–440;2–425;2–467;2–460;2–480;2–479;2–465;2–172;2–480;2–464;2–477;2–466;2–480;2–464;2–479;30–485 |
| 3327 | 1–485;51–572 |
| 3328 | 1–473;1–527;1–466;1–464 |
| 3329 | 1–397;1–481 |
| 3330 | 1–397;1–471 |
| 3331 | 1–446;2–445;2–266;2–407;10–477;14–503;40–427;40–266;40–442;40–528;44–501;44–503;44–342;44–483;44–484;44–486 |
| 3335 | 1–479;1–401 |
| 3337 | 1–473;1–468;29–463;432–846 |
| 3338 | 1–481;10–177;10–527;10–505;13–495;13–514;13–525;15–503;15–488 |
| 3340 | 1–123;12–431 |
| 3341 | 1–431;26–505 |
| 3342 | 1–464;1–232;1–219 |
| 3343 | 1–522;1–531;1–554;1–519;1–474;1–468;1–286;4–530;27–581;29–468;41–537;41–510;41–592;41–536;41–565;41–537;41–554;41–448;41–467;41–510;41–539;41–493;41–568;41–590;41–537;41–540;41–567;41–220;41–563;41–584;41–581;42–521;42–583;42–583;42–511;42–509;42–589;42–511;42–519;42–595;42–533;42–572;42–511;42–554;42–490;42–466;42–565;42–530;42–494;42–548;44–509;44–297;44–588;44–537;44–575;45–540;45–559;45–403;45–510;45–511;45–511;45–509;45–510;45–540;45–572;45–540;45–532;45–510;45–559;45–519;45–563;45–540;45–207;45–531;45–403;45–574;45–475;45–510;45–500;45–467;45–538;45–567;45–492;45–564;45–579;45–540;45–445;45–500;45–551;45–479;45–509;45–296;45–595;45–530;45–192;45–540;45–510;45–540;45–530;45–493;45–416;45–500;45–567;45–596;45–581;45–530;45–530;45–511;45–553;45–240;45–591;45–540;45–297;45–530;45–183;45–540;45–471;45–510;45–592;45–537;45–493;45–579;45–492;45–530;45–519;45–491;45–530;45–509;45–559;45–540;45–530;45–570;45–567;45–568;45–567;45–540;45–220;45–520;45–581;45–595;45–430;45–563;45–211;45–540;45–568;45–509;45–584;45–535;45– |
| 3344 | 1–275;40–404;41473;41–496;41–213;41–464;41–481;41–465;41–454;41–496;41–164;41–407;41–473;41–476;41–495;41–489;4–496;41–480;4485;41–481;41–474;41–481;45–212;45–184;45–281;45–245;45–198;45–202;45–175;45–228;45–281;46–124;46–492;46–478;46–281;47–218;47–281;49–478 |
| 3345 | 1–393;1–550;1–394;1–413;1–311;1–340 |
| 3346 | 1–507;1–504;1–392;1–269;1–485;1–506;1–416;1–475;1–109;1–482;5–287;5–82 |
| 3347 | 1–269;1–109;5–496;5–287;5–82 |
| 3349 | 1–471;1–527 |

TABLE II-continued

(Tiling path)

| Seq Id No. | Positions of biological 5'ESTs |
|---|---|
| 3353 | 1–461;88–458 |
| 3354 | 1–455;1–454;1–504;1–472;1–447;1–365;1–502;1–405;1–494;1–454;1–387;1–477;1–480;1–477;1–488 |
| 3357 | 1–453;1–479;1–532;1–468;1–513;1–436 |
| 3358 | 1–475;1–426 |
| 3360 | 1–454;245–593 |
| 3361 | 1–460;1–509 |
| 3362 | 1–456;1–457;1–220;1–470;1–496;1–502;1–362;1–472;32–429;34–589;34–362;34–243;34–511;34–518;34–500;34–421;34–489;34–483;34–580;34–448;34–475;34–428;34–447;34–514;34–458;34–492;34–516;34–50;34–437;34–488;34–364;34–483;34–214;34–499;34–590;34–397;34–475;34–430;34–418;34–488;34–551;34–362;34–590;34–473;34–590;34–471;34–457;34–517;34–498;34–449;34–483;34–342;34–492;34–510;34–387;34–532;34–475;34–541;34–486;34–523;34–433;34–482;34–515;34–462;34–594;34–489;34–434;34–541;34–234;34–580;34–483;34–431;34–378;34–590;34–492;34–488;34–590;34–515;34–569;34–287;34–575;34–513;34–518;34–487;34–511;34–580;34–499;34–301;34–522;34–528;34–576;34–498;34–488;34–480;34–555;34–338;34–342;34–507;34–489;34–429;34–488;34–507;34–520;34–487;34–483;34–574;34–487;34–487;34–498;34–541;34–361;34–523;34–551;34–590;34–487;34–447;34–471;34–510;34–519;34–561;34–422;34–442;34–517;34–313;34–544;34–456;34–551;34–195;34–494;34–458;34–472;34–482;34–590;34–492;34–459;34–363;34–478;34–315;34–546;34–486;34–497;34–501;34–539;34–478;34–417;66–501;66–550;66–3 |
| 3363 | 1–457;1–220;1–470;1–496;1–456;1–502;1–362;1–472;32–429;34–362;34–487;34–500;34–518;34–421;34–489;34–483;34–475;34–448;34–428;34–520;34–487;34–492;34–456;34–342;34–539;34–362;34–364;34–483;34–499;34–214;34–458;34–475;34–397;34–418;34–551;34–546;34–488;34–471;34–517;34–473;34–498;34–483;34–342;34–510;34–492;34–387;34–532;34–449;34–541;34–486;34–475;34–555;34–515;34–462;34–489;34–88;34–523;34–234;34–483;34–378;34–492;34–433;34–515;34–567;34–541;34–513;34–518;34–487;34–499;34–458;34–301;34–522;34–482;34–514;34–498;34–437;34–488;34–431;34–287;34–480;34–501;34–429;34–488;34–487;34–195;34–430;34–551;34–498;34–487;34–519;34–361;34–523;34–482;34–544;34–338;34–471;34–447;34–510;34–243;34–51 ;34–447;34–516;34–483;34–457;34–434;34–315;34–494;34–541;34–507;34–492;34–459;34–422;34–486;34–501;34–507;34–528;34–472;34–363;34–478;34–442;34–497;34–478;34–417;34–488;34–551;34–517;34–313;34–511;34–489;66–550;66–376;66–501;67–503;70–480;70–548;70–488;72–544;72–512;72–567;72–475;72–539;72–513;72–561;72–497;72–507;72–566;72–566;72–5 |
| 3364 | 1–220;1–457;1–470;1–496;1–456;1–502;1–362;1–472;32–429;34–589;34–362;34–510;34–243;34–511;34–518;34–421;34–489;34–500;34–580;34–448;34–475;34–608;34–428;34–483;34–608;34–458;34–492;34–607;34–429;34–576;34–608;34– |
| | 612;34–364;34–483;34–499;34–214;34–590;34–397;34–475;34–456;34–418;34–551;34–362;34–590;34–488;34–471;34–590;34–88;34–517;34–473;34–498;34–483;34–342;34–510;34–492;34–532;34–387;34–449;34–541;34–486;34–475;34–523;34–287;34–515;34–462;34–595;34–489;34–546;34–433;34–234;34–580;34–483;34–342;34–378;34–590;34–492;34–541;34–590;34–515;34–569;34–488;34–513;34–575;34–518;34–487;34–580;34–523;34–499;34–301;34–522;34–482;34–608;34–498;34–514;34–442;34–555;34–480;34–338;34–516;34–501;34–488;34–437;34–539;34–608;34–482;34–520;34–487;34–430;34–447;34–498;34–487;34–517;34–361;34–422;34–483;34–434;34–611;34–447;34–487;34–590;34–528;34–561;34–507;34–544;34–431;34–457;34–590;34–478;34–487;34–494;34–541;34–519;34–486;34–492;34–459;34–497;34–501;34–315;34–488;34–507;34–472;34–551;34–363;34–417;34–458;34–551;34–478;34–1 |
| 3368 | 1–105;6–540;46–568;49–535;49–524;49–540 |
| 3369 | 1–105;1–473;1–311;1–465;1–437;1–478;1–463;1–455;1–471;1–457;1–461;1–460;1–452;1–465;6–458;20–361;21–307;26–489;26–498;26–511;26–484;26–479;26–461;26–488;26–397;26–480;26–193;28–469;28–488;28–161;38–532;38–498;46–439;46–520;49–451;49–409;51–308;51–545;51–308;51–469;58–493 |
| 3379 | 1–446;1–461 |
| 3380 | 1–147;1–490 |
| 3382 | 1–510;142–673;142–657;179–556;181–724;182–602;182–660;193–738;199–680;205–680;205–680;214–671;214–526;214–679;217–315 |
| 3383 | 1–486;1–443 |
| 3384 | 1–467;1–494;1–462;1–354;1–261;1–485;1–487;1–473;1–500;1–289;1–451;1–474;1–456;15–436;29–413;29–519;40–505;40–534;63–559;63–532;64–560;64–457;64–457 |
| 3385 | 1–421;1–301;1–163;1–340 |
| 3387 | 1–480;1–254;1–453 |
| 3388 | 1–579;1–252;11–527 |
| 3389 | 1–566;1–490 |
| 3391 | 1–401;1–459;1–526;1–492;1–445;1–360;1–457;1–485;1–410;1–480 |
| 3392 | 1–434;–478 |
| 3394 | 1–465;1–160 |
| 3395 | 1–380;1–469 |
| 3396 | 1–211;3–316 |
| 3397 | 1–463;–477;1–450 |
| 3402 | 1–349;1–498 |
| 3406 | 1–577;1–406;1–413;7–356;7–490;14–480;14–461;14–456;14–484;219–618;219–726 |
| 3410 | 1–451;–227 |
| 3411 | 1–488;475;1–495;1–488;1–487;1–406;1–424 |
| 3412 | 1–484;3–167 |
| 3415 | 1–463;116–585 |
| 3417 | 1–413;11–423;12–547 |
| 3418 | 1–509;2–203;10–86 |
| 3419 | 1–339;1–250;1–339;1–330;1–429;1–419;1–427;1–359;1–357;1–345;1–405;1–519 |
| 3420 | 1–436;1–151 |
| 3421 | 1–472;8–77;8–83;8–104;8–149;8–61;8–133 |
| 3422 | 1–485;1–522;1–265;1–422;1–392;1–446;1–485;1–506;1–528;1–505;1–490;1–578;1–431;1–558;1–434;1–522;1–358;1–489;1– |

TABLE II-continued

(Tiling path)

| Seq Id No. | Positions of biological 5'ESTs |
|---|---|
|  | 460;1–499;1–491;1–164;1–503;1–298;1–181;1–442;1–487;1–481;1–493;1–435;1–496;1–483;1–503;1–485;1–344;1–588;1–446;1–381;1–313;1–489;1–555;1–477;1–519;1–399;1–503;1–510;1–588;1–473;1–497;1–419;1–535;1–519;1–519;1–387;1–380;1–568;1–594;1–485;1–518;1–436;1–485;1–364;1–341;1–448;1–364;1–499;1–587;1–555;1–530;1–245;1–486;1–420;1–369;1–501;1–426;1–448;1–491;1–460;1–360;1–401;1–268;1–492;1–501;1–447;1–316;1–407;1–499;1–481;1–560;1–419;1–483;1–555;1–519;1–444;1–429;1–498;1–485;1–555;1–486;1–555;1–451;1–499;1–495;1–574;1–322;1–394;1–472;1–486;1–519;1–478;1–512;1–499;1–426;1–477;1–485;1–471;1–329;1–588;1–588;1–76;1–97;1–475;1–473;1–503;1–484;1–485;1–421;1–561;1–476;1–474;1–342;1–560;1–472;1–503;1–478;1–426;1–481;1–485;1–492;1–562;1–519;1–349;1–479;1–378;1–264;1–368;1–503;1–429;1–142;1–303;1–464;1–477;1–54;1–386;1–546;1–440;1–436;1–503;1–489;1–555;1–499;1–578;1–126;1–457;1–472;1–397;1–491;1–440;1–568;1–501;1–242;1 |
| 3423 | 1–265;1–76;1–97;1–164;1–298;1–181;1–378;1–429;1–378;1–264;1–142;1–54;1–378;1–126;1–245;1–242;1–268;1–268;1–70 |
| 3430 | 1–502;1–498;1–474;1–499;–418;1–283;1–804;1–499;1–298;1–269;1–487;1–527;1–452;1–512;1–475;1–305;1–488;1–338;1–316;1–534;1–282;1–469;1–507;1–239;1–299;1–500;1–484;1–306;1–331;1–507;1–509;1–499;1–457;39–125;39–237;48–366;48–499;48–421;48–353 |
| 3431 | 1–299;1–290;1–332;1–496;1–524;1–363;1–493;1–385;1–470;4–509;4–489;4–357;4–442;5–476;10–457 |
| 3433 | 1–182;1–277;1–420;1–473;1–440;1–420;1–466 |
| 3434 | 1–448;7489 |
| 3435 | 1–475;1–588;30–410;46–508;48–547;48–425;48–300;65–414;65–553 |
| 3436 | 1–475;1–465;1–135;1–446 |
| 3438 | 1–476;1–465;1–135;1–488;1–446;3–556 |
| 3440 | 1–471;142–550;150–614;150–599;150–651 |
| 3441 | 1–410;1–324;1–362;1–364;1–453;1–356;1–399;1–356;1–362 |
| 3442 | 1–406;1–436;1–450;1–335;1–222 |
| 3443 | 1–505;58–515;58–138 |
| 3444 | 1–311;1–439 |
| 3446 | 1–387;40–536;323–600;527–741 |
| 3447 | 1–469;1–495 |
| 3448 | 1–518;1–398;13–463;13–410;13–346;13–389;13–393;13–374;13–487;13–497;13–488 |
| 3450 | 1–387;1–382;1–503;1–372;1–222;1–455 |
| 3451 | 1–452;1–441;1–426 |
| 3454 | 1–283;4–167;4–95;4–101;4–179;4–177;4–125 |
| 3455 | 1–498;1–540;1–540;7–103 |
| 3456 | 1–325;1–327;1–450;1–140;1–353;1–264;1–94 |
| 3457 | 1–325;1–327;1–486;1–489;1–473;1–472;1–515;1–474;1–465;1–508;1–465;1–529;1–140;1–473;1–498;1–489;1–483;1–353;1–515;1–264;1–571;1–94 |
| 3458 | 1–478;1–357;1–462;1–323;1–427 |
| 3459 | 1–549;9–520;9–254;9–435;9–508;9–565;9–492;9–448 |
| 3460 | 1–481;1–432;4–482;40–475;40–442;40–423;51–543;51–423;57–385 |
| 3462 | 1–546;1–525 |
| 3465 | 1–526;3–440 |
| 3466 | 1–490;2–486;3–260;3–519;3–643;3–562;3–260;4–538;4–560;4–519;4–501;4–546;6–499;6–517;6–521;6–498;6–518;6–473;6–260;6–574;6–442;6–518;6–412;6–468;6–490;6–487;6–248;6–378;6–386;6–442;6–485;6–442;6–501;6–457;6–501;6–537;6–275;6–490;6–458;6–518;6–474;6–486;6–368;6–501;6–360;6–561;6–509;6–499;6–501;6–477;6–385;6–490;6–543;6–291;6–485;6–583;6–384;6–431;6–490;6–518;6–562;6–457;6–153;6–458;6–490;6–477;6–486;6–487;6–597;6–458;6–509;6–517;6–159;6–57;6–518;6–538;6–501;6–384;6–493;6–470;6–500;6–521;6–498;6–458;6–486;6–487;6–471;6–597;6–400;6–249;6–518;6–431;6–563;6–548;6–546;6–474;6–521;6–583;6–578;6–487;6–509;6–477;6–500;6–487;6–500;6–202;6–214;6–482;6–501;6–517;6–483;6–442;6–478;6–431;6–501;6–260;6–548;6–487;6–499;6–427;6–548;6–521;6–601;6–509;6–518;6–316;6–547;6–501;6–521;6–486;6–483;6–537;6–487;6–521;6–518;6–546;6–538;6–537;6–518;6–509;6–417;6–455;6–477;6–548;6–521;6–474;6–517;6–574;6–501;6–583;6–249;6–548;6–485;6–490;6–486;6–519;6–509;6–484;6–489;6–259;6–597;6–501;6–427;6–517;6–533;6–471;6–501;6–519;6–536;6–537;6–426 |
| 3467 | 1–468;1–510;1–491 |
| 3472 | 1–402;1–492 |
| 3473 | 1–427;1438 |
| 3474 | 1–512;1–451 |
| 3476 | 1–404;3–511;3–394 |
| 3478 | 1–498;1–443 |
| 3482 | 1–482;19–504;19–555;35–370;35–304;36–354;46–470;54–484;54–350;54–506;54–531;54–535;54–647;54–647;54–521;54–570;54–659;54–540;54–506;54–555;54–554;54–523;54–566 |
| 3483 | 1–258;3–556;3–306;3–469;17–481;17–468;17–493;21–302;49–129 |
| 3484 | 1–518;1–468;17–337;17–273;18–321;28–435;36–498;36–484;36–503;36–473;36–518;36–517;36–449;36–317;36–486;36–494;36–470 |
| 3489 | 1–527;1–523 |
| 3490 | 1–482;1–432;1–421;1–457;1–450;1–342;1–337;1–419;1–480;1–425;21–435;21–385 |
| 3491 | 1–467;14–350;14–352;34–512;34–483;34–399;37–503;40–401;59–551;75–553;83–561;102–559;103–510 |
| 3492 | 1–466;14–349;14–351;34–398;34–482;37–502;40–400;45–522;102–509 |
| 3493 | 1–231;1–477 |
| 3494 | 1–230;19–494 |
| 3497 | 1–433;138–520 |
| 3498 | 1–366;20–500;147–684;164–673;164–681 |
| 3499 | 1–465;1–461 |
| 3500 | 1–358;24–608;27–438 |
| 3501 | 1–467;1–141;1–325;1–498;1–502;1–511;1–499 |
| 3505 | 1–502;1–440 |
| 3507 | 1–350;1–497 |
| 3508 | 1–470;1–452 |
| 3509 | 1–487;1–406;1–467;1–490;1–530;1–481;3–469;3–290;3–469;3–141;3–479;4–361;4–455;4–465;4–409;5–475;8–87;8–92;8–406;8–485;8–123;8–223;8–268;8–508;8–478;8–151;8–105;8–110;8–486;8–347;8–480;8–511;8–468;8–239;0–508;10–471;11–553;11–242;11–166;11–457;11–153;11–470;11–494;11–497;11–457;11–557;11–523;11–412;11–469;11–278;11– |

TABLE II-continued (Tiling path)

| Seq Id No. | Positions of biological 5'ESTs |
|---|---|
|  | 481;21–154;27–163;27–418;27–156;27–394;27–50;27–465;27–473;27–346;27–92;28–92;39–270;41–93;41–462;41–415;41–409;41–521;41–269;41–515;41–489;41–402;41–532;41–481;41–159;41–415;41–515;41–461;41–395;41–396;41–535;41–552;41–552;41–539;41–467;41–518;41–468;41–272;43–409;43–523;43–117;43–112;43–275;49–133;49–489;49–460;49–529;49–547 |
| 3510 | 1–139;6–85;6–90;6–121;6–108;6–103;6–149;9–151;9–164;19–152;25–154;25–90;25–161;26–90;39–157;39–91;41–110;41–115;47–131;49–495 |
| 3512 | 1–492;1–155;1–405 |
| 3514 | 1–450;1–217;1–469;1–459;1–421;1–441;1–245;1–450;1–460;1–461;1–454;1–450;1–432;1–454;1–414;1–369;15–467;30–391 |
| 3518 | 1–492;19–470;21–475;50–491;361–752;361–754 |
| 3519 | 1–459;263–657;263–655 |
| 3520 | 1–489;1–490 |
| 3521 | 1–88;1–517 |
| 3522 | 1–267;66–530;66–406;66–521;66–423;66–477;66–461;66–500 |
| 3523 | 1–497;1–503;1–490 |
| 3524 | 1–477;2–456;2–484;4–513;22–350;22–486;38–545 |
| 3525 | 1–419;1–502;1–461;1–464;80–472;80–545;80–572;80–551;81–215 |
| 3528 | 1–462;1–476;1–463;1–407;1–475;1–477;1–420;1–473;1–502;1–470;2–407;5–410;5–485;5–471;5–466;5–450 |
| 3534 | 1–343;1–218;279–765;331–787 |
| 3535 | 1–260;1–482 |
| 3538 | 1–462;1–469;1–468;1–494;1–393;1–395;1–485;1–464 |
| 3540 | 1–52;1–500;1–499 |
| 3546 | 1–440;1–83;1–447;1–466 |
| 3547 | 1–83;7–470 |
| 3548 | 1–382;1496 |
| 3551 | 1–354;93–370;101–494 |
| 3552 | 1–490;1–433 |
| 3553 | 1–484;1–500;1–479;1–481;1–381;1–370;1–523;1–455;1–454;1–456;1–394;1–452;1–420 |
| 3555 | 1–493;6–354;31–531;72–424;72–413;85–561;85–561;85–565;85–561;85–565;85–412;85–548;85–560;85–532;85–557;85–548;85–561;85–549;85–487;85–565;85–178;85–481;85–565;85–565;85–531;85–539;85–408;85–565;85–357;85–547;85–554;85–563;85–556;86–664 |
| 3556 | 1–493;6–354;31–531;72–413;72–424;85–561;85–581;85–565;85–561;85–567;85–412;85–561;85–549;85–560;85–581;85–532;85–557;85–565;85–548;85–556;85–487;85–563;85–178;85–481;85–565;85–566;85–531;85–539;85–408;85–566;85–357;85–547;85–554;85–548;85–561;85–579 |
| 3557 | 1–242;1–244;1–244;1–239 |
| 3559 | 1–548;1–347;1–454 |
| 3561 | 1–448;2–394;5–332;5–330;5–481;5–435;5 405;12–415;12–478;12–489;12–466;16–155;23–447;23–540;27–478;27–479;27–489;27–507;27–522 |
| 3564 | 1–410;1–481;1–510;1–427;1–535;1–524;1–456;1–201;1–428;1–526;1–472;1–435;1–363;1–471;1–319;1–377;1–517;1–271;1–471;1–313;1–470;1–334;1–508;1–516;1–216;1–401;1–334;1–442;1–503;1–473;1–553;1–344;1–376;1–535;1–498;1–421;1–475 |
| 3565 | 1–478;1–491;1–467;1–477;1–444 |
| 3567 | 1–416;1–459 |
| 3568 | 1–499;31–489;39–471;39–509;39–194;39–117;39–108;39–448;39–410;39–432;40–538;41–451;41–458;41–437;41–196;41–289;41–518;41–514;41–297;41–368;41–512;41–482;41–512;41–449;41–519;41–502;41–391;41–513;41–480;41–521;41–494;41–470;41–279;41–392;41–466;41–487;41–220;41–522;41–519;41–478;41–502;41–532;41–531;41–491;41–130;41–498;41–494;41–521;41–434;41–482;41–482;41–145;41–301;41–306;41–496;41–498;41–419;41–533;41–439;41–280;41–522;41–482;41–453;41–469;41–477;41–532;41–516;41–191;42–161;42–451;42–499;42–269;42–472;42–439;42–420 |
| 3569 | 1–381;10–433;11–482;39–487;39–533;39–522;39–543;39–541;39–487;39–578;39–375;39–433;39–462;39–503;39–108;39–533;39–485;39–567;39–117;41–494;41–411;41–505;41–532;41–289;41–581;41–529;41–549;41–499;41–496;41–482;41–384;41–220;41–508;41–531;41–324;41–530;41–534;41–418;41–196;41–482;41–519;41–526;41–539;41–539;41–556;41–518;41–453;41–531;41–486;41–595;41–506;41–534;41–524;41–484;41–280;41–548;41–451;41–515;41–532;41–493;41–536;41–522;41–492;41–508;41–544;41–434;41–573;41–489;41–391;41–453;41–532;41–297;41–482;41–441;41–529;41–543;41–339;41–517;41–548;41–508;41–411;41–440;41–306;41–488;41–496;41–489;41–480;41–518;41–560;41–532;42–532;42–557;42–526;42–540;42–532;42–439;42–507;42–531;42–269;42–542;42–557;42–562;42–531;42–533;42–492;42–506;42–481;43–464;43–481;43–511;165–325 |
| 3573 | 1–436;1–464;1–459;1–390;1–436;1–429;1–478;1–437;1–500;1–405;1–409;1–504 |
| 3574 | 1–325;1–483;55–557 |
| 3578 | 1–301;1–228;1–413;1–321;1–395;1–404 |
| 3581 | 1–271;13–479;16–448;16–458;16–426;16–492 |
| 3582 | 1–489;1–461;2–382;2–493;2–455;2–391;2–465;2–482;2–483;2–302;2–295;2–503;2–468;2–339;2–413;2–446;2–466;2–484;2–489;2–482;2–468;3–505;3–494;3–510;3–483;5–466;5–471;5–487;5–303;5–460;5–167;5–527;5–481;37–496 |
| 3583 | 1–443;1–516;1–459;1–184;1–451;1–459;1–376 |
| 3584 | 1–491;2–461;2–483;2–439;2–393;2–453;2–501;2–468;2–371;3–492;3–137;3–456;3–137;3–137;3–395;3–446;3–137;3–455;3–443;3–392;3–461;3–438;3–137;3–446;3–493;3–266;3–137;3–468;3–137;3–477;3–485;3–468;3–137;3–456;3–456;3–259;3–125;3–457;3–495;3–137;3–510;3–137;3–379;3–137;4–459;4–373;8–457;40–458;40–509 |
| 3588 | 1–406;1–446;1–379;1–439;1–484;1–539;1–468;1–461;1–533;1–363;1–192;1–454;1–446;1–465;1–558 |
| 3589 | 1–637;1–475 |
| 3590 | 1–477;1–448;1–441;1–397;1–259;1–436;1–474;1–373;1–308;1–436;1–447;1–474;1–441;1–473;1–477 |
| 3591 | 1–459;1–449 |
| 3593 | 1–327;1–446;1–475;1–459;1–418;1–418;4–492;4–308;4–446;4–446;4–489;4–414;4–203;4–384;4–467;4–385;4–436;4–451;4–319;4–469;4–385;4–472;4–418;4–411;4–492;4–349;4–426;4–376;4–400;4–67;4– |

TABLE II-continued

(Tiling path)

| Seq Id No. | Positions of biological 5'ESTs |
|---|---|
| | 470;4–70;4–72;4–461;4–426;4–67;5–446;5–474;11–69;11–446;11–68;11–487 |
| 3594 | 1–350;1–465;1–388;1–512;1–382;1–321 |
| 3595 | 1–486;1–90;1–505;1–571;1–313;1–446 |
| 3597 | 1–396;1–520;1–503;1–436;1–560;1–364 |
| 3598 | 1–417;257–826 |
| 3599 | 1–537;17–489;20–484;23–276;422–853;422–946;422–940 |
| 3600 | 1–477;1–477;9–205;9–64;9–102 |
| 3601 | 1–57;1–380;1–95;1–375;1–392;1–366;1–380;1–307;1–312;1–393;1–394;1–372;1–385;1–198;1–283;1–394;1–376;1–377;1–380;1–379;1–392;1–393;1–372;1–354;1–391;1–376;1–379 |
| 3604 | 1–441;3–416 |
| 3607 | 1–429;4–488 |
| 3608 | 1–475;1–433;1–501;1–469;1–414;1–483;1–304;1–479;1–449;1–430;1–377;1–469;1–402;1–473;1–458;1–428;1–402 |
| 3609 | 1–422;1–492;1–425;207–638 |
| 3610 | 1–440;1–490;1–478 |
| 3612 | 1–438;27–421;27–448;27–421;27–450;27–421;27–510;27–450;27–510;27–421;27–389;27–450;27–442;27–421;28–517;28–429;28–489;28–364;28–450;28–488;28–421;28–421;28–95;28–429;28–416;28–394;29–88;31–436;31–406;31–168;31–450;33–347;337–583;337–699 |
| 3614 | 1–146;1–125;1–179;23–493;42–263 |
| 3615 | 1–491;1–439 |
| 3616 | 1–395;9–549;9–497;9–522;9–527;9–455;9–466;9–117;9–523;9–523;9–455;9–493;9–495;9–466;10–471;16–456;18–227 |
| 3617 | 1–292;1–489 |
| 3618 | 1–467;1–454;1–278;10–77;10–75;10–75;10–75;10–75;10–75;10–77;10–77;10–77;10–77;10–75;10–75;10–75;10–75;10–75;10–77;10–75;10–75;10–75;10–75;10–77;10–75;10–75;10–75;10–75;10–77;10–75;10–75;10–75;10–75;10–77;48–409;55–469;55–419;55–457;57–396;66–547;76–416;97–515;99–473;103–539;103–473;103–557;103–538;262–753 |
| 3622 | 1–479;1–450 |
| 3623 | 1–454;1–501;1–487;1–505 |
| 3624 | 1–439;1–461;1–479 |
| 3627 | 1–508;11–202;14–553;14–463;18–458;18–381;24–524;24–548;24–460 |
| 3628 | 1–503;–522;1–428;1–455;1–436;1–366;1–437;1–489 |
| 3629 | 1–507;1–477;18–490;390–850 |
| 3631 | 1–427;25–458;25–471;25–500 |
| 3637 | 1–310;1–442;1–386;1–406;1–460;1–488 |
| 3638 | 1–352;1–474 |
| 3639 | 1–454;1–486;1–393 |
| 3644 | 1–440;1–485;1–471;1–436 |
| 3650 | 1–473;1–484 |
| 3652 | 1–346;1–414;2–442;3–453;3–458;3–517;3–409;3–443;3–453;3–440;7–456;8–153;18–522 |
| 3653 | 1–400;1–472;1–501;1–160;1–492 |
| 3662 | 1–362;1–347 |
| 3663 | 1–1043;1–456 |
| 3664 | 1–425;22–515;22–520;22–515;48–510;49–517;54–247;55–523;55–527;58–527;63–509;63–498;63–399;63–485;63–498;63–517;63–472;81–391;82–531;82–517;83–260;83–504;83–515;83–506;83–451;83–476;83–477;83–524;83–516;83–498;83–504;83–324;83–260;83–492;83–468;83–506;83–468;83–505;83–401;83–512;83–517;83–484;83–485;84–530;84–493;84–428;84–381;84–527;84–498;84–530;84–524;84–519;84–511;84–516;84–530;84–468;84–510;84–469;84–536;84–422;84–485;84–531;84–492;84–480;84–469;84–491;84–521;84–531;84–529;84–535;84–512;84–517;84–467;84–504;84–532;84–516;84–439;84–512;84–517;84–525;84–517;84–509;84–405;84–510;84–480;84–531;84–516;84–472;84–532;84–535;84–533;84–321;84–506;84–531;84–489;84–507;84–374;84–500;84–456;84–530;84–509;84–467;84–375;84–507;84–492;84–531;84–527;84–518;84–338;84–511;84–531;84–449;84–533;84–485;84–382;84–498;84–472;84–506;84–532;84–525;84–485;84–532;84–522;84–509;84–477;84–527;84–520;84–164;84–531;84–477;84–456;84–510;84–509;84–53;84–523;84–531;84–428;84–304;84–531;84–527;84–523;84–516;84–320;84–525;84–480;84–531;84– |
| 3666 | 1–424;53–246;62–497;62–484;62–398;62–503;62–497;62–471;80–390;82–475;82–400;82–484;82–323;82–467;82–483;82–503;82–497;82–503;82–503;82491;82–503;82–259;82–450;82–503;82–476;82–467;82–259;83–438;83–503;83–479;83–468;83–421;83–488;83–479;83–503;83–478;83–404;83–499;83–467;83–320;83–497;83–484;83–380;83–427;83–497;83–374;83–492;83–491;83–443;83–494;83–337;83–136;83–484;83–471;83–381;83–471;83–496;83–468;83–503;83–567;83–448;83–317;83–503;83–476;83–455;83–503;83–427;83–373;83–319;83–479;83–503;83–398;83–478;83–466;83–503;83–503;83–503;83–503;83–491;83–455;83–448;83–402;83–503;83–284;83477;83–466;83–404;83–467;83–475;83–502;83–324;83–503;83–163;83–490;83–484;83–443;83–471;83–500;83–276;83–448;83–484;83–490;83–466;83–163;83–242;83–284;83–503;83–443;83–443;83–503;83–243;83–490;83–455;83–303;83–503;83–439;83–486;83–483;83–503;83–484;83–443;83–442;83–503;83–476;83–503;83–414;83–494;83–450;83–503;83–428;83–428;83–476;83–492;83–503;83–411;83–494;83–503;83–493;83–436;83–503;83–444;83–503;83–484;83–499;83–472;83–455;83– |
| 3670 | 1–463;8–550;8–490;8–483;8–330;8–453;8–335 |
| 3671 | 1–444;1–514;1–342 |
| 3672 | 1–460;1–480;1–518;1–488;1–535;1–398;2–335;41–476;43–473;76–597;76–585;76–398;76–369;76–550;76–573;76–546;76–587 |
| 3676 | 1–489;1–586 |
| 3678 | 1–471;1–464 |
| 3679 | 1–343;1–132;1–425;1–495;1–446;1–372;1–422;1–492;1–524 |
| 3680 | 1–336;1–421;1–941;34–497 |
| 3681 | 1–410;12–447;12–496;23–587;32–490;35–537;52–543;52–543;52–484;52–483 |
| 3684 | 1–508;1–414;1–449;1–472;1–504;1–490;1–474;1–466;1–441;2–421 |
| 3685 | 1–284;1–427 |
| 3688 | 1–471;1–465 |
| 3689 | 1–339;1–356;1–525 |
| 3690 | 1–488;1–438;1–513;1–465;41–473;41–473 |
| 3691 | 1–377;1–477;1–529;1–529;1–506;1–564;1–477;1–524;1–560;1–471;1–477;1–508;1–488 |
| 3693 | 1–324;39–473 |
| 3694 | 1–410;45–461 |
| 3697 | 1–469;1–467 |
| 3698 | 1–195;1–454;1–382;–485;5–327 |

TABLE II-continued (Tiling path)

| Seq Id No. | Positions of biological 5'ESTs |
|---|---|
| 3699 | 1–858;1–444 |
| 3701 | 1–273;1–499;1–479;1–334;1–467;1–460;1–493;1–496;1–493;1–462;1–525;1–477;1–496;–223;–296;1–514;1–478;1–479;1–487;1–229;1–194;1–482;1–388;1–475;1–572;1–459;1–387;1–497 |
| 3702 | 1–500;1–374;1–479;1–470;1–480;1–504;1–543 |
| 3703 | 1–483;1–487;1–485;1–394;1–487;1–492;1–503;1–491;1–488;1–445;1–452;1–339;1–493;1–471 |
| 3706 | 1–442;8–499;19–451;19–409;42–458 |
| 3708 | 1–496;1–331;13–499;13–517;13–128;13–512;13–514;13–453;13–525;13–506;38–444;57–633;57–500;58–505 |
| 3709 | 1–331;13–128;13–451;38–444;57–500;234–504;234–504 |
| 3710 | 1–560;5–382 |
| 3711 | 1–426;1–461;1–430 |
| 3712 | 1–460;1–471;1–415;1–462;14–457;14–456;14–457;14–466;14–452 |
| 3713 | 1–482;4–350;5–497;5–485;5–499;5–490;28–495;29–494;29–471;36–450;36–499;36–495;49–492;49–492;49–487;49–491;49–497 |
| 3715 | 1–507;1–142 |
| 3716 | 1–483;13–182;239–771;246–675;270–652;270–665 |
| 3717 | 1–501;1–472;1–459;1–508;1–494;1–423;1–478;33–350;72–599;72–558;72–550;72–597;72–513;72–421;72–578 |
| 3719 | 1–435;2–449;2–205;2–511;2–423;3–64;3–462;3–423;3–406;4–388;22–443;25–443;25–140 |
| 3720 | 1–816;1–436;2–450;2–205;2–424;3–64;3–463;3–424;3–407;4–530;4–507;4–389;8–510;22–444;22–816;25–140;25–444 |
| 3721 | 1–469;1–442 |
| 3722 | 1–379;1–466;1–473;1–496;1–331;1–466;1–242;1–486;1–403 |
| 3723 | 1–304;1–408;1–409;1–477;1–465;1–366 |
| 3724 | 1–412;1–469 |
| 3726 | 1–507;1–339;1–491;1–523 |
| 3727 | 1–472;1–483;1–496;1–579 |
| 3731 | 1–250;1–494 |
| 3732 | 1–425;1–524;41–486;57–302 |
| 3733 | 1–381;1–415;1–364;1–479 |
| 3738 | 1–468;1–245;1–463;1470;1–457;1–244;1–452;1–375;17–432;48–439;48–522;48–544;48–493;48–362;48–466;48–375;48–515;48–397;48–523;48–454;48–467;48–145;48–485;48–520;48–465;48–361;49–328;52–523;52–514;52–516;52–132;52–432;52–430;52–535;52–431;52–477;52–467;52–371;59–542;59–447;59–525;59–481;59–340;59–423;59–375;59–248;59–484;59–357;59–357;59–410;59–447;59–544;59–546;59–564;59–444;59–485;59–428;59–417;59–521;59–351;59–528;59–466;59–467;59–564;59–510;66–534;67–484;67–549;86–556;86–562;86–456;86–360;86–514;86–546;86–531;86–530;86–534;86–485;86–251;86–552 |
| 3739 | 1–433;1–98;5–85;5–68 |
| 3740 | 1–476;1–457;1–473 |
| 3742 | 1–425;4–429;4–382;4–464;4–503;8–67;8–500;8–484;8–500;11–478;18–431;29–509;41–481;41–475;44–496;45–489;45–490;45–484;45–492;45–547;45–515;45–509;45–494;45–508;45–427;45–474;45–509;45–333;45–490;45–415;45–171;45–474;45–463;45–358;45–382;46–395;46–327;46–335;46–413;81–585;82–497;82–499;82–513;82–464;82–523;100–488;100–573;100–506;100–491;100–603;100–500;100–491;100–581;100–591;100–500;112–510;112–504;112–510 |
| 3743 | 1–490;158–613 |
| 3744 | 1–312;1–308;1–247;1–271;2–295;2–193;2–243;2–274;2–159;2–321;2–200;2–212;2–324;2–468;2–288;2–133;2–71;2–491;2–269;2–133;2–331;2–268;2–213;2–159;2–477;4–319;4–303;4–328;4–148;4–331;4–282;5–275;5–145;5–266;5–313;5–323;5–221;5–322;5–325;5–266;5–290;5–327;5–266;5–329;5–266 |
| 3746 | 1–409;1–418;1–301 |
| 3748 | 1–437;50–519;50–495;51–425;51–534 |
| 3749 | 1–380;1–403;1–377;1–446;1–387;1–392;1–373;1–125;1–370;1–393;2–324;16–484;16–506;16–471;16–447;31–379;36–366;38–111 |
| 3750 | 1–389;2–421;2–424;2–405;2–421;2–421 |
| 3751 | 1–389;1–444;2–405 |
| 3753 | 1–499;1–457;1–131;1–462;1–508;2–231;2–465;2–313;2–456;2–332;2–478;3–557;3–281;3–455;3–452;4–513;4–405;4–456;4–357;5–429;11–455;11–63;11–461;11–531;11–465;11–451;11–483;11–453;14–342;23–504 |
| 3754 | 1–380;1–166;1–231;1–371;30–171;99–495 |
| 3756 | 1–448;2–512;2–99;2–132;2–352;2–98;2–439;2–134;2–245;2–100;2–100;2–100;2–225;2–100;2–134;2–100;2–96;2–117;2–100;4–444;4–494;5–487;5–431;5–525;16–455 |
| 3757 | 1–362;1–350;24–473 |
| 3759 | 1–402;3–518;5–380;5–376;5–438;5–419;5–103;5–365;5–480;5–439;5–478;5–497;24–444;24–440 |
| 3760 | 1–485;1–490;1–58 |
| 3761 | 1–111;1–454;1–447 |
| 3763 | 1–472;1–469;1–372;1–477 |
| 3764 | 1–473;1–480 |
| 3766 | 1–566;1–221;128–470;265–728 |
| 3767 | 1–371;22–478 |
| 3769 | 1–461;1–457 |
| 3771 | 1–69;24–548;24–438;24–477;24–228;24–504;24–471;99–401;113–604;113–612;113–563;113–466;113–441;113–615;113–618;113–465;113–578 |
| 3772 | 1–464;1–177;1–492 |
| 3773 | 1–505;1–370 |
| 3774 | 1–488;1–379;81–518;243–762;598–1060;653–759;714–1157;814–157;814–1149;822–1101 |
| 3775 | 1–461;1–455;1–466;1–473;1–452;1–443;1–459;1–443;1–443;1–439;1–451;1–453;1–440;1–464;1–473;1–470;1–444;1–342;1–330;1–463;1–443;1–470;1–451;1–460;1–355;1–442;1–464;1–397;1–460 |
| 3776 | 1–178;1–461;1–406;5494;5–476;5–457;5–542;5–491;5–449;5–452;5–521;5–506;5–520;6–392;17–518;19–517;19–405;19–521;19–1100;19–498;36–176 |
| 3777 | 1–324;1–516 |
| 3778 | 1–64;1–65;1–75;28–504;28–488;28–427;28–505;28–510;28–505;28–496;28–167;28–444;28–494;28–314;28–505;32–183;67–687;67–550;67–405;67–496;72–496;72–597 |
| 3779 | 1–407;2–445;2–425;2–503;2–488;2–459;2–396;2–488;2–413;2–426;2–431;2–494;2–494;2–420;2–391;2–494;2–464;2–454;2–463;2–435;2–444;2–471;2–461;2–497;2–187;2–489;2–443;2–474;2–473;2–424;2–489;2–470;2–484;2–477;2–481;2–499;3–493;3–457;3–474;3–392;3–499;3–301;3–478;3–485;3–485;3–304;3–510;3–495;3–495;3–507;3–483;3–471;3–474;3–303;3–479;5–489;5–490;5–507;5–484;5–484;5– |

TABLE II-continued (Tiling path)

| Seq Id No. | Positions of biological 5'ESTs |
|---|---|
| | 497;5–443;5–275;5–485;5–496;5–495;5–527;5–473;5–496;5–510;5–484;5–306;5–445;5–472;5–476;5–489;5–388;5–484;5–469;5–479;5–387;5–412;5–488;5–492;5–484;5–443;5–477;5–192;5–496;5–471;5–503;5–492;5–476;5–479;5–484;6–453;6–362;7–415;7–485;7–494;7–487;7–484;7–497;7–476;7–408;7–501;7–192;11–334;13–362;13–299;13–489;33–465;33–496;33–413;33–486;33–485;33–520;33–332;33–466;33–502;33–408;33–51;33–478;33–429;33–492;33–306;33–508;54–386 |
| 3780 | 1–407;2–445;2–484;2–425;2–488;2–536;2–396;2–464;2–499;2–494;2–420;2–494;2–426;2–391;2–463;2–494;2–459;2–431;2–444;2–454;2–471;2–481;2–497;2–488;2–484;2–461;2–503;2–474;2–489;2–413;2–473;2–489;2–435;2–187;2–552;2–470;2–477;2–443;3–457;3–552;3–499;3–392;3–485;3–474;3–485;3–478;3–301;3–493;3–542;3–479;3–510;3–507;3–304;3–495;3–483;3–495;3–471;3–474;3–303;5–490;5–531;5–489;5–306;5–497;5–484;5–443;5–507;5–496;5–485;5–495;5–476;5–473;5–510;5–484;5–445;5–496;5–472;5–484;5–275;5–479;5–387;5–471;5–532;5–484;5–484;5–469;5–489;5–388;5–479;5–492;5–492;5–503;5–412;5–488;5–192;5–477;5–484;5–476;5–496;5–443;6–362;6–453;7–497;7–494;7–484;7–501;7–485;7–415;7–408;7–476;7–487;7–192;11–555;11–334;13–299;13–362;13–489;13–546;33–540;33–465;33–552;33–523;33–496;33–486;33–413;33–332;33–502;33–511;33–485;33–531;33–466;33–492;33–408;33–429;33–306;33–527;33–508;33–478;54–386 |
| 3781 | 1–451;83–534 |
| 3782 | 1–467;2–357 |
| 3784 | 1–484;1–484;1–261 |
| 3785 | 1–291;1–421;1–348;1–442 |
| 3786 | 1–420;1–416;1–414;1–420;1–416;1–420;1–416;1–163;1–416;1–404;1–416;1–416;1–420;1–420;1–416;1–420;1–350;1–416 |
| 3787 | 1–419;1–505 |
| 3788 | 1–491;1–466 |
| 3789 | 1–478;1–488 |
| 3790 | 1–495;1–443;1–255;1–450 |
| 3791 | 1–389;1–373;–391;1–398;1–39;1–373 |
| 3792 | 1–488;1–448;1–450;1–287;1–71;1–474;–430;1–495;2–465 |
| 3793 | 4–363;4–410;13–469;3–481;13–482;13–455;13–480;15–406;15–487;15–461;15–147;15–391;15–425;16–498;16–144;16–492;16–434;16–487;16–449;16–145;16–129;16–479;16–397;16–462;16–391;16–483;16–472;16–484;16–463;16–497;16–443;16–472;16–477;16–491;16–481;16–485;16–483;16–333;16–482;16–443;16–471;16–434;16–481;16–486;16–145;16–480;16–420;16–421;16–434;16–479;16–406;16–462;16–480;16–86;16–484;16–487;16–458;16–446;16–471;16–204;16–139;16–435;16–141;16–480;16–145;16–452;16–403;16–435;16–387;16–458;16–459;16–458;16–482;16–472;16–493;16–243;16–434;16–478;16–470;16–117;16–487;16–450;16–485;16–458;16–441;16–486;16–442;16–422;16–490;16–482;16–460;16–483;16–469;16–418;16–472;17–433;17–441;17–462;17–480;17–423;17–453;17–484;17–484;17–484;17–469;17–451;17–474;17–477;17–303;17–462;17–469;17–463;17–461;17–404;17–462;17–458;17–124;17–440;17–471;17–495;17–419;17–327;17–479;17–445;17–487;17–420;20–344;20–485;20–480;20–386;20–475;46–325;46–349;46–484;46–20 |
| 3794 | 1–522;1494;1–492;12–440;12–389;22–563;22–521;22–563;22–522;22–492;22–544;24–437;24–522;24–458;24–420;24–498;24–160;25–534;25–158;25–533;25–551;25–534;25–498;25–544;25–513;25–544;25–483;25–143;25–420;25–522;25–589;25–544;25–498;25–522;25–525;25–522;25–513;25–532;25–521;25–522;25–159;25–572;25–522;25–475;25–475;25–356;25–534;25–561;25–544;25–521;25–522;25–159;25–421;25–450;25–450;25–572;25–513;25–544;25–437;25–571;25–498;25–522;25–534;25–93;25–547;25–522;25–519;25–522;25–542;25–450;25–531;25–522;25–131;25–222;25–542;25–153;25–155;25–544;25–483;25–483;25–495;25–495;25–513;25–534;25–534;25–589;25–495;25–495;25–522;25–429;25–573;25–534;25–553;25–159;25–534;25–450;25–553;25–522;25–496;25–522;25–497;25–544;25–475;25–475;25–563;25–262;25–522;25–534;26–544;26–513;26–522;26–498;26–450;26–522;26–544;26–475;26–483;26–498;26–544;26–475;26–498;26–513;26–138;26–498;26–553;26–544;26–429;26–522;26–319;26–498;26–542;26–544;26–450;26–534;26–475;26–495;26–522;26–450;26–552;26–513;26–563;26–350;29–513;29–577;29–368;57–553;57–544 |
| 3801 | 1–273;1–403;1–403;1–366;1–157;1–462;3–290 |
| 3802 | 1–273;1–468;1–403;1–403;1–366;1–157;3–290 |
| 3803 | 1–475;5–449;50–407;50–507;50–508;50–552;50–547;52–521;52–534;52–533;52–526;52–517;52–238;52–574;88–536;88–579;468–985 |
| 3807 | 1–471;1–445;4–452;4–464;40–498;40–209 |
| 3808 | 1–499;1–446 |
| 3809 | 1–462;1–484;1–473;1–450;1–455;6–477;12–590;36–418;39–538 |
| 3810 | 1–503;1–450 |
| 3811 | 1–476;41–528;46–527;46–509;46–519;46–518;49–526 |
| 3812 | 1–467;29–519 |
| 3813 | 1–483;1–451;1–345;1–518;1–486 |
| 3814 | 1–449;6–515;7–478 |
| 3815 | 1–478;1–480 |
| 3816 | 1–443;1–458 |
| 3817 | 1–85;45–455 |
| 3818 | 1–371;4–484 |
| 3819 | 1–527;1–368 |
| 3820 | 1–368;1–480 |
| 3821 | 1–449;–436 |
| 3822 | 1–481;1–459;1–487;1–437;1–435;1–465;1–569;–491;1–535;1–513;1–447;1–468;1–469;1–481;1–552;1–414;1–490;1–447;1–459;1–509;1–278 |
| 3825 | 1–463;1–487 |
| 3826 | 1–220;19–511;19–472;19–512;19–448;19–315;28–465;28–480;28–531;28–515;28–199;28–453;28–517;28–456;28–495;28–536;28–495;28–515;28–469;28–411;28–545;3–506;31–532;31–389;31–95;31–480;31–484;31–511;3–518;31–459;31–511;3–459;31–505;31–489;31–507;31–459;3–518;31–441;31–506;31–95;31–508;31–488;31–506;31–95;31–407;31–543;31–463;31–95;31–220;31–107;31–518;31–505;31–476;31–536;31–226;31– |

TABLE II-continued (Tiling path)

| Seq Id No. | Positions of biological 5'ESTs |
|---|---|
|  | 503;31–481;31–95;31–496;31–494;31–500;31–496;31–95;31–491;31–480;31–481;31–491;31–483;32–237;32–368;32–468;34–505;42–506;42–493;42–503;57–603 |
| 3827 | 1–105;1–432;1–453;1–400;1–432;1–439;1–351;1–362;1–440;1–261;1–332;1–444;1–352;1–362;1–430;1–441;1–339;1–398;1–419;1–421;1–191;1–287;1–144;1–345;1–432;1–413;1–356;1–190;1–161;1–414;1–379;1–445;1–99;1–441;1–432;1–434;1–464;1–63;1–442;1–441;1–290;1–359;1–451;1–172;1–224;1–285;1–442;1–427;1–270;1–275;1–400;1–453;1–432;1–446;1–419;1–227;1–421;1–459;1–280;1–88;1–454;1–281;1–444;1–442;1–458;1–369;1–464;1–78;1–441;1–431;1–336;1–350;1–442;1–207;1–453;1–453;1–298;1–457;1–431;1–440;1–355;1–465;1–457;1–283;1–340;1–432;1–464;1–231;1–216 |
| 3829 | 1–346;8–577;14–503;16–483;16–455;16–496;16–482;16–478;16–211;16–479;16–517;16–500;16–378;16–457;16–398;35–519;57–530;57–589 |
| 3830 | 1–484;2–335;2–561;2–456;2–480;2–512;2–395;2–550;2–485;2–60;2–470 |
| 3831 | 1–477;1–542 |
| 3834 | 1–592;1–493 |
| 3835 | 1–452;1–209 |
| 3837 | 1–550;1–542 |
| 3839 | 1–517;1–70;1–489;1–456;1–488;1–446;1–533;1–408;1–267;1–456;1–442;1–483;1–529;1–497;1–533;1–536;1–432;1–533;1–506;1–396;1–389;1–469;1–243;11–374 |
| 3840 | 1–70;1–489;1–434;1–456;1–483;1–488;1–408;1–494;1–267;1–456;1–442;1–446;1–426;1–495;1–441;1–432;1–396;1–389;1–469;1–243;1–508;11–374 |
| 3845 | 1–351;1–213 |
| 3846 | 1–432;248–768 |
| 3848 | 1–547;1–539;1–539;1–447;1–314;1–547;1–349;1–539;1–438;1–554;1–547;1–539;1–449;1–554;1–539;1–674;1–497;1–547;1–547;1–375;1–547;1–438;1–547;1–547;1–539;1–438;1–539;1–606;1–438;1–554;1–438;1–564;1–438;1–554;1–547;1–542;1–547;1–547;1–547;1–485;1–438;1–61;1–426;1–480;1–567;1–539;1–438;1–483;1–547;1–485;1–554;1–547;1–423;1–547;1–539 |
| 3860 | 1–468;1–243 |
| 3861 | 1–335;1–424;1–54 |
| 3864 | 1–500;1–513 |
| 3865 | 1–495;8–151;8–166;8–176;8–176;8–158;8–176;8–165;8–179;8–176 |
| 3866 | 1–461;1–470;1–470;1–446 |
| 3868 | 1–368;1–61;1–446;1–467;1–398;1–409;1–450;1–424;1–450;1–425;1–418;1–467;1–278;1–458;1–470;1–500;1–478 |
| 3870 | 1–457;1–503 |
| 3874 | 1–417;189–604;192–419;193–613;193–489;193–548;193–452;193–604 |
| 3880 | 1–452;275–698;278–508;279–707;279–578;279–541;279–698;279–635 |
| 3882 | 1–202;2–205;4–485;6–221;6–221;6–221;6–218;17–114;21–193 |
| 7819 | 1–205;1–186;1–200;1–200;1–200;1–182;1–200;1–200;1–194;1–200;1–196 |
| 7828 | 1–498;58–547;58–418;58–584 |
| 7837 | 1–355;21–477;21–395;57–547 |
| 7845 | 1–355;21–477;21–395;65–562 |
| 7851 | 1–432;1–449 |
| 7872 | 1–106;1–556;1–449;1–523;1–551;1–415;1–468;1–556;1–501;1–449;1–556;1–556;1–452;1–496;1–361;1–556;1–556;1–566;1–372;1–452;1–263;1–341;1–487;1–462;1–362;1–372;1–498;1–447;1–507;1–545;1–491;1–507;1–347;1–556;1–413;1–433;1–556;11433;1–556;1–556;1–194;1–292;1–556;1–551;1–146;1–355;1–449;1–429;1–366;1–552;1–556;1–556;1–193;1–163;1–430;1–488;1–386;1–508;1–463;1–556;1–566;1–466;1–556;1–100;1–449;1–556;1–556;1–556;1–451;1–64;1–479;1–460;1–556;1–497;1–491;1–295;1–489;1–556;1–369;1–510;1–498;1–491;1–179;1–468;1–479;1–228;1–290;1–460;1–79;1–444;1–275;1–487;1–280;1–566;1–500;1–415;1–468;1–509;1–449;1–464;1–433;1–231;1–433;1–478;1–511;1–285;1–556;1–89;1–537;1–468;1–286;1–501;1–462;1–460;1–465;1–466;1–477;1–466;1–508;1–572;1–554;1–489;1–471;1–468;1–507;1–205;1–556;1–488;1–448;1–556;1–344;1–360;1–556;1–487;1–544;1–556;1–564;1–569;1–566;1–556;1–460;1–468;1–365;1–479;1–300;1–499;1–476;1–448;1–452;1–535;1–556;1–220;1–476;1–541;1–288;1–347;1–449;1–479;1–235;2–553;2–538 |
| 7920 | 1–112;1–112;1–171;1–128;2–149 |
| 7945 | 1–238;1–238 |
| 7963 | 1–334;1–334;1–328;1–297;1–334;1–322;1–327 |
| 7991 | 1–450;1–279;1–369;1–519 |
| 8242 | 1–450;1–429 |
| 8292 | 1–401;1–416;1–369;1–457;1–406;1–436 |
| 8324 | 1–459;1–459 |
| 8351 | 1–411;1–476;1–477;1–443 |
| 8377 | 1–150;1–150;1–150 |
| 8385 | 1–438;1–393 |
| 8393 | 1–463;1–322 |
| 8401 | 1–557;1–382;1–425;1–448;1–386;1–419;1–415 |
| 8413 | 1–434;1–492 |
| 8421 | 1–420;1–467;1–484;1–455;1–442 |
| 8436 | 1–518;1–586;4–496 |
| 8452 | 1–429;1–547 |
| 8477 | 1–369;33–114 |
| 8508 | 1–421;1–421;1–421;1–421;1–421;1–363;1–421 |
| 8529 | 1–411;2–223;4–460 |
| 8538 | 1–433;1–459;1–222;3–409 |
| 8560 | 1–379;1–267;1–442;15–233 |
| 8586 | 1–439;1–272 |
| 8627 | 1–411;123–506 |
| 8689 | 1–96;1–366 |
| 8821 | 1–410;1–369 |
| 8830 | 1–446;1–469;1–500;1–505;1–498;1–321;1–213;1–493;1–356;1–480;1–482;1–467;1–454;1–362;1–544;1–136;1–477;1–218;2–537;2–500 |
| 8841 | 1–467;1–475 |
| 8862 | 1–320;1–212;1–355;1–361;1–135;1–217;1–379 |
| 8884 | 1–193;1–206;1–206;1–203;1–206;1–206;1–194;1–194;1–194;1–206;1–194;1–205;1–206;1–206;1–206;1–195;1–199;1–157;1–208;1–206;1–206;1–184;1–194;1–206;1–206;1–206;1–194;1–194;1–205;1–158;1–189;1–194;1–194;1–194;1–206;1–194;1–206;1–194;1–194;1–206;1–206;1–206;1–206;1–206;1–205;1–206;1–187;1–206;1–194;1–146;1–194;1–206;1–206;1–163;1–193;1–193;1–206;3–201 |
| 8885 | 1–437;1–442 |
| 8905 | 1–212;1–212;1–212;1–212 |
| 8955 | 1–326;1–371;1–445 |
| 8976 | 1–399;32–388 |
| 8992 | 1–341;1–469;1–478 |

TABLE II-continued (Tiling path)

| Seq Id No. | Positions of biological 5'ESTs |
|---|---|
| 9016 | 1–468;1–515 |
| 9024 | 1–380;1–387 |
| 9064 | 1–431;4–439;5–194 |
| 9093 | 1–175;1–175;1–175;1–170;1–171;1–171;1–55;1–175;1–175;1–171;1–171;1–175;1–175;1–171;1–175;1–171;1–175;1–175;1–171;1–175;1–175 |
| 9097 | 1–445;1–556;1–294;1–428;1–153;1–435;1–537 |
| 9121 | 1–433;1–205;1–434 |
| 9177 | 1–377;1–377;1–86;1–377;1–376;1–377;1–377;1–377;1–109;1–377;1–377;1–139;1–377;1–377;1–362;1–377;1–377;1–377;1–377;1–377;1–377;1–377;1–377;1–377;1–377;1–349;1–377;1–377;1–377;1–377;1–364;1–377;1–377;1–377;1–377;1–377;1–377;1–377;1–377;1–377;1–377;1–377;1–151;1–377;1–377;1–377;1–377;1–377;1–365;1–377;1–377;1–164;1–377;1–377;1–377;1–377;1–377;1–377;1–377;1–377;1–377;1–361;1–377;1–372;1–377;1–377;1–377;1–376;1–375;1–377;1–377;1–376;1–377;1–344;1–377;1–349;1–377;1–377;1–346;1–377;1–377;1–372;1–375;1–377;1–346;1–377;1–377;1–377;1–377;1–376;1–376;1–341;1–377;1–377;1–149;1–377;1–342;1–377;1–377;1–377;1–377;1–349;1–377;1–377;1–377;1–377;1–377;1–377;1–377;1–377;1–377;1–377;1–377;1–377;1–377;1–377;1–377;1–377;1–377;1–377;1–377;1–377;1–376;1–377;1–365;1–377;1–376;1–377;1–146;1–348;1–377;1–377;1–377;1–377;1–377;1–377;1–346;1–377;1–375;1–377;1–377;1–377;1–377;1–377;1–377;1–377;1–377;1–377;1–377;1–384;1–377;1–377;1–169;1–270;1–345;1–377;1–343;1–377;1–377;1–377;1–377;1–377;1–377;1–367;1–377;1–377;1–377;1–377;1–377;1–377;1–377;1–377;1–377;1–341 |
| 9185 | 1–386;1–386;1–88;1–392;1–385;1–386;1–386;1–386;1–111;1–386;1–386;1–392;1–142;1–386;1–371;1–386;1–386;1–386;1–386;1–386;1–386;1–386;1–386;1–386;1–373;1–386;1–386;1–386;1–386;1–386;1–386;1–386;1–349;1–386;1–386;1–386;1–386;1–386;1–386;1–154;1–386;1–386;1–386;1–386;1–386;1–374;1–386;1–386;1–167;1–386;1–386;1–385;1–386;1–386;1–386;1–386;1–386;1–386;1–370;1–386;1–381;1–386;1–386;1–386;1–385;1–384;1–386;1–386;1–388;1–386;1–350;1–386;1–386;1–392;1–386;1–386;1–350;1–389;1–386;1–381;1–386;1–384;1–350;1–386;1–387;1–386;1–386;1–385;1–386;1–374;1–386;1–386;1–152;1–349;1–386;1–392;1–386;1–386;1–386;1–386;1–386;1–386;1–386;1–386;1–386;1–386;1–386;1–386;1–386;1–386;1–386;1–386;1–387;1–386;1–386;1–386;1–386;1–385;1–386;1–387;1–386;1–386;1–392;1–392;1–385;1–149;1–386;1–386;1–386;1–386;1–386;1–386;1–386;1–350;1–384;1–386;1–386;1–386;1–386;1–350;1–392;1–386;1–386;1–386;1–386;1–386;1–392;1–386;1–386;1–172;1–386;1–272;1–386;1–392;1–386;1–386;1–386;1–387;1–386;1–386;1–376;1–386;1–349;1–386;1–386;1–386;1–350;1–386 |
| 9192 | 1–298;1–31.2;1–274;1–293;1–313 |
| 9208 | 1–473;1–438 |
| 9217 | 1–397;1–445;1–452;1–451;1–452;1–389;1–442;1–452;1–465;1–449;1–398;1–443;1–429;1–442;1–407;1–432;1–380;1–445;1–452;1–445;1–438;1–133;1–453;1–437;1–434;1–463;1–465;1–448;1–448;1–452;1–448;20–167 |
| 9218 | 1–459;1–447;364–861 |
| 9256 | 1–489;1–490;1–312;1–510;1–490;1–480;1–461;1–434;1–490;1–494;1–417;1–514;1–517;1–531;1–473;1–364;1–476;1–480;1–341;1–134;1–497 |
| 9279 | 1–454;1–288;1–429;1–354;1–497;1–366;1–512;1–444 |
| 9299 | 1–299;1–298 |
| 9307 | 1–394;1–408;1–409;1–420;1–387;1–419 |
| 9339 | 1–483;1–467 |
| 9357 | 1–379;1–389 |
| 9362 | 1–63;1–64;1–62;1–63 |
| 9396 | 1–118;31–328;31–463;31–437;31–476;31–476;31–360;31–463;31–470;31–466;31–460;31–469;31–479;31–401;31–358;31–479;31–344;31–209;31–198;31–364;31–442;31–472;31–255;31–156;31–358;31–402;31–472;31–455;31–460;31–453;31–448;31–400;31–482;31–230;31–339;31–485;31–471;31–469;31–476;31–214;31–359;31–404;31–230;31–470;31–470;31–479;31–323;31–391;31–463;31–485;31–476;31–472;31–100;31–241;31–447;31–460;31–448;31–478;31–470;31–356;31–437;31–214;31–479;31–476;31–379;31–314;31–351;31–482;31–381;31–295;31–485;31–466;31–482;31–466;31–442;31–437;31–472;31–400;31–314;31–470;31–485;31–437;31–345;31–452;31–214;31–482;31–469;31–449;31–349;31–379;31–323;31–482;31–392;31–448;31–252;31–328;31–468;31–476;31–339;31–479;31–358;31–483;31–101 |
| 9403 | 1–119;1–176;31–99;31–100 |
| 9411 | 1–119;31–488;31–531;31–366;31–522;31–530;31–529;31–545;31–483;31–544;31–544;31–451;31–544;31–531;31–347;31–523;31–201;31–505;31–530;31–537;31–485;3–532;31–533;31–466;31–365;31–409;31–506;31–496;31–530;31–234;31–344;3–499;31–532;31–506;31–544;31–430;31–521;31–543;31–485;31–520;31–243;31–101;31–453;31–442;31–529;31–530;31–544;31–544;31–220;31437;31–547;31–540;31–387;31–543;31–505;31–532;31–543;31–439;31–389;31–496;31–508;31–530;31–522;31–538;31–449;31–521;31–524;31–416;31–438;31–530;31–551;31–525;31–354;31–544;31–400;31–533;31–544;31–530;31–508;31–544;31–504;31–508;31–531;31–439;31–531;31–531;31–437;31–544;31–430;31–102;31–333;31–508;31–440;31–520;31–532;31–522;31–508;31–508;31–436;31–540;31–529;31–532;31–506;31–517;31–533;31–522;31–531;31–442;31–158;31–428;31–464;31–523;31–544;31–544;31–507;31–530;31–430;31–482;31–519;31–543;31–544;31–416;31–542;31–488;31–499;31–453;31–437;31–553;31–488;31–544;31–504;31–506;31–530;31–531;31–354;31–521;31–300;31–496;31–544;31–440;31–537;31–455;31–507;31–319;31–437;31–521;31– |
| 9420 | 1–352;1–357;1–354;1–368;1–358;1–166;1–345;1–358;1–362;1–362;1–359;1–119;1–367;31–100;31–99 |
| 9462 | 1–441;4–105 |
| 9546 | 1–511;1–471;1–256;1–482;47–511;49–501 |
| 9553 | 1–409;1–245 |
| 9597 | 1–456;1–454 |
| 9614 | 1–478;3–244 |

TABLE II-continued (Tiling path)

| Seq Id No. | Positions of biological 5'ESTs |
|---|---|
| 9622 | 1–496;1–458;1–479;1–242;1–290;1–357;1–511 |
| 9633 | 1–386;2–432;2–444;2–455 |
| 9643 | 1–420;1–447;1–468;1–453 |
| 9652 | 1–458;95–569 |
| 9669 | 1–285;1–145 |
| 9677 | 1–434;1–405 |
| 9721 | 1–377;1–359;25–376;25–358;30–377;30–378;30–36 |
| 9731 | 1–543;1–543;1–543;1–511;1–494;1–543;1–447;1–621;1–586;1–482;1–543;1–556;1–429;1–543;1–378;1–541;1–543;1–543;1–556;1–511;1–425;1–543;1–538;1–369;1–537;1–543;1–458;2–428 |
| 9748 | 1–368;1–501 |
| 9759 | 1–487;1–453 |
| 9769 | 1–447;1–466 |
| 9780 | 1–415;1–425;1–460;1–542;1–459;1–461;1–432;1–468;1–450;1–402;1–450 |
| 9800 | 1–396;1–393;1–370;1–375;1–399;1–369;1–381;1–391;1–394;1–404;1–387;1–379;1–405;1–383;1–403;1–215;1–388;1–390;1–397;1–387;1–403;1–387;1–304;1–404;1–391;1–404;1–404;1–403;1–387;1–403;1–387;1–377;1–404;1–403;1–341;1–403;1–389;1–384;1–388;1–387;1–389 |
| 9836 | 1–483;1–407;1–497;1–489;3–151 |
| 9861 | 1–455;1–485;1–335;1–523;3–185;3–553;3–472;4–447;4–466;4–496 |
| 9879 | 1–491;1–498;1–504;1–472;1–485 |
| 9880 | 1–191;1–179;1–179;1–191;1–194;1–191;1–121;1–191;1–194;1–194;1–191;1–191;1–194;1–194;1–194;1–191;1–194;1–194;1–194;1–194;1–194;1–179;1–179;1–179;1–191;1–191;1–194;1–194;1–191;1–191;1–191;1–194;1–194;1–194;1–191;1–194;1–194;1–194 |
| 9885 | 1–382;1–453;97–572;97–585;97–458;97–572;97–578;97–578 |
| 9893 | 1–482;1–468 |
| 9918 | 1–451;345–836;345–822;345–853;345–869;345–867;345–838;345–556;345–840;345–617;345–673;345–777;345–830;345–891;345–816;345–702;345–836;345–827;345–819;345–834;345–503;444–732 |
| 9964 | 1–356;4–469 |
| 9988 | 1–447;1–472;1–467;1–488;1–334;1–474;1–355 |
| 10032 | 1–310;14–527;14–439;14–441;16–395;23–564 |
| 10042 | 1–483;1–406 |
| 10073 | 1–509;1–439 |
| 10079 | 1–497;1–476;1–443;1–498 |
| 10088 | 1–519;1–485 |
| 10106 | 1–351;1–441 |
| 10153 | 1–477;1–413;1–496;1–458;1–349;1–203;1–466;1–399;1–450;1–484 |
| 10178 | 1–243;1–242;1–239;1–210;1–239;1–187;1–246;1–209;1–235;1–221;1–244;1–177;1–91;3–221 |
| 10295 | 1–476;1–491;1–511;1–493;1–501;1–512;1–269;2–463;16–463;29–508;29–475;29–515;29–509;29–361;29–463;29–515;29–127;29–476;29–432;29–476;29–476;30–492;30–509;30–481;30–412;30–463;30–480;30–322;30–420;30–460;30–476;30–246;30–510;30–322;30–412;30–498;30–501;30–453;30–511;30–501;30–185;30–511;30–405;30–500;30–506;30–474;30–509;31–503;31–308;31–597;31–507;31–374;31–503;31–510;31–514;31–498;31–358;31–415;31–517;31–494;31–410;31–496;31–504;31–510;31–487;31–503;31–490;31–509;31–494;31–412;31–501;31–502;31–508;31–493;31–474;31–405;31–213;31–248;31–206;31–382;31–509;31–412;31–454;31–512;31–507;31–512;31–127;31–457;31–510;31463;31–435;31–501;31–496;31–404;31–267;31–496;31–499;31–512;31–460;31–474;31–185;31–270;31–480;31–449;31–90;31–528;31–552;31–500;31–389;31–477;31–499;31–499;31–515;31–510;31–300;31–433;31–553;32–510;32–319;32–474;32–488;32–206;32–382;32–308;32–335;32–322;32–463;32–495;32–499;32–501;32–476;32–427;32–457;32–548;32–390;32–484;32–158;32–508;32–335;32–512;32–126;32–322;32–420;32–496;32–430;32–489;32–506;32–5 |
| 10296 | 1–476;1–481;1–480;1–477;1–393;1–474 |
| 10331 | 1–259;1–259 |
| 10339 | 1–115;1–370;1–361;1–364;1–394;1–427;1–315;1–369;1–364;1–525;1–306;1–457 |
| 10348 | 1–115;1–370;1–361;1–364;1–394;1–427;1–315;1–369;1–525;1–364;1–306;1–457;1–557 |
| 10363 | 1–341;1–401 |
| 10377 | 1–323;1–327;1–103;1–315 |
| 10378 | 1–392;1–444 |
| 10408 | 1–424;1–536;1–525 |
| 10413 | 1–457;1–505;1–474 |
| 10421 | 1–255;1–425 |
| 10427 | 1–198;1–171 |
| 10438 | 1–438;1–476;1–462;1–500;1–419;1–468 |
| 10444 | 1–238;1463 |
| 10445 | 1–470;1–417;1–470;1–474;1–471 |
| 10453 | 1–75;1–75;1–75;1–75;1–77 |
| 10523 | 1–251;51–530;51–534 |
| 10531 | 1–251;41–300 |
| 10538 | 1–491;74–581;74–514;74–561;75–530 |
| 10597 | 1–445;1–362 |
| 10652 | 1–249;1–404;1–445;1–384 |
| 10661 | 1–419;1–423;1–283;1–407;1–413;1–395;1–412;1–414;1–428;1–420;1–207;1–420;1–415 |
| 10679 | 1–351;1–351 |
| 10700 | 1–468;1–470;1–454 |
| 10709 | 1–120;1–418;1–417 |
| 10734 | 1–472;1–230;1–436 |
| 10798 | 1–375;1–415;1–417;1–362;1–406;1–398;1–416;1–401;1–414;1–414;1–416;1–415;1–167;1–414;1–416 |
| 10834 | 1–55;4–440;4–69;4–165;4–75 |
| 10835 | 1–384;1–418 |
| 10845 | 1–471;1–407;1–407 |
| 10903 | 1–476;1–469;1–262 |
| 10963 | 1–448;157–597 |
| 10976 | 1–338;1–520;1–444;1–284;1–472;1–375;1–512;1–510;1–388 |
| 11004 | 1–486;1–502;1–446;1–359;1–493;1–484;1–436;1–410;1–329;1–441;1–413;1–418;1–544 |
| 11011 | 1–350;1–458;1–312;1–453;1–457;1–371;1–341 |
| 11036 | 1–501;1–482;1–462;1–479 |
| 11056 | 1–347;1–340;1–343;1–343 |
| 11067 | 1–493;1–491;1–511;1–476;1–269;1–501;1–512;2–463;16–463;29–127;29–475;29–463;29–508;29–361;29–515;29–515;29–509;29–476;29–476;29–432;29–476;30–412;30–492;30–509;30–463;30–480;30–481;30–185;30–460;30–511;30–474;30–476;30–322;30–498;30–420;30–529;30–453;30–501;30–322;30–246;30–506;30–501;30–412;30–511;30–509;30–405;30–527;30–510;30–500;30–529;31–507;31– |

TABLE II-continued (Tiling path)

| Seq Id No. | Positions of biological 5'ESTs |
|---|---|
| | 248;31–487;31–510;31–494;31–374;31–308;31–415;31–503;31–358;31–410;31–522;31–496;31–510;31–503;31–412;31–494;31–490;31–509;31–498;31–514;31–501;31–504;31–508;31–493;31–474;31–405;31–213;31–502;31–503;31–412;31–382;31–509;31–206;31–507;31–510;31–300;31–512;31–496;31–510;31–127;31–501;31–457;31–463;31–500;31–435;31–528;31–454;31–404;31–267;31–496;31–474;31–512;31–270;31–480;31–449;31–499;31–460;31–389;31–477;31–433;31–499;31–512;31–499;31–90;31–185;31–515;31–530;32–510;32–488;32–319;32–484;32–489;32–427;32–463;32–322;32–506;32–499;32–501;32–474;32–308;32–457;32–531;32–390;32–496;32–158;32–508;32–335;32–512;32–126;32–322;32–420;32–476;32–335;32–495;32–430;32–382;32–4 |
| 11076 | 1–436;42–448 |
| 11090 | 1–275;12–103 |
| 11135 | 1–469;13–459 |
| 11144 | 1–383;1–540 |
| 11158 | 1–279;1–405;1–561;1–379;1–566;1–486;1–384;1–482;1–470;1–413 |
| 11172 | 1–529;1–252;1–529 |
| 11179 | 1–522;1–434;1–498;1–434;1–495 |
| 11189 | 1–488;1–408 |
| 11207 | 1–108;1–106;1–108;1–106;1–108 |
| 11214 | 1–367;1–381 |
| 11279 | 1–469;2–386;2–387 |
| 11310 | 1–444;1–485;1–487;1–438;1–489 |
| 11321 | 1–380;1–450 |
| 11341 | 1–162;1–162;1–162;1–162;1–162;1–162;1–162 |
| 11350 | 1–410;1–272 |
| 11360 | 1–293;1–464 |
| 11366 | 1–459;1–505 |
| 11378 | 1–295;2–76;2–184;2–188 |
| 11387 | 1–415;1–184;2–268;2–276;2–480;2–270;2–377;2–309;2–284;2–76;2–309;2–188;2–276;2–493;2–406;3–428 |
| 11449 | 1–485;1–217 |
| 11457 | 1–233;1–292;1–374 |
| 11465 | 1–231;1–289;3–349 |
| 11473 | 1–293;1–311 |
| 11484 | 1–127;1–267;1–453;1–476 |
| 11499 | 1–477;1–478;1–482;1–504 |
| 11509 | 1–212;1–201;1–212 |
| 11527 | 1–490;76–572;166–589;166–597 |
| 11537 | 1–314;1–371 |
| 11565 | 1–387;1–277;2–236 |
| 11584 | 1–367;1–451;117–460 |
| 11595 | 1–245;1–236;1–245 |
| 11606 | 1–250;1–96 |
| 11696 | 1–337;1–430;1–415;1–403;1–418;5–393 |
| 11707 | 1–93;1–338;1–397 |
| 11717 | 1–128;1–439 |
| 11737 | 1–503;1–525;1–132;1–508;2–308 |
| 11747 | 1–474;1–451;1–501;1–483;1–497;1–477;1–454;1–493;1–562;1–315;1–368;1–460;1–565;1–183;1–482;1–522;1–562;1–565;1–344;1–565;1–446;1–319;1–562;1–467 |
| 11757 | 1–462;1–429 |
| 11768 | 1–448;1–314;1–396 |
| 11779 | 1–189;1–205;1–207;1–100;1–205 |
| 11790 | 1–393;1–279;1–335;1–430;1–479 |
| 11801 | 1–206;1–294;1–196;1–223 |
| 11811 | 1–233;1–235 |
| 11822 | 1–460;2–400;2–460;2–460;2–456;2–460;2–460;2–110;2–348;2–110;2–460;2–456;2–445;2–400;2–460 |
| 11833 | 1–492;1–415;1–492;1–334;1–363 |
| 11854 | 1–96;1–373;7–373 |
| 11884 | 1–423;1–547 |
| 11895 | 1–406;1–402;1–270;1–346;1–386;1–483;1–340;1–401;1–350;1–392;1–464;1–395;1–406 |
| 11927 | 1–489;1–509 |
| 11977 | 1–243;1–437 |
| 12071 | 1–441;1–452 |
| 12072 | 1–412;1–206 |
| 12082 | 1–490;1–365 |
| 12091 | 1–488;1–433 |
| 12112 | 1–478;1–358 |
| 12123 | 1–376;1–72 |
| 12134 | 1–138;4–205 |
| 12145 | 1–264;15–458 |
| 12177 | 1–479;1–450;1–520;1–479;1–465 |
| 12197 | 1–111;1–443;1–438;1–270 |
| 12208 | 1–441;1–465;1–500;1–374;1–472 |
| 12218 | 1–440;1–267 |
| 12239 | 1–446;1–485;1–468;1–410 |
| 12278 | 1–353;1–401 |
| 12317 | 1–400;1–133 |
| 12327 | 1–125;1–126;1–103;1–113;1–128;1–103;1–125;1–125;1–125;1–117;1–125;1–123;1–125;1–114;1–119;1–109;1–74;1–127;1–90;1–113;1–126;1–113;1–113;1–125;1–125;1–81;1–125;1–125;1–121;1–64;1–125;1–125;1–128;1–118;1–125;1–125;1–126;1–127;1–125;1–81;1–128;1–113;1–125;1–64;1–128;1–128;1–125;1–118;1–127;1–113;1–120;1–128;1–125;1–108;1–120;1–125;1–113;1–125;1–128;1–125;1–125;1–126;1–125;1–123;1–125;1–112;1–113;1–90;1–113;1–113;1–125;1–125;1–128;1–97;1–128;1–113;1–128;1–128;1–125;1–125;1–113;1–117;1–125;1–125;1–104;1–125;1–128;1–117;1–104;1–125;1–125;1–97;1–109;1–113;1–90;1–124;1–128;3–126 |
| 12437 | 1–505;1–505;1–431;1–462;1–435;1–434;1–492;1–479 |
| 12476 | 1–478;1–470;1–422;3–434 |
| 12485 | 1–474;1–377;1–483;1–467;1–437;1–418;1–423;1–474 |
| 12509 | 1–418;1–364;1–384;1–445;1–422 |
| 12580 | 1–444;1–406 |
| 12590 | 1–429;1–440 |
| 12605 | 1–377;1–102 |
| 12618 | 1–486;1–259;1–446;1–378;1–477;1–544;1–268 |
| 12625 | 1–438;2–404 |
| 12635 | 1–509;1–553 |
| 12636 | 1–426;30–250 |
| 12670 | 1–257;1–220;71–526 |
| 12678 | 1–397;1–184 |
| 12687 | 1–332;15–378;15–393;15–395;15–393;15–375;15–238;15–394 |
| 12719 | 1–290;1–333 |
| 12835 | 1–552;6–490 |
| 12844 | 1–500;1–497;1–429 |
| 12854 | 1–488;1–446;1–508;1–513 |
| 12879 | 1–263;1–502;117–591;117–573;117–597;129–600;129–598;129–541;129–611;129–597;200–604;200–561;241–530 |
| 12900 | 1–393;1–459;1–455 |
| 12945 | 1–199;1–199;1–199;3–482;3–64;5–208 |
| 13008 | 1–176;1–346 |
| 13056 | 1–542;1–483 |
| 13085 | 1–458;1–447 |
| 13090 | 1–266;1–266 |
| 13110 | 1–164;1–375 |
| 13117 | 1–461;1–186 |
| 13133 | 1–363;1–389;1–389;1–385;1–294;1–385 |
| 13142 | 1–395;1–395 |

TABLE II-continued

(Tiling path)

| Seq Id No. | Positions of biological 5'ESTs |
|---|---|
| 13150 | 1–471;1–459;1–630 |
| 13172 | 1–382;1–381 |
| 13180 | 1–457;258–667 |
| 13188 | 1–87;1–317 |
| 13193 | 1–66;1–66 |
| 13198 | 1–479;1–475;1–474 |
| 13207 | 1–237;1–450 |
| 13233 | 1–439;1–455 |
| 13240 | 1–406;1–414 |
| 13267 | 1–395;1–482;1–398;1–479;1–464;1–396;1–398;1–470;1–333;1–406 |
| 13277 | 1–466;2–290 |
| 13286 | 1–303;1–290 |
| 13294 | 1–433;1–402 |
| 13330 | 1–157;1–160 |
| 13336 | 1–485;1–500 |
| 13366 | 1–263;1–328;1–309;1–311;1–316;1–328;1–316;1–326 |
| 13449 | 1–182;40–167;40–175;40–177;40–177;40–178;40–176;40–174;40–167;40–166;40–179;40–179;40–177;40–174;40–168;40–179;40–132;40–175;40–168;40–168;40–177;40–132;40–183;40–174;40–167;40–174;40–167;40–181;40–174;40–182;40–183;40–176;40–177;40–103;40–183;40–168;40–168;40–175;40–162;40–175;40–174;40–179;40–108;40–154;40–175;40–168;40–178;40–166;40–154;40–164;41–179;85–182;104–177;104–182;104–171;104–163;104–170;104–173;104–177;104–166;104–172;104–176;104–171;104–156;104–182;104–182;104–163;104–182;104–182;104–183;104–182;104–183;104–169;104–223;104–180;104–174;104–269;104–174;104–182;104–182;104–175;104–183;104–183;104–182;104–182;104–166;104–173;104–154;104–174;104–167;104–182;104–161;104–174;104–180;104–182;104–177;104–182;104–226;104–183;104–182;104–171;104–177;104–192;104–255;104–180;104–174;104–182;104–181;104–183;104–182;104–167;104–173;104–173;104–162;104–174;104–171;104–182;104–166;104–182;104–173;104–182;104–182 |
| 13491 | 1–480;1–410;1–470;1–482 |
| 13520 | 1–258;1–256;1–247;1–246;1–271;1–260;1–260;1–260;1–255;1–260 |
| 13592 | 1–113;79–132 |
| 13614 | 1–165;1–151;1–154;1–164 |
| 13621 | 1–468;1–397;1–522;1–419;1–360;1–491 |
| 13627 | 1–266;1–266;1–261;1–261;1–250;1–117;1–266;1–261;1–248;1–266;1–247;1–260;1–266;1–250;1–225;1–261;1–194;1–234;1–214;1–261;1–226;1–261;1–251;1–126;1–261;1–261;1–249;1–231;1–250;1–261;1–223;1–194;1–266;1–231;1–261;1–266;1–251;1–266;1–266;1–266;1–261;1–261;1–218;1–252;1–194;1–235;1–261;1–250 |
| 13653 | 1–475;1–450;1–472;1–471 |
| 13675 | 1–402;2–451;2–479;2–451;2–301;34–87 |
| 13690 | 1–492;1–492;1–368;1–510;1–386;1–496;1–418;1–346;1–248 |
| 13712 | 1–358;11–254;13–158;13–158;13–158;13–158;13–97;13–154 |
| 13722 | 1–452;7–383;7–468;7–468 |
| 13731 | 1–357;1–336;1–370 |
| 13735 | 1–263;1–224 |
| 13767 | 1–415;1–386;1–380;1–355;1–470;1–471;1–358;1–369;1–369;1–543;1–473;1–510;1–390;1–473;1–419;1–474;1–369;1–415;1–470;1–397;1–295;1–491;1–471 |
| 13774 | 1–441;1–408;1–521;1–232;1–430;1–415;1–491;1–470;1–545;1–413;1–472;1–397;1–439;1–495;1–232;1–274;1–430;1–555;1–582;1–471 |
| 13779 | 1–487;1–534 |
| 13788 | 1–465;72–546;73–530;76–391;76–391;94–554;94–532;94–503;94–575;100–570;100–588;100–525;100–510;102–605 |
| 13809 | 1–283;1–446;1–471 |
| 13835 | 1–443;1–485;1–449;1–462;1–487;1–445;1–292;1–51 |
| 13850 | 1–485;1–355;1–496;1–544 |
| 13859 | 1–398;1–458;1–466;1–256;1–468;1–458;1–306;1–281;163–667;163–667;163–554;163–597;163–531;163–574;163–554;163–587;163–652;163–590;163–654 |
| 13870 | 1–249;1–268 |
| 13879 | 1–480;1–467 |
| 13891 | 1–574;1–458 |
| 13911 | 1–600;1–544 |
| 13922 | 1–504;234–691 |
| 13931 | 1–463;36–391 |
| 13947 | 1–45&;1–194;1–441;1–53;1–341;1–398 |
| 13969 | 1–293;1–485 |
| 14022 | 1–285;1–387;1–387;1–387;1–329;1–387;1–14546 1–495;1–495;1–51;1–492;2–493;2–495;2–386;1–386;1–280;1–383;1–386;1–310 |
| 14065 | 1–460;1–477 |
| 14075 | 1–408;1–468 |
| 14088 | 1–425;1–466;1–503 |
| 14093 | 1–326;1–326;1–326 |
| 14094 | 1–501;1–514 |
| 14104 | 1–404;2–607;67–310 |
| 14134 | 1–480;2–52;2–51 553;81–605;81–519;81–504;81–607;81– |
| 14143 | 1–439;1–50;1–51 |
| 14180 | 1–296;1–294;1–301 |
| 14224 | 1–459;1–475;47–186 |
| 14232 | 1–437;48–187 |
| 14250 | 1–485;1–474;1–471;1–443;1–480;1–487;1–502;5–391 |
| 14278 | 1–459;1–480;1–474;1–486;1–522;1–480;2–462;4–504;4–490;4–486 |
| 14286 | 1–157;1–156;1–157;1–156;1–141;1–141;1–154;1–154;1–154;1–154;1–157;1–154;1–157;1–154;1–157;1–157;1–154;1–154;1–157 |
| 14295 | 1–175;43–433;43–256;43–433;43–420;43–159 |
| 14304 | 1–401;1–383;1–453;1–293;1–439;1–396 |
| 14312 | 1–409;1–364 |
| 14341 | 1–262;1–314 |
| 14367 | 1–436;1–164;1–79 |
| 14386 | 1–359;1–372 |
| 14427 | 1–360;7–415 |
| 14455 | 1–373;1–461 |
| 14465 | 1–96;1–93 |
| 14475 | 1–458;1–328;1–450 |
| 14508 | 1–339;1–278;1–342;1–338 |
| 14519 | 1–461;1–461 |
| 14529 | 1–448;1–504 |
| 14538 | 1–425;1–372;1–295 |
| 14546 | 1–495;1–495;1–51;1–492;2–493;2–495;2–478;3–491;3–474;3–432;3–529;3–219;6–269;8–623;20–376;31–544;34–495;39–544;54–572;54–576;54–550;54–562;54–600;54–495;66–562;69–118;71–560;71–491;71–478;71–269;80–601;81–495;81–495;81–594;81–512;81–594;81–562;81–617;81–408;81–619;81–507;81–562;81–432;81–583;81–616;81–573;81–509;81–553;81–605;81–519;81–504;81–607;81–603;81–616;81–363;81–506;81–215;81–515;81–576;81–479;82–561;82–603;83– |

TABLE II-continued

(Tiling path)

| Seq Id No. | Positions of biological 5'ESTs |
|---|---|
| | 637;83–562;83–530;83–576;85–619;85–576;85–597;85–622;85–600;85–495;85–576;85–621;85–544;85–466;85–489;85–492;86–334;86–619;86–606;86–569;86–193;86–590;86–584;86–626;87–504;87–544;87–618;87–562;87–576;87–479;87–612;87–604;87–631;97–619;97–544;102–619;118–479;118–643;129–636;130–495 |
| 14559 | 1–471;1–418;1445 |
| 14595 | 1–180;1–238 |
| 14604 | 1–551;1–562;1–420;1–598 |
| 14610 | 1–335;1–335 |
| 14624 | 1–381;1–472 |
| 14630 | 1–116;1–129;1–126;1–129;1–129;1–129;1–126;1–116;1–129;1–119;1–116;1–126;1–126;1–129;1–129 |
| 14654 | 1–137;1–183;1–184;1–183;1–183;1–126;1–183;1–183;1–184;1–183;1–183;1–183;1–128;1–183;1–184;1–171;1–183;1–183;1–137;1–183;1–183;1–161;1–183;1–66;1–183;1–183;1–183;1–183;1–183;1–167;1–151;1–172;1–163;1–183;1–183;1–161;1–183;1–181;1–183;1–183;1–150;1–183;1–183;1–184;1–183;1–182;1–128;1–182;1–388;1–183;1–183;1–183;1–180;1–178;1–183;1–183;1–173;1–183;1–183;1–183;1–183;1–183;1–183;1–172;1–179;1–163;1–182;1–105;1–137;1–132;1–132;1–183;1–183;1–126;1–169;1–183;1–183;1–183;1–183;1–158;1–61;1–164;1–124;1–172;1–156;1–122;1–183;1–127;1–183;1–183;2–173;2–175;2–183;2–166;2–183;2–183;2–183;2–133;2–166;2–183;2–183;2–182;2–183;2–183;22–207;22–214;22–103 |
| 14709 | 1–440;1–469;1–452;1–237;1–509 |
| 14719 | 1–274;1–271 |
| 14730 | 1–407;1–319;1–197 |
| 14746 | 1–288;1–463;1–376 |
| 14817 | 1–496;153–552;375–551;375–564;375–566;375–563 |
| 14852 | 1–413;1–423;1–404;1–410;1–411;1–415;1–420;1–414;1–422 |
| 14933 | 1–432;3–434 |
| 14956 | 1–501;1–501 |
| 14964 | 1–187;1–187;1–187;1–187;1–187 |
| 15005 | 1–241;1–245;1–245;1–218 |
| 15013 | 1–404;1–463;25–459;29–507;29–423;29–451;29–518;29–120;29–517;29–300;29–138;30–418;30–580;30–458;30–392;30–409;30–521;30–475;30–464;30–520;30–133;30–423;30–521;30–520;30–390;30–500;30–491;30–472;30–481;30–537;30–436;30–539;30–514;30–471;30–504;30–527;31–465;31–504;32–463;32–434;38–518;38–503;38–508;61–533 |
| 15032 | 1–265;49–432 |
| 15042 | 1–283;1–490;1–459;1–481;1–503 |
| 15053 | 1–271;1–456;1–539;1–439;1–548 |
| 15077 | 1–348;1–329;1–349 |
| 15088 | 1–371;1–329;1–371;1–369;1–373 |
| 15095 | 1–351;32–172 |
| 15097 | 1–506;123–452 |
| 15098 | 1–465;1–463;1–520 |
| 15101 | 1–478;32–503;32–311;32–573;32–546;32–531 |
| 15102 | 1–206;53–290 |
| 15103 | 1–362;1–405;1–379;1–405;1–337;6–489;6–428 |
| 15104 | 1–368;1–359;1–348;1–361;1–361;1–360;1–172;1–364;1–172;1–346;1–365;3–363 |
| 15105 | 1–454;12–359;12–366;12–366;12–183;12–183;12–357 |
| 15108 | 1–337;1–334;1–335;1–135 |
| 15110 | 1–360;1–481 |
| 15111 | 1–372;1–356;1–357;1–356;1–358 |
| 15113 | 1–406;1–265 |
| 15114 | 1–486;1–508;1–539;16–368;16–414;16–391;32–172;33–384 |
| 15115 | 1–408;1–408;3–63 |
| 15116 | 1–464;1–539;1–430;1–454;1–558;1–418;1–457;1–492;1–508;1–473;1–448 |
| 15118 | 1–407;15–394 |
| 15119 | 1–409;1–495 |
| 15120 | 1–473;1–478;2–58 |
| 15121 | 1–483;1–57 |
| 15122 | 1–424;1–524;1–57 |
| 15123 | 1–477;1–388;1–478 |
| 15124 | 1–358;1–375 |
| 15125 | 1–61;1–64;1–64;1–61;1–61;1–61;1–64;1–64;1–64;1–61;1–61;1–61;1–63;1–64 |
| 15126 | 1–95;1–100 |
| 15129 | 1–201;1–220;1–159;1–220;1–220;1–219;1–220;1–217;1–235;1–220;1–219;1–226;1–220;1–232;1–220;1–202;1–233;1–235;1–220;1–220;1–212;1–135;1–222;1–220;1–220;1–232;1–220;4–220;4–232;4–220;4–233;4–234;4–220;4–200;4–233;4–231;4–233;4–220;4–220;4–232;4–220;4–234;4–209;4–220;4–201;4–232;4–220;4–232;4–222;4–220;4–222;4–220;4–219;4–215;4–220;5–225;5–233;5–232 |
| 15130 | 1–421;1–417 |
| 15131 | 1–617;56–617;56–528 |
| 15132 | 1–540;1–451 |
| 15135 | 1–438;1–440 |
| 15136 | 1–472;1–397;1–396;1–468;1–402;1–405;1–493 |
| 15137 | 1–320;1–187;1–348;1–159;15–313 |
| 15138 | 1–398;1–399;14–269;14–380 |
| 15139 | 1–225;1–225;1–225;1–225;1–225;1–225;1–224;1–223;1–225;1–223;1–225 |
| 15140 | 1–63;31–535;31–528 |
| 15141 | 1–358;1–362;1–339;1–353;1–358;6–391;6–350;6–439;6–367;6–161;6–372;6–391;6–344;17–411;22–431;22–427;22–392;22–366;22–421;22–427;22–438;22–339;22–432;22–434;22–409;22–364;22–431;22–390;22–407;22–424;22–436;22–434;22–430;27–401 |
| 15143 | 1–479;1–466 |
| 15145 | 1–456;1–301 |
| 15146 | 1–266;1–462;1–462 |
| 15147 | 1–56;1–353 |
| 15148 | 1–372;1–413;1–486 |
| 15149 | 1–417;1–408;1–437;1–310 |
| 15150 | 1–324;1–468;1–570;1–298 |
| 15151 | 1–464;1–445 |
| 15153 | 1–342;1–344 |
| 15154 | 1–481;1–484;1–480 |
| 15155 | 1–530;388–795;390–896;501–733 |
| 15157 | 1–62;1–67;1–79 |
| 15158 | 1–301;1–315 |
| 15159 | 1–495;1–412 |
| 15160 | 1–455;2–495 |
| 15162 | 1–293;1–355;1–420 |
| 15164 | 1–533;1–449;1–322;1–342;1–342;1–514;1–477;2–86 |
| 15165 | 1–246;1–233;1–253;1–247;1–254 |
| 15166 | 1–406;1–414;1–474;1–484;1–407;1–475 |
| 15168 | 1–285;1–294 |
| 15170 | 1–477;1–437;1–468;1–150;1–462;1–370;1–467;1–277;1–472;1–478 |
| 15171 | 1–416;1–87 |
| 15173 | 1–468;6–475 |
| 15174 | 1–508;1–397;1–497;1–466;1–458;1–466 |
| 15175 | 1–146;1–480;1–373;1–483;1–487 |
| 15177 | 1–455;1–478 |
| 15178 | 1–312;1–278 |

TABLE II-continued (Tiling path)

| Seq Id No. | Positions of biological 5'ESTs |
|---|---|
| 15179 | 1–473;1–425 |
| 15180 | 1–463;6–73 |
| 15181 | 1–501;11–376;101–591 |
| 15182 | 1–248;2–232;2–240;2–246;2–250;2–235;2–241;2–241;2–248;2–248;2–248;2–248;2–232;2–248 |
| 15183 | 1–377;1–232 |
| 15184 | 1–439;1–454;1–448;1–452 |
| 15185 | 1–298;1–376;1–311;1–292 |
| 15186 | 1–257;1–436;1–436 |
| 15187 | 1–251;1–382 |
| 15188 | 1–494;1–361;1–361 |
| 15189 | 1–521;1–426 |
| 15190 | 1–503;1–431 |
| 15191 | 1–358;1–433 |
| 15192 | 1–494;1–482;1–567 |
| 15193 | 1–215;1–112 |
| 15194 | 1–264;1–264;1–264 |
| 15195 | 1–408;1–451 |
| 15196 | 1–351;1–362;1–297;1–355;1–343;1–366;2–355;2–355;2–245;2–354;2–356;2–355;2–95;2–362;2–357;2–368;2–367;2–355;2–362;2–342;2–352;2–123;2–295;2–62;2–363;2–354;2–355;2–355;2–355;2–362;2–355;2–360;2–366;2–355;2–356;2–57 |
| 15197 | 1–280;1–248;1–93;1–302;1–61;1–287;1–281;1–56 |
| 15198 | 1–459;1–341;1–347;1–297;2–95;2–245;2–341;2–347;2–123;2–295;2–62;2–57 |
| 15199 | 1–94;1–431;1–122;1–61;1–56 |
| 15200 | 1–442;5–444;5–392;5–366;7–454;8–365;8–444;8–437;8–452;8–418;8–413;8–449;8–452;8–451;9–458;9–430;9–421;9–373;9–404;9–250;9–440;9–450;9–440;9–433;9–374;9–433;9–436;9–364;9–445;9–439;9–421;9–435;9–455;9–439;9–437;9–458;9–448;9–447;9–458;9–453;9–442;9–430;9–436;9–442;9–415;9–440;9–459;9–444;9–432;9–430;9–410;9–440;9–309;9–338;9–417;9–430;9–441;9–419;9–101;9–444;9–439;9–456;9–453;9–435;9–407;9–412;9–439;9–360;9–452;9–399;9–424;9–254;9–422;9–460;9–441;9–440;9–442;9–453;9–453;9–456;9–457;9–454;9–435;9–421;9–351;9–433;9–457;9–434;9–409;9–440;9–364;9–385;9–437;9–417;9–441;9–385;9–434;9–406;9–452;9–433;9–452;9–452;9–351;9–435;9–364;9–421;9–321;9–451;9–438;9–436;9–452;9–437;9–383;9–437;9–437;9–437;9–430;9–129;9–449;9–442;9–418;9–453;9–455;9–433;9–446;9–417;9–430;9–287;9–453;9–68;9–441;9–316;9–292;9–449;9–421;9–437;9–440;9–403;9–443;9–437;9–450;9–430;9–439;9–442;9–420;9–358;9–443;9–430;9–446;9–442;9–319;9–440;9–421;9–453;9–399;9–456;9–440;9–429;9–291;9–431;9–451;9–439;9–424;9–391;9–435;9–442;9–416;9–442;9–453;9–385;9–293 |
| 15201 | 1–375;4–355;5–423;5–216;5–350;5–453;5–356;5–443;5–464;5–438;5–299;6–449;6– |
| 15202 | 464;6–462 5–392;5–366;5–437;8–365;8–437;8–418;8–413;9–442;9–430;9–250;9–430;9–421;9–404;9–433;9–437;9–439;9–436;9–373;9–374;9–437;9–364;9–442;9–421;9–432;9–437;9–360;9–436;9–471;9–439;9–421;9–435;9–440;9–415;9–479;9–435;9–433;9–437;9–437;9–430;9–410;9–309;9–338;9–439;9–430;9–417;9–101;9–419;9–439;9–254;9–407;9–412;9–439;9–439;9–399;9–424;9–437;9–422;9–437;9–437;9–437;9–433;9–435;9–434;9–471;9–351;9–442;9–409;9–414;9–365;9–385;9–364;9–441;9–417;9–385;9–436;9–406;9–434;9–433;9–351;9–435;9–364;9–321;9–421;9–436;9–438;9–437;9–383;9–437;9–437;9–437;9–430;9–129;9–444;9–439;9–418;9–433;9–442;9–417;9–430;9–287;9–68;9–316;9–437;9–292;9–439;9–421;9–439;9–403;9–442;9–437;9–430;9–429;9–442;9–358;9–420;9–439;9–430;9–496;9–319;9–439;9–440;9–421;9–399;9–442;9–439;9–291;9–431;9–385;9–424;9–391;9–435;9–437;9–416;9–437;9–293;9–372;9–437;9–423;9–429;9–442;9–63;10–242;13–477 |
| 15211 | 1–474;1–332;26–98 |
| 15212 | 1–509;1–454 |
| 15213 | 1–461;1–487;1–490 |
| 15214 | 1–472;1–471 |
| 15215 | 1–454;1–461 |
| 15216 | 1–406;1–318 |
| 15217 | 1–423;1–469 |
| 15218 | 1–447;1–460 |
| 15219 | 1–469;1–368;1–510;1–491;1–423;1–405;1–466;1–519 |
| 15220 | 1–378;9–456;9–507;9–506;9–326;9–487;9–544;9–507;9–442;9–469;9–539;9–71 |
| 15222 | 1–378;1–478;1–539;1–434;1–556 |
| 15223 | 1–395;1–456;1–423;1–495;1–544 |
| 15224 | 1–494;1–332 |
| 15225 | 1–484;1–413 |
| 15226 | 1–86;1–86;1–86;1–86;1–86;1–86 |
| 15227 | 1–335;1–92;1–410;23–417 |
| 15228 | 1–523;1–458 |
| 15229 | 1–487;1–505;1–453;1–413;1–507;1–472;1–498;1–511;1–311;1–416 |
| 15231 | 1–334;1–507;1–92;1–409;1–504;13–444;13–468;13–415;13–421;23–517;23–517 |
| 15232 | 1–297;1–300 |
| 15235 | 1–297;1–338 |
| 15236 | 1–292;1–306;1–306;1–311;1–298;1–311 |
| 15237 | 1–430;21–416;23–419;23–514;24–408;33–460 |
| 15238 | 1–430;21–415;23–418;23–435;23–442;24–407 |
| 15239 | 1–394;1–347 |
| 15240 | 1–464;1–475;1–137 |
| 15241 | 1–415;1–434;1–417;1–419;1–435 |
| 15242 | 1–394;1–272 |
| 15243 | 1–117;1–276;1–193;1–205;1–163;1–238 |
| 15244 | 1–256;1–256;1–256;1–256;1–256;1–256;1–256;1–256;53–560;56–390;56–544;56–396;56–581;56–538;56–494;56–527;56–406;81–347;81–356;82–256;82–561;82–534;82–534;82–256;82–542;82–167;82–506;82–578;82–261;82–462;82–254;82–256;82–534;82–256;83–449;84–415;84–601;84–534;84–534;84–593;87–530;112–579 |
| 15245 | 1–374;1–501;1–506 |
| 15247 | 1–468;1–309 |
| 15248 | 1–256;1–263;1–345 |
| 15250 | 1–108;1–109 |
| 15251 | 1–406;111–576 |
| 15253 | 1–185;1–185;1–185 |
| 15254 | 1–434;1–410 |
| 15256 | 1–501;1–458;1–396 |
| 15257 | 1–489;1–151;1–412;1–493 |
| 15258 | 1–454;1–207 |
| 15259 | 1–466;1–341 |
| 15260 | 1–199;1–173 |
| 15261 | 1–392;3–390;3–380;3–402;3–399;3–402;3–380 |
| 15262 | 1–440;1–448 |
| 15264 | 1–377;1–381 |
| 15265 | 1–453;1–530 |
| 15266 | 1–437;1–420 |

TABLE II-continued

(Tiling path)

| Seq Id No. | Positions of biological 5'ESTs |
|---|---|
| 15267 | 1–438;1–162;1–488;1–110 |
| 15273 | 1–512;1–434 |
| 15279 | 1–389;1–533 |
| 15280 | 1–459;1–455 |
| 15281 | 1–274;1–405;1–416;1–460;1–438;1–89;1–389;1–287;1–364 |
| 15282 | 1–274;1–405;1–416;1–480;1–483;1–438;1–89;1–389;1–506;1–287;1–485;1–364 |
| 15283 | 1–385;145–641 |
| 15284 | 1–295;1–279 |
| 15285 | 1–441;1–428;1–445 |
| 15288 | 1–243;42–503;83–487 |
| 15289 | 1–377;1–256 |
| 15290 | 1–505;1–506;1–464;1–533 |
| 15291 | 1–100;1–404 |
| 15292 | 1–230;1–223 |
| 15293 | 1–389;1–534 |
| 15294 | 1–140;1–140;2–142;2–140;2–142;2–132;2–142;2–140;2–142;2–140;2–142;2–142;2–142;2–142;2–140;2–140;2–142;2–142;2–142;2–140;2–140;2–142;2–142;2–142;2–140;2–140;2–142;2–140;2–142;2–140;2–142;2–140;2–142;2–140;2–142;2–142;2–142;2–142;2–142;2–132;2–140;2–142;2–142;2–142;2–142;2–142;2–140;2–142;2–140;2–140;2–142;2–140;2–142;2–140;2–140;2–140;2–140;2–142;2–140;2–140;2–140;2–140;2–140;2–140;2–140;2–142;2–140;2–142;2–142;2–140;2–142;2–142;2–142;2–140;2–142;2–142;2–140;2–142;2–142;2–142;2–140;2–142;2–132;2–140;2–142;2–142;2–142;2–142;2–142;2–140;2–140;2–142;2–140;2–140;2–142;2–142;2–140;2–140;2–142;2–142;2–140;2–142;2–142;2–140;2–142;2–142;2–140;2–142;2–142;2–140;2–142;2–142;2–140;2–89;2–142;2–132;2–142;2–142;2–140;2–142;2–140;2–142;2–142;2–142;2–140;2–140;2–142;2–140;2–140;2–140;2–142;2–142;2–142;2–140;2–140;2–142;2–142;2–140;2–140;2–142;2–142;2–140;2–140;2–142;2–142;2–140;2–140;2–142;2–142;2–140;2–140;2–140;2–142;2–140;2–142;2–140;2–140;2–140;2–142;2–142;2–140;2–142;2–142;2–140;2–142;2–142;2–142;2–140;2–142;2–142;2–142 |
| 15296 | 1–412;1–100 |
| 15297 | 1–350;1–425;1–459;1–531;13–521;13–411;13–523;28–504;28–510;28–548;28–518;31–496;31–519;31–510;31–540;31–485;31–544;31–433;31–510;31–505;31–527;31–529;31–467;31–510;31–544;31–528;31–275;31–531;31–564;31–531;31–247;31–527;31–510;31–543 |
| 15299 | 1–372;1–491;1–446 |
| 15300 | 1–416;1–387 |
| 15301 | 1–377;1–382;1–379;1–384;1–398;1–390;1–410;1–351;1–316;1–402;1–409;1–401;1–412;1–409;1–379;1–398;1–379;1–379;1–379;1–383;1–380;1–142;1–369;1–398;1–379;1–391 |
| 15303 | 1–494;1–367;1–480;1–304;1–541;93–784;93–459 |
| 15304 | 1–488;1–473 |
| 15305 | 1–276;1–445 |
| 15308 | 1–462;1–490;1–481 |
| 15309 | 1–494;1–367;1–480;1–304;1–542;93–606;93–459 |
| 15310 | 1–478;1–483;25–511 |
| 15311 | 1–464;1–497;1–436;1–474;1–496;1–220 |
| 15312 | 1–116;1–121;1–136;1–159;1–129;1–150;1–152;1–117;1–135;1–157;1–142;1–131;1–155;1–153;1–150;1–159;1–147;1–141 |
| 15315 | 1–489;1–483 |
| 15324 | 1–449;1–450;1–410 |
| 15325 | 1–432;46–416;46–98;50–573 |
| 15326 | 1–381;1–378 |
| 15327 | 1–432;1–468;1–490;1–379;1–475;1–432;1–308;1–464 |
| 15328 | 1–286;8–504 |
| 15330 | 1–398;7–434;7–385;7–408;7–545;7–489;7–502;7–517;7–276;7–490 |
| 15331 | 1–167;1–167 |
| 15334 | 1–353;1–457 |
| 15336 | 1–349;1–361;1–325 |
| 15338 | 1–488;1–429 |
| 15339 | 1–200;1–198;1–200;1–200;1–198;1–198;1–198;1–198;1–198;1–198;1–200;1–198;1–200;1–200;1–200;1–200 |
| 15340 | 1–522;1–511 |
| 15341 | 1–191;1–180;1–180;1–114;1–196;1–196;1–193;1–196;1–196;1–197;1–183;1–114;1–196;1–196;1–183;1–190;1–196;1–196;1–197;1–196;1–183;1–176;1–114;1–161;1–114;1–180;1–195;1–183;1–196;1–197;1–196;1–177;1–191;1–182;1–184;1–196;1–114;1–114;1–180;1–194;1–174;1–197;1–172;1–196;1–196 |
| 15344 | 1–357;1–319;1–428;1–295;1–263;1–378;1–254;1–256 |
| 15345 | 1–333;1–462;1–463;1–464;1–482;1–465;1–469;1–460;1–466;1–467;1–424;1–471 |
| 15346 | 1–499;3–439 |
| 15347 | 1–427;1–447;1–436;1–387 |
| 15348 | 1–101;1–395;1–98;1–395;1–301;1–389;1–392;1–395;1–392;1–389;3–395 |
| 15349 | 1–263;1–92 |
| 15354 | 1–485;1–444 |
| 15356 | 1–402;1–105;1–388;1–402;1–400;1–402;1–208;1–400;1–312;1–399;1–303;1–402;1–402;2–158;3–500;3–484;3–481 |
| 15363 | 1–418;1–130;1–417;1–433;1–423;1–402 |
| 15368 | 1–275;1–416;1–442 |
| 15369 | 1–549;1–282;1–429;1–468;1–484;1–399;1–476;1–431 |
| 15371 | 1–501;1–476 |
| 15372 | 1–446;1–460;1–320;1–489;1–495 |
| 15373 | 1–506;1–485 |
| 15374 | 1–408;1–396;1–415;1–420 |
| 15375 | 1–497;1–526 |
| 15376 | 1–496;1–448 |
| 15377 | 1–451;89–176;89–569 |
| 15378 | 1–189;21–126;22–108;22–108;50–187;50–106;51–109;52–106 |
| 15379 | 1–125;1–125;1–125;1–125;1–125;1–125;1–125 |
| 15380 | 1–506;1–437 |
| 15381 | 1–487;1–425;1–465 |
| 15383 | 1–491;1–428 |
| 15384 | 1–79;1–201 |
| 15385 | 1–79;1–465 |
| 15386 | 1–106;1–172;1–51;1–87;34–99 |
| 15390 | 1–398;1–391;1–404;1–417;1–137 |
| 15391 | 1–213;11–442;11–419 |
| 15392 | 1–122;1–122;1–122;1–93;1–128 |
| 15394 | 1–410;1–409;1–441;1–397;1–426;1–444 |
| 15397 | 1–490;1–283 |
| 15398 | 1–368;1–431 |
| 15399 | 1–486;1–411;1–447 |
| 15400 | 1–458;111–575 |
| 15401 | 1–472;1–490 |
| 15402 | 1–336;1–483 |
| 15403 | 1–466;1–486;1–411;1–412;1–435 |
| 15404 | 1–107;10–115;15–275;29–129;29–115;29–128;29–80;29–136;29–118;29–93;30–104;30–109;30–129 |
| 15405 | 1–108;8–175;8–238;8–256;8–294;8–279;10–208;10–361;10–116;11–286;13–311;14– |

TABLE II-continued

(Tiling path)

| Seq Id No. | Positions of biological 5'ESTs |
|---|---|
|  | 297;29–221;30–135;30–195;30–116;30–253;30–279;30–255;30–242;30–235;30–167;30–188;30–81;30–223;30–94;30–139;30–249;30–202;30–292;30–260;30–237;30–214;30–119;30–234;30–281;31–110;31–291;31–272;31–105;31–268;31–278;31–227;31–296;31–134;31–226;60–141;60–308;64–179;64–273 |
| 15406 | 1–106;10–114;28–133;28–114;28–127;28–79;28–134;28–117;28–92;29–148;29–103;29–108;29–132;58–134 |
| 15407 | 1–295;1–279 |
| 15408 | 1–430;83–440 |
| 15413 | 1–86;1–144;1–112;1–109 |
| 15415 | 1–362;1–360;1–140;1–345 |
| 15416 | 1–220;1–207;1–220;1–220;1–221;1–220 |
| 15417 | 1–426;1–471 |
| 15418 | 1–444;1–121;1–472;1–449;1–451;1–416 |
| 15419 | 1–528;3–436;6–540;6–372;6–321;6–387;6–504;6–475;6–389;6–445;6–540;6–539;6–540;6–445;6–445;6–431;6–540;6–372;6–540;6–540;6–445;6–540;6–539;6–506;6–179;6–321;6–179;6–380;6–536;6–444;6–279;6–392;6–539;6–372;6–459;6–437;6–308;6–394;6–426;6–445;6–540;6–593;6–457;6–127;6–349;6–540;6–524;6–388;6–462;6–371;6–165;6–91;6–540;6–154;6–415;6–189;6–459;6–493;6–540;6–389;6–382;6–372;6–474;6–493;6–540;6–179;6–525;6–540;6–258;6–504;6–544;6–189;6–462;8–129;10–372;14–436 |
| 15420 | 1–391;1–390;1–391 |
| 15421 | 1–515;1–293 |
| 15422 | 1–395;1–416 |
| 15423 | 1–479;1–412;1–426 |
| 15424 | 1–462;1–258;1–417;1–120;1–461 |
| 15425 | 1–414;1–451;1–466;1–476;1–490;1–480;1–465 |
| 15426 | 1–467;394–801;394–800 |
| 15428 | 1–495;1–439;1–491 |
| 15429 | 1–285;1–291;1–279 |
| 15430 | 1–508;1–456;1–437 |
| 15431 | 1–361;1–166 |
| 15432 | 1–145;1–125;1–314 |
| 15433 | 1–488;1–457;12–117;12–79 |
| 15435 | 1–402;1–410 |
| 15442 | 1–202;1–273;1–275;1–384 |
| 15443 | 1–98;1–85;1–200;1–84;1–200;1–109;1–66;1–172;1–200;1–97 |
| 15444 | 1–463;1–498;1–312;1–316 |
| 15445 | 1–477;1–524;1–394;3–568;3–482;3–394 |
| 15447 | 1–148;1–144;1–148;1–135;1–148;1–144;1–148;1–144;1–148;1–148;1–144;1–144;1–144;1–144;1–144;1–144 |
| 15448 | 1–504;6–186 |
| 15449 | 1–402;1–401 |
| 15450 | 1–446;1–326;1–449;1–519;1–450;1–454;1–459;1–426;1–491;1–476 |
| 15451 | 1–511;1–338 |
| 15452 | 1–377;1–129;1–181 |
| 15453 | 1–103;1–109;1–109;1–109;1–113;1–113;1–113;1–113;1–113;1–109;1–113;1–109;1–113;1–113;1–113;1–113;1–113;1–109;1–113;1–113;1–109;1–113;1–109;1–113;1–109;1–76;1–109;1–113;1–113;1–109;1–113;1–113;1–113;1–103;1–109;1–113;1–113;1–113;1–113;1–109;1–109;1–109;1–113;1–109;1–113;1–109;1–109;1–109;1–109;1–109;1–109;1–113;1–113;1–113;1–113;1–113;1–113;1–103;1–113;1–113;1–113;1–109;1–109;1–113;1–113;1–109;1–113;1–113;1–109;1–113;1–109;1–114;1–109;1–113;1–113;1–113;1–113;1–113;1–113;1–113;1–109;1–113;1–103;1–113;1–113;1–113;1–113;1–103;1–113;1–109;1–109;1–113;1–113;1–113;4–109;4–109 |
| 15454 | 1–311;48–411 |
| 15455 | 1–517;125–540 |
| 15457 | 1–417;1–457 |
| 15459 | 1–355;63–492;63–484;63–429 |
| 15460 | 1–407;1–410;43–404 |
| 15462 | 1–468;1–466 |
| 15463 | 1–375;1–415;1–569;1–552;1–391 |
| 15464 | 1–410;1–405 |
| 15466 | 2–371;2–370;2–371;38–88;38–95 |
| 15471 | 1–376;1–376 |
| 15473 | 1–447;1–461;1–452 |
| 15474 | 1–459;1–432;1–466 |
| 15475 | 1–447;1–289 |
| 15476 | 1–306;1–461;1–457;1–411;1–478;1–373;2–294;2–477;2–379;2–422;2–398 |
| 15477 | 1–403;1–394;1–366 |
| 15478 | 1–453;1–345 |
| 15479 | 1–408;1–478 |
| 15480 | 1–188;1–297 |
| 15481 | 1–340;3–267 |
| 15482 | 1–111;1–460;1–305;1–476 |
| 15483 | 1–455;1–506;1–479 |
| 15484 | 1–459;1–500 |
| 15485 | 1–468;1–470;1–464;1–465 |
| 15486 | 1–488;1–298;1–512 |
| 15487 | 1–307;1–444 |
| 15488 | 1–353;1–343;1–354;1–354;1–355 |
| 15489 | 1–350;1–352 |
| 15490 | 1–454;1–497;4–466;4–494;4–476;4–442;4–425;4–458;4–486;4–536;25–492;28–536;32–524;32–443;32–533;32–542;32–505;43–505;46–508;46–489;46–496;46–522;46–300;46–536;52–515;52–535;52–533;52–607;52–443;52–512;53–129;53–129;53–129;53–129;53–129;53–129;53–130;53–129;53–130;53–129;53–129;53–129;53–129;53–130;53–129;53–129;53–129;53–129;53–129;53–130;53–129;53–129;53–129;53–129;53–129;53–129;53–129;53–129;53–129;53–129;53–129;53–129;53–129;53–129;53–129;53–129;53–129;53–130;53–129;53–130;53–130;53–129;53–129;53–130;53–129;53–129;53–129;53–129;53–129;53–129;53–129;53–129;53–129;53–129;53–129;53–129;53–129;53–129;53–129;53–129;53–130;53–129;53–129;53–129;53–130;53–129;53–129;53–129;53–129;53–129;53–129;53–129;53–129;53–129;53–129;53–129;53–129;53–129;53–129;53–129;53–129;53–129;53–130;53–130;53–129;53–129;53–129;53–129;53–129;53–129;53–129;53–129;53–129;53–129;53–129;53–129;53–129;53–129;53–129;53–130;53–129;53–129;53–129;53–130;53–129;53–129;53–12 |
| 15491 | 50–547;50–533;50–531;50–530;50–524;50–525;50–549;57–547;57–553;57–547;57–524;57–553;57–545 |
| 15492 | 1–464;1–248;1–464;1–465;1–454 |
| 15493 | 1–497;1–478 |
| 15494 | 1–471;1–445;1–488;1–476;1–464;1–382;1–483;1–484 |
| 15498 | 1–457;1–489 |
| 15499 | 1–477;1–461 |
| 15500 | 1–422;1–436 |
| 15501 | 1–331;1–432 |
| 15502 | 1–367;1–354 |
| 15503 | 1–372;4–516;7–453 |

TABLE II-continued (Tiling path)

| Seq Id No. | Positions of biological 5'ESTs |
|---|---|
| 15512 | 1–416;1–416;1–416;1–414;1–416;1–416;1–416;1–416;1–414;1–416;1–416;1–416;1–414;1–370;1–416;1–76;1–414;1–414;1–416;1–414;1–416;1–416;1–414;1–414;1–376;1–416;1–416;1–400 |
| 15513 | 1–444;4–114;6–74;8–136;24–159 |
| 15515 | 1–454;1–450;1–465;1–371;1–479 |
| 15516 | 1–343;1–240 |
| 15517 | 1–176;1–180;1–176;1–155 |
| 15518 | 1–198;1–165;1–198;1–185;1–185 |
| 15519 | 1–93;1–300;1–457;1–423 |
| 15520 | 17–442;17–408;17–451;17–447;17–374;17–444;17–445;17–446;17–459;17–462;17–432;17–449;17–368;17–460;17–460;17–447;17–446;17–444;17–442;17–439;17–459;17–448;17–435;17–143;17–422;17–461;17–443;17–434;17–451;17–451;17–395;17–447;17–422;17–277;17–396;17–450;17–442;17–418;17–422;17–405;17–448;17–354;17–439;17–456;17–447;17–440;17–443;17–407;17–427;17–447;17–460;17–416;17–352;17–439;17–442;17–422;17–344;17–427;17–451;17–441;17–374;17–361;17–442;17–199;17–375;17–449;17–366;17–447;17–454;17–420;17–450;17–422;17–447;17–362;17–325;17–447;17–462;17–378;17–426;17–442;17–429;17–420;17–459;17–430;17–213;17–427;17–427;17–438;17–445;17–442;17–454;17–444;17–439;17–447;17–451;17–136;17–446;17–427;17–402;17–452;17–448;20–460;22–460;22–238;22–114;22–441;22–460;23–407;26–431;40–441;40–454;40–438;40–457;40–442;43–443;43–461;43–455;43–447;43–455;43–460;43–443;43–269;43–441;43–439;43–251;43–459;43–427;43–438;43–459;43–447;43–447;43–451;43–427;43–460;43–453;43–381;43–459;46–460;46–460;46–452;46–457;46–449;46–441;46–441;46–421;49–432;51 |
| 15523 | 1–432;1–432;1–495;1–483;1–412;1–437;1–497;1–458;1–453;1–493;1–481 |
| 15524 | 1–428;7–510;7–269 |
| 15525 | 1–542;32–459;38–300 |
| 15529 | 1–445;1–447 |
| 15531 | 1–290;1–288;1–104 |
| 15532 | 1–399;1–467;1–478;1–507;1–358;1–471;1–477 |
| 15534 | 1–463;1–446 |
| 15536 | 1–585;1–279 |
| 15537 | 1–432;1–92;1–515 |
| 15539 | 1–399;1–424 |
| 15540 | 1–499;1–489 |
| 15541 | 1–72;11–71 |
| 15542 | 1–182;1–182;1–184;1–182;1–185;1–185;1–182;1–182;1–182;1–172;1–182;1–185;1–182;1–172;1–184;1–182;1–182;1–184;1–162;1–182;1–169;1–182;1–188;1–182;1–182;1–170;1–188;1–182;1–182;1–182;1–182;1–172;1–168;1–182;1–182;1–185;1–188;1–188;1–182;1–182;1–177;1–182;1–182;1–162;1–185;1–182;1–182;1–183;1–182;1–182;1–182;1–182;1–182;1–188;1–185;1–183;1–171;1–188;1–150;1–182;1–182;1–182;1–169;1–172;1–182;1–182;1–182;1–188;1–188;1–183;1–182;1–185;1–182;1–182;1–185;1–159;1–183;1–182;1–185;1–188;1–182;1–182;1–182;1–182;1–183;1–185;1–188;1–185;1–72;1–183;1–183;1–182;1–182;1–182;1–147;1–182;1–145;1–182;1–182;1–182;1–182;1–172;1–182;1–182;1–182;1–182;1–182;1–183;1–182;1–188;1–182;1–182;1–150;1–183;1–188;1–182;1–80;1–188;1–185;1–182;1–182;1–183;1–183;1–172;1–174;1–182;1–163;1–171;1–182;1–182;1–182;1–183;1–128;1–188;1–182;1–183;1–182;1–171;1–182;1–182;1–183;1–182;1–183;1–183;1–182;1–181;1–162;1–182;1–182;1–183;1–172;1–177;1–188;1–151;1–171;1–183;1–183;1–185;1–182;1–182;1–182;1–182;1–184;1–182;1–182;1–182;1–182;1–182;1–182;1–182; |
| 15544 | 1–476;1–485;1–496;1–460;1–499;1–496 |
| 15545 | 1–442;1–476 |
| 15546 | 1–338;1–358 |
| 15547 | 1–501;1–183 |
| 15548 | 1–232;1–370;1–456;1–487;1–487;1–454;1–490 |
| 15550 | 1–477;1–508;1–472;1–477;1–372 |
| 15552 | 1–350;1–414;1–456;1–128 |
| 15553 | 1–158;1–157;1–157;1–162;1–157;1–157;1–157;1–157;1–161;1–161;1–161;1–157;1–157;1–157;1–157;1–157;1–157;1–157;1–157;1–157;1–157;1–157;1–157;1–157;1–157;1–157;1–158;1–162;1–157;1–157;1–157;1–161;1–161;1–161;1–157;1–157;1–157;1–157;1–157;1–157;1–157;1–157;1–157;1–157;1–157;1–157;1–157;1–94 |
| 15554 | 1–226;1–241;1–242 |
| 15555 | 1–404;1–359;1–399;1–406;2–396 |
| 15556 | 1–226;1–387;1–418;1–372 |
| 15557 | 1–499;1–508;1–119;1–509;1–477;1–447;1–508;1–345;1–525;1–491;1–525;1–441;1–494;1–583;1–84;1–476;1–485;1–494;1–507;1–503;1–503;1–115;1–524;1–483;1–299;1–432 |
| 15558 | 1–83;1–254;1–103;1–254;1–254;1–101;1–104;1–254;1–252;1–254;1–103;1–254;1–254;1–254;1–254;1–252;1–166;1–255;1–103;1–254;1–254;1–254;1–254;2–276 |
| 15560 | 1–501;1–205;1–427;1–467 |
| 15561 | 1–188;1–420 |
| 15562 | 1–310;1–291;1–281;1–387;1–287;1–300;1–279;1–284;1–249;1–80;1–357;1–313 |
| 15563 | 1–467;1–476 |
| 15564 | 1–294;1–399;1–408;1–403;1–404;1–408;1–398;1–399;1–391;1–395;1–385;1–402;1–298 |
| 15565 | 1406;1–121 |
| 15566 | 1–92;1–96;1–92;1–79;1–79;1–88;1–94 |
| 15567 | 1–460;1–428;1–460;1–451;1–476;1–424;1–444 |
| 15568 | 1–205;1–205;7–216;7–216;7–216;7–200;7–210;7–205;7–206;7–205;7–205;7–206;7–205;7–192;7–205;7–210;7–216;7–95;7–205;7–106;7–216;7–205;11–207;11–205;11–205;11–216;15–153;15–117;15–205;15–204;15–162;15–206;15–204;15–206;15–167;15–204;15–176;22–217;44–191;54–171;54–195 |
| 15569 | 1–407;3–395 |
| 15570 | 1–455;1–524;1–350 |
| 15571 | 1–420;1–396 |
| 15572 | 1–541;1–577 |
| 15573 | 1–440;4–438;7–424;8–441;8–437;8–415;8–437;8–327;8–349;8–437;8–411;8–434;8–423;8–437;8–443;8–434;8–390;8437;11–439;11–434;11–441;11–441;11–441;11–441;11–438;11–369;11–390;11–430;11–534;11–400;11–441;11–441;11–441;11–459;11–438;11–435;11–320;11–339;11–440;11–490;11–441;11–422;11–363;11–415;11–417;11–437;11–417;11–436;11–441;11–208;11–356;11–438;11–272;11–370;11–437;11–441;11–391;11–441;11– |

TABLE II-continued

(Tiling path)

| Seq Id No. | Positions of biological 5'ESTs |
|---|---|
|  | 131;11–413;11–441;11–441;11–441;11–373;11–441;11–441;11–421;11–441;11–422;11–422;11–441;11–397;11–422;11–437;11–433;11–441;11–425;11–417;11–347;11–434;11–422;11–417;11–361;11–194;12–434;12–417;12–369;12–437;12–357;12–437;12–403;12–402;12–427;12–437;12–437;12–437;12–439;12–138;12–429;17–109;17–233;17–436;18–402;21–426;35–433;35–436;35–437;38–422;38–264;38–438;38–441;38–441;38–492;38–438;38–436;38–422;38–434;38–441;38–376;38–433;38–441;38–246;41–509;41–416;41–436;41–436;44–427;46–423;46–442;46–439;46–437;46–437;46–438;46–358;46–439;46–437;46–442;46–422;47–97;47–401;47–173;47–134;47–147;47–104;47–441;48–133;52–365;52–435;52–436; |
| 15574 | 1–484;1–415;1–474 |
| 15575 | 1–433;1–427 |
| 15576 | 1–465;1–333 |
| 15577 | 1–504;1–453;1–444;1–470 |
| 15578 | 1–821;1–358;1–358;1–440 |
| 15580 | 1–488;1–433 |
| 15581 | 1–172;35–389 |
| 15582 | 1–389;1–388 |
| 15583 | 1–519;1–486 |
| 15584 | 1–331;1–153 |
| 15586 | 1–371;1–498;1–486;1–448;1–471;1–489;1–488;1–521;1–561;1–443;1–275;1–475;1–488 |
| 15588 | 1–311;1–289;1–297;1–270;1–294;1–309;1–297;1–298;1–308;1–290;1–302;1–296;1–293;1–309;1–128;1–309;1–309;1–296;1–309;1–311;5–311 |
| 15590 | 1–513;1–462 |
| 15591 | 1–417;1–569;1–360 |
| 15592 | 1–358;1–368;1–359 |
| 15593 | 1–346;1–393;5–99 |
| 15594 | 1–469;1–329;1–484;1–453;1–493;1–484;1–485;1–430;1–400;1–429;1–442;1–469;1–397;1–388;1–446;1–454;1–360;1–370;1–313;1–397;1–429;1–361;1–370;1–453;1–246;1–429;1–465;1–446;1–442 |
| 15595 | 1–436;1–291 |
| 15596 | 1–385;1–286;1–443;1–419;2–408 |
| 15597 | 1–502;1–504 |
| 15598 | 1–388;11–410 |
| 15600 | 1–446;1–402;1–442;1–374;1–438 |
| 15603 | 1–493;1–491;1–449;1–368;1–490;1–473;1–544;1–500;1–476;1–325;1–498;1–453;1–510;1–506 |
| 15604 | 1–473;1–470;1–489 |
| 15605 | 1–419;1–409;1–414;1–422;1–413;1–421;1–390;1–419;1–405;1–404;1–409;1–412;1–412;1–422 |
| 15606 | 1–470;1–487;1–462 |
| 15607 | 1–375;1–406 |
| 15608 | 1–365;1–500 |
| 15609 | 1–383;1–359 |
| 15610 | 1–473;1–463;65–600;65–530;65–454 |
| 15612 | 1–481;1–425 |
| 15613 | 1–220;1–220;1–220;1–216;1–220;1–216;1–216;1–216;1–216;1–216;1–220;1–220;1–220;1–220;1–216;1–220;1–220;1–220;1–220;1–220;1–216;1–220;1–220;1–216;1–216;1–216;1–216;1–216;1–216;1–216;1–220;1–220;1–220;1–216;1–220;1–220;1–220;1–216 |
| 15614 | 1–342;5–61;5–202;18–138;18–202;19–145;24–116;54–154;54–382;54–141;54–485;54–111;54–350;54–228;54–227;54–104;54–382;54–463;54–181;55–140 |
| 15615 | 1–77;1–409;2–450 |
| 15617 | 1–371;1–372 |
| 15618 | 1–456;1–456 |
| 15619 | 1–516;1–448;1–597 |
| 15621 | 1–376;1–462 |
| 15622 | 1–566;1–565 |
| 15623 | 1–453;6–447;15–494;15–459;15–423;17–504 |
| 15627 | 1–576;1–361;1–501 |
| 15628 | 1–443;1–476 |
| 15629 | 1–381;1–380;1–304 |
| 15630 | 1–520;2–497 |
| 15631 | 1–455;1–476;1–503;1–87;1–488;1–457 |
| 15632 | 1–50;1–63 |
| 15633 | 1–368;1–396;1–396 |
| 15634 | 1–403;1–393 |
| 15635 | 1–349;1–507 |
| 15636 | 1–507;1–446;1–508 |
| 15637 | 1–304;1–372 |
| 15638 | 1–444;1–462 |
| 15639 | 1–490;1–497;1–489;1–492;2–486;8–497 |
| 15640 | 1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–150;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–220;1–224;1–220;1–220;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224;1–224 |
| 15641 | 1–510;1456 |
| 15642 | 1–280;1–324 |
| 15643 | 1–366;1–404;1–406;1–381;1–57;1–400;1–405;1–418;1–373;1–374;1–69;1–400;1–406;1–417;1–378;1–133 |
| 15646 | 1–298;1–316 |
| 15647 | 1–525;1–475 |
| 15649 | 1–466;1–404 |
| 15650 | 1–463;76–526 |
| 15651 | 1–402;1–368;1–387;1–232;1–415;1–229;1–409;1–402;1–408;1–414;1–422;1–318;1–399;1–204;1–405;1–229;1–295;1–387;1–413;1–312;1–400;1421;1400;1409;1–94;1–409;1–287;1–280;1–392;1–398;1–326;1–378;1–391;39425 |
| 15657 | 1–419;12–435;12–459;12–396;12–382;12–458;12–447;12–381;12–460;12–431;12–433;12–467;12–460;12–445;12–368 |
| 15658 | 1–58;1–248;2–199;3–254;9–332;9–396;12–354;15–397;15–352;15–396;15–213;15–135;15–277;15–344;15–199;15–325;16–142;21–113;21–238;42–269;42–379;42–251;51–108;51–101;51–138;51–178;51–151;52–137;58–315;79–292 |
| 15659 | 1–498;196–694;196–665;196–662;196–681;196–651;196–601;196–633;196–697;196–695;196–634;196–695;196–694;196–662;196–658;196–694;196–661;196–672;196–682;196–690;196–681;196–549;196–667;196–694;196–661;196–648;196–646;196–568;196–692;196–380;196–627;198–491 |
| 15661 | 1–308;1–302 |
| 15662 | 1–207;1–100;1–206;1–207 |
| 15663 | 1–100;1–206;1–207;1–207 |
| 15665 | 1–482;9–160 |
| 15666 | 1–491;7–296 |
| 15670 | 1–220;1–99;1–463 |
| 15673 | 1–560;1–181 |
| 15674 | 1–493;1–458;1–437 |

TABLE II-continued (Tiling path)

| Seq Id No. | Positions of biological 5'ESTs |
|---|---|
| 15675 | 1–494;1–505;1–408 |
| 15676 | 1–227;1–144;1–295;1–435;13–537;15–366 |
| 15677 | 1–157;1–163;1–87;1–144;1–152;2–65 |
| 15678 | 1–183;1–184;1–178;1–165;1–175;1–152;1–164;1–402;1–183;1–144;1–181;1–160;1–184;1–182;1–182;1–87;1–184;1–184;1–179;1–196;2–65;2–167;2–183;3–185 |
| 15679 | 1–399;1–461;1–365;1–470 |
| 15680 | 1–532;1–451 |
| 15681 | 1–446;1–471 |
| 15682 | 1–117;1–106;1–122;1–121 |
| 15683 | 1–466;1–489 |
| 15684 | 1–475;1–446 |
| 15685 | 1–532;1–436;1–532;1–517;1–513;1–351;1–532;1–453;1–493;1–405;1–450;1–516;1–492;1–513;1–428;1–466;1–450;1–410;1–516;1–334;1–382;1–469;1–241 |
| 15687 | 1–422;3–428;10–400 |
| 15688 | 1–148;1–418;1–438 |
| 15690 | 1–438;34–368;34–389 |
| 15691 | 1–497;1–479;1–464;1–480 |
| 15693 | 1–499;1–451;1–587 |
| 15694 | 1–201;1–120;1–201 |
| 15697 | 1–457;1–466 |
| 15698 | 1–276;1–276;1–276;1–284 |
| 15702 | 1–502;1–482 |
| 15703 | 1–482;1–477 |
| 15704 | 1–432;1–391;1–101;1–423;1–162;1–470;1–503 |
| 15705 | 1–379;1–439;13–503;13–498;13–451;13–445;13–481;13–490;13–481;13–173 |
| 15709 | 1–283;1–272 |
| 15710 | 1–328;1–278;1–72;1–80 |
| 15711 | 1–440;4–438;7–424;8–454;8–445;8–327;8–349;8–437;8–454;8–434;8–447;8–441;8–434;8–411;8–437;8–415;8–442;8–457;8–437;8–390;8–423;8–437;11–442;11–441;11–455;11–430;11–439;11–369;11–434;11–443;11–446;11–390;11–439;11–444;11–457;11–454;11–441;11–440;11–363;11–445;11–347;11–400;11–443;11–361;11–422;11–417;11–438;11–435;11–456;11–131;11–438;11–442;11–422;11–442;11–446;11–391;11–373;11–413;11–442;11–437;11–397;11–417;11–437;11–415;11–446;11–436;11–442;11–356;11–449;11–272;11–370–11–444;11–441;11–421;11–208;11–454;11–422;11–417;11–445;11–447;11–194;11–425;11–446;11–339;11–422;11–443;11–434;11–442;11–449;11–422;11–320;11–440;11–433;11–417;12–369;12–439;12–455;12–427;12–429;12–437;12–434;12–446;12–138;12–442;12–455;12–403;12–442;12–442;12–402;12–357;12–451;12–454;12–437;12–417;15–455;17–233;17–455;17–109;17–436;17–455;18–402;21–426;35–437;35–449;35–452;35–436;35–433;38–246;38–456;38–438;38–264;38–422;38–450;38–454;38–422;38–442;38–448;38–454;38–442;38–376;38–436;38–442;38–454;38–455;38–438;38–455;38–450;38–433;38–434;38– |
| 15712 | 1–420;1–338;1–412;1–497 |
| 15714 | 1–425;1–489;1–472 |
| 15715 | 1–423;3–456;4–316;4–357;4–309 |
| 15717 | 1–409;22–149;22–123 |
| 15718 | 1–496;1–441;1–551 |
| 15719 | 1–493;1–471 |
| 15721 | 1–364;1–126;1–420;1–383;1–324;1–389;1–405;1–375;1–404 |
| 15722 | 1–78;27–410;27–193;29–98 |
| 15726 | 1–336;1–304;1–340 |
| 15727 | 1–448;1–288 |
| 15728 | 1–133;1–184 |
| 15730 | 1–361;8–276;8–338;8–339;11–408 |
| 15731 | 1–352;1–409;1–423;1–357 |
| 15733 | 1–102;1–396 |
| 15734 | 1–476;1–457 |
| 15735 | 21–222;25–397 |
| 15736 | 1–361;1–404;1–505 |
| 15738 | 1–245;6–494;6–457 |
| 15739 | 1–423;1–414 |
| 15740 | 1–242;28–253 |
| 15742 | 1–323;1–323 |
| 15743 | 1–338;1–370;1–345;1–349 |
| 15745 | 1–100;1–274;8–503 |
| 15746 | 1–459;1–338;1–427;1–429;1–450;1–113;1–427;1–395;1–399;1–380;1–453 |
| 15747 | 1–96;1–78;1–80;1–96;1–96;1–96;1–96;1–97;1–96;1–97;1–95;1–96;1–97;1–96;1–96;1–97;1–84;1–97;1–96;1–97;1–72;1–97;1–96;1–96;1–80;1–96;1–84;1–96;1–96;1–97;1–96;1–96;1–97;1–97;1–80;1–96;1–97;1–96;1–95;2–113;2–129;2–128;2–129;2–129;2–129;2–125;2–126;2–129;2–134;2–129;2–129;2–129;2–115;2–129;2–129;2–113;2–129;2–71;2–129;2–129;2–116;2–129;2–129;2–129;2–129;2–129;2–134;2–126;2–104;2–129;2–123;2–129;2–104;2–126;2–129;2–115;2–129;2–129;2–120;2–129;2–128;2–115;2–95;2–129;2–73;2–129;2–129;2–126;2–129;2–134;2–129;2–129;2–126;2–128;2–129;2–129;2–129;2–134;2–134;2–129;2–129;2–104;2–129;2–129;2–129;2–134;2–134;2–105;2–129;2–129;2–129;2–134;2–115;2–125;2–129;2–134;2–103;2–129;2–134;2–105;2–129;2–129;2–134;2–125;2–129;2–129;2–129;2–115;2–129;2–128;2–129;2–129;2–129;2–129;2–124;2–117;2–129;2–129;2–125;2–134;2–134;2–134;2–113;2–105;2–122;2–126;2–129;2–129;2–125;2–129;2–129;2–107;2–129;2–121;2–126;2–129;2–126;2–134;2–134;2–134;2–134;2–129;2–129;2–125;2–129;2–129;2–129;2–129;2–129;2–125;2–129;2–129;2–129;2–129;2–126;2–126;2–129;2–12 |
| 15748 | 1–516;1–503;2–479;4–480;4–459;4–483;4–459;4–459;4–459;4–454;4–268;4–61;5–407;5–478;5–459;5–459;5–274;5–457;5–408;5–483;5–459;5–481;5–457;5–457;5–479;5–480;5–457;5–480;5–392;5–457;5–459;5–480;6–501;11–358;11–459;11–425;11–479;11–479;12–483;13–485;14–445;14–382;14–479;14–479;14–459;14–480;14–455;17–478;17–457;17–459;17–390;17–483;17–532;17–298;17–405;17–479;17–501;17–483;17–483;17–425;17–480;7–408;17–477;17–483;17–479;17–483;17–459;17–483;17–481;17–483;17–459;17–469;17–479;17–483;17–483;17–483;17–469;17–483;17–577;17–480;17–404;17–479;17–457;17–483;17–392;17–374;17–483;17–482;17–392;17–217;17–457;17–480;17–483;17–483;17–425;17–459;17–459;17–371;17–346;17–453;17–483;17–455;17–459;17–483;17–457;17–231;17–146;17–483;18–442;18–148;18–479;18–469;18–391;18–404;18–479;18–479;18–479;18–457;18–479;18–481;18–468;23–478;23–257;23–117;24–441;27–467;41–479;41–478;44–290;55–481;55–459;55–459;55–468;55–481;55–392;55–479;55–163;55–479;55–484;55–480;55–483;55–484;55–148;55–479;55–190;56–148;60–483;60–477;60–478;60–483;60–400;6 |

TABLE II-continued

(Tiling path)

| Seq Id No. | Positions of biological 5'ESTs |
|---|---|
| 15791 | 1–453;1481;1–465;1–483 |
| 15802 | 1–492;1–72;1–541 |
| 15823 | 1–199;1–127 |
| 15992 | 1–165;1–183;1–85;1–180 |
| 16002 | 1–337;2–377 |
| 16003 | 1–363;1–424;1–376 |
| 16004 | 1–471;1–495;1–403;1–468;1–498 |
| 16007 | 1–269;1–236;1–272;1–272;1–272;1–272;1–270;1–272;1–250;1–250;1–64;1–272 |
| 16036 | 1–449;1–526 |
| 16047 | 1–175;1–115 |
| 16062 | 1–110;2–107 |
| 16063 | 1–447;3–247 |
| 16064 | 1–376;1–450;1–128;1–311;1–428;1–311;1–327 |
| 16065 | 1–206;1–225;1–225;1–225;1–225;1–213;1–212;1–225;1–127;1–225;1–214;1–215;1–224;1–225;1–213;1–227;1–224;1–224;1–225;1–225;1–226;1–225;1–225;1–216;1–226;1–225;1–209 |
| 16066 | 1–405;1–405;1–394 |
| 16067 | 1–516;6–442 |
| 16068 | 1–217;1–234 |
| 16069 | 1–404;4–172 |
| 16070 | 1–399;1–169 |
| 16071 | 1–479;1–482;1–480;1–308;1–471 |
| 16072 | 1–323;1–451;1–321;2–439;3–357;3–453;3–455;3–296;3–415;3–311;3–416;3–289;3–403;3–355;4–464;4–498;5–93;5–53;5–274;5–364;5–319;5–78;6–382;6–481;7–398 |
| 16073 | 1–455;13–500;18–168;18–212;18–144 |
| 16074 | 1–276;1–276;1–270 |
| 16075 | 1–458;1–470 |
| 16076 | 1–328;1–308;1–328;1–79;1–319;1–318;1–293 |
| 16078 | 1–357;1–351 |
| 16079 | 1–362;1–430 |
| 16083 | 1–215;1–215;1–215;1–215;1–213;1–215;1–213;1–137;1–213;1–215 |
| 16084 | 1–52;1–52 |
| 16085 | 1–388;6–373;18–301 |
| 16086 | 1–376;1–334 |
| 16087 | 1–499;1–489;1–436 |
| 16088 | 1–411;1–413;1–422 |
| 16089 | 1–479;1–529 |
| 16091 | 1–96;1–285;29–276;29–283;29–300;29–139;29–300;29–272;29–281;29–299;29–287;29–278;29–278;29–300;29–302;29–301;29–299;29–286;29–296;29–301;29–301;29–301;29–301;29–287;29–302;29–302;29–287;29–287;29–298;29–283;29–287;29–299;29–299;29–291;29–284;29–287;29–287;29–290;29–300;29–94;29–299;29–275;34–299 |
| 16094 | 1–333;37–492;43–538;49–572;49–372 |
| 16095 | 1–234;130–280;130–273;172–234 |
| 16098 | 1–486;1–556 |
| 16102 | 1–316;1–321;1–145 |
| 16103 | 1–70;1–384;1–470 |
| 16104 | 1–460;13–569 |
| 16105 | 1–219;1–216;1–351;1–238 |
| 16106 | 1–258;1–472;1–485;1–517 |
| 16107 | 1–462;1–466;1–230 |
| 16112 | 1–422;1–440;1–440;1–395 |
| 16113 | 1–76;1–72 |
| 16116 | 1–485;1–105;1–105;1–362 |
| 16117 | 1–459;1–470;1–438;1–105;1–105;1–455;1–528 |
| 16119 | 1–466;1–740 |
| 16121 | 1–116;1–395 |
| 16123 | 1–272;1–258 |
| 16124 | 1–512;1–441 |
| 16127 | 1–157;1–282;1–272;1–267;1–280;1–283;1–288;1–277;1–206;1–270;1–206;1–258;1–220;1–175;1–281;1–259;1–269;1–270;1–286;1–140;1–286;1–284;1–276;1–270;1–279;1–219;1–287;1–284;1–262;1–190;1–275;1–262;1–239;1–288;1–76;1–272;1–271;1–260;1–264;1–280;1–282;1–248;1–287;1–284;1–293;1–272;1–266;1–280;1–288;1–270;1–284;1–275;1–274;1–283;1–282;1–284;1–293;1–263 |
| 16146 | 1–479;1–408 |
| 16150 | 1–434;2–77 |
| 16151 | 1–350;1–309;1–350;1–350;1–249;1–350;36–337;36–347;36–342;36–353;36–353;36–127;36–353;36–351;36–353;36–350;36–352;36–315;36–350;36–353;36–115;36–314;36–353;36–353;36–346;36–353;36–315;36–315;36–351;36–352;36–353;36–352;36–353;36–350;36–140;36–352;36–333;36–297;36–340;36–343;36–315;36–316;36–305;36–350;36–351;36–336;36–327;36–346;36–204;36–350;36–328;36–353;36–350;36–351;36–353;36–341;36–338;36–350;36–353;36–352;36–350;36–353;36–350;36–353;36–315;36–317;36–351;36–353;36–140;36–351;36–352;36–353;36–349;36–351;36–349;36–330;36–140;36–315;36–344;36–321;36–350;36–317;36–345;36–353;36–353;36–349;36–211;36–353;36–353;36–349;36–276;36–353;36–349;36–353;36–353;36–350;36–351;36–138;36–353;36–350;36–350;36–315;36–350;36–308;36–334;36–347 |
| 16153 | 1–504;1–517;1–499;1–371;1–477;1–450;1–378;1–437;1–433;1–476;1–491;1–439;1–387;1–472;1–461;1–379;1–423;1–460;1–424;1–431;1–468;1–559;1–475;1–489;1–478;1–366;1–524;1–474;1–479;1–121;1–504;1–485;1–527;1–465;1–432;1–319;1–449;1–441;1–431;1–456;1–387;1–482;1–441;1–475;1–433;1–489;1–398;1–432;1–460;1–466;1–523;1–477;1–456;1–333;1–517;1–516;1–146;1–452;1–530;1–516;1–525;1–460;1–204;1–306;1–419;1–441;1–410;1–412;1–476;1–198;1–483;1–433;1–314;1–517;1–475;1–517;1–478;1–525;1–473;1–486;1–465;1–354;1–460;1–441;1–476;1–463;1–467;1–423;1–526;1–481;1–527;1–278;1–362;1–456;1–474;1–513;1–487;1–452;1–418;1–476;1–463;1–444;1–487;1–303;1–405;1–452;1–402;1–488;1–470;1–544;1–466;1–474;1–489;1–460;1–489;1–465;1–374;1–359;1–350;1–413;1–508;3–385 |
| 16154 | 1–193;1–121;1–146 |
| 16157 | 1–512;1–453 |
| 16158 | 1–435;1–476 |
| 16159 | 1–446;1–493;1–439;4–523 |
| 16160 | 1–122;1–157 |
| 16168 | 1–456;1–478;1–527;1–469;1–451;1–507;1–493;1–497 |
| 16169 | 1–420;1–489 |
| 16170 | 1–409;2–349;2–361;2–113 |
| 16171 | 1–252;19–136;19–492 |
| 16172 | 1–347;1–435;1–446;1–460;1–444;1–489 |
| 16173 | 1–369;1–479 |
| 16176 | 1–504;1–441 |
| 16178 | 1–531;1–173 |
| 16179 | 1–403;1–366;1–402 |
| 16181 | 1–396;10–387 |
| 16182 | 1–388;1–473;1–494;1–449;1–493;1–462;1–494;1–416;1–231;1–111;1–255;1–508;1–472;1–341;1–508;1–427;1–104;1–494;1–508;1–547;1–403;1–351;1–465;1–355;1–494;1–492 |
| 16183 | 1–448;1–481 |

TABLE II-continued

(Tiling path)

| Seq Id No. | Positions of biological 5'ESTs |
|---|---|
| 16184 | 1–243;1–409 |
| 16185 | 1–372;1–362;1–367;1–403;1–388;1–411;1–413;1–398;1–399;1–413;1–395;1–401;1–413;1–396;1–411;1–320;1–351;1–401;1–225;1–256;1–361;1–399;1–398;1–411;1–399;1–403;1–155;1–401;1–378;1–396;1–400;1–389;1–368;1–411;1–397;1–389;1–412;1–412;1–398;1–412;1–401;1–394;1–125;1–249 |
| 16186 | 1–431;1–418 |
| 16187 | 1–198;1–198;1–198;1–199 |
| 16191 | 1–418;1–418;1–418;1–418;1–418;1–477;1–418;1–418;1–416;1–418;1–418;1–416;1–416;1–397;1–412;1–418;1–408;1–418;1–418;1–364;1–418;4–146 |
| 16192 | 1–488;32–446;32–446;32–446;32–446;32–446;32–446;32–446;32–444;32–444;32–446;32–446;32–174;32–444;32–425;32–446;32–440;32–436;32–446;32–446;32–392;32–446 |
| 16193 | 1–211;4–146 |
| 16196 | 1–362;1–493;1–456 |
| 16207 | 1–414;2–430;2–341 |
| 16210 | 1–203;1–204;1–203 |
| 16211 | 1–388;1–393 |
| 16212 | 1–304;1–343 |
| 16213 | 1–384;1–440;1–412 |
| 16214 | 1–471;1–507 |
| 16220 | 1–250;1–536 |
| 16221 | 1–291;1–290;1–291;1–291 |
| 16222 | 1–201;1–493;1–255 |
| 16223 | 1–278;1–460;6–403 |
| 16224 | 1–421;1–585;1–518;1–537 |
| 16228 | 1–70;10–401;10–409 |
| 16229 | 1–416;1–409;1–188;48–117 |
| 16230 | 1–428;1–469;1–469;1–304;1–451;1–335;1–499;1–471;1–408;1–385;1–516 |
| 16231 | 1–448;1–459;1–459;1–458;1–483;1–327;1–272;1–472;1–419;1–92;1–327;1–402;1–377;1–218;1–92;1–377;1–402;1–478;1–386 |
| 16232 | 1–333;1–68;1–385 |
| 16235 | 1–464;1–372;1–464 |
| 16236 | 1–393;1–451;78–598;78–583;78–591;78–527 |
| 16237 | 1–246;1–248;1–246;1–249;4–112;4–108;4–111;4–100;4–108;4–102;4–108;4–108;4–107;4–61;4–108;4–108;4–90;4–111;4–111;4–100;4–108;4–108;4–74;4–90;4–114;4–107;4–108;4–108;4–108;4–106;4–108;4–108;4–99;4–84;4–91;4–108;4–91;4–108;4–92;4–108;4–108;4–91;4–107;4–101;4–108;4–108;4–108;4–100;4–73;4–88;4–108;4–84;4–90;4–85;4–108;4–11;4–91;4–107;4–110;4–107;4–83;4–78;4–107;4–108;4–108;4–108;4–111;4–93;4–111;4–108;4–108;4–111;4–99;4–107;4–83;4–108;4–108;4–90;4–108;4–102;4–108;4–111;4–108;4–111;4–107;4–91;4–107;4–108;4–111;4–108;4–108;4–107;4–108;4–85;4–69;4–107;4–108;4–108;4–111;4–107;4–108;4–100 |
| 16238 | 1–118;1–104;1–118;1–118;1–118;1–124;1–118;1–118;1–118;1–119;1–118;1–118;1–118;1–118;1–105;1–118;1–118;1–119;1–118;1–104;1–118;1–105;1–118;1–97;1–81;1–71;1–117;1–81;1–118;1–118;1–118;1–105;1–105;1–118;1–118;1–124;1–118;1–118;1–118;1–118;1–105;1–118;1–105;1–118;1–118;1–118;1–118;1–105;1–118;1–118;1–124;1–118;1–118;1–118;1–97;1–118;1–119;1–118;1–118;1–118;1–124;1–118;1–118;1–118;1–118;1–118;1–118;1–118;1–80;1–118;1–118;1–118;1–119;1–118;1–118;1–118;1–118;1–118;1–118;1–118;1–118;1–118;1–118;1–118;1–118;1–118;1–118;1–118;1–118;1–118;1–118;1–105;1–118;1–105;1–119;1–118;1–88;1–118;1–118;1–119;1–124;1–118;1–118;1–111;1–118;1–118;1–118;1–104;1–118;1–82;1–118;1–118;1–118;1–118;1–120;1–104;1–118;1–118;1–118;1–118;1–118;1–124;1–105;1–118;1–124;1–118;1–118;1–118;1–118;1–118;1–118;1–124;1–124;1–118;1–104;1–124;1–105;1–111;1–118;1–118;1–119;1–118;1–105;1–87;1–120;1–118;1–118;1–118;1–109;1–118;1–118;1–111;1–98;1–118;1–118;1–105;1–118;1–124;1–118;1–118;1–96;1–118;1–105;1–88;1–118;1–118;1–118;1–118;1–118;1–89;1–118;1–118;1–118;1–118;1–118;1–118;1–124 |
| 16241 | 1–295;1–282;1–129;1–317;1–288;1–308;1–274;1–273;1–307;1–317;1–275;1–306;1–289;1–317;1–307;1–305;1–308;1–308 |
| 16242 | 1–92;1–52;1–81;1–93;1–92;1–81;1–92;1–92;1–84;1–83;1–68;1–97;1–97;1–92 |
| 16243 | 1–497;1–382;1–483;1–498;1–487;1–474;1–400;1–497;1–497;1–401;1–497;1–349;1–464;1–489;1–478;1–484;1–397;1–501;1–501;1–502;1–497;1–489;1–496;1–473;1–363 |
| 16244 | 1–401;1–401 |
| 16245 | 1–496;1–446 |
| 16246 | 1–331;1–337;1–317;1–331 |
| 16247 | 1–237;1–239 |
| 16248 | 1–138;1–138;1–163;1–136;1–135;1–163;1–138;1–160;1–138;1–138;1–88;1–163;1–525;1–136;1–136;1–136;1–163;1–160;1–160;1–163;1–138;1–138;1–163;1–129;1–136;1–163;1–138;1–136;1–138;1–160;1–136;1–163;1–138;1–136;1–136;1–160;1–136;1–136;1–376;1–138;1–138;1–163;1–136;1–138;1–136;1–136;1–144;1–136;1–163;1–138;1–138;1–136;1–138;1–138;1–160;1–138;1–144;1–138;1–163;1–136;1–136;1–163;1–136;1–163;1–144;1–136;1–138;1–136;1–136;1–160;1–163;1–136;1–138;1–138;1–163;1–138;1–163;1–160;1–138;1–160;1–136;1–160;1–136;1–160;1–136;1–88;1–136;1–163;1–138;1–138;1–136;1–136;1–136;1–136;1–136;1–138;1–136;1–136;1–138;1–160;1–163;1–138;1–136;1–324;1–160;1–136;1–138;1–160;1–163;1–138;1–136;1–163;1–136;1–136;1–136;1–129;1–163;1–163;1–138;1–138;1–138;1–163;1–138;1–163;1–136;1–138;1–138;1–163;1–137;1–138;1–136;1–138;1–163;1–136;1–160;1–163;1–160;1–138;1–138;1–163;1–163;1–138;1–163;1–138;1–160;1–138;1–138;1–129;1–136;1–138;1–138;1–160;1–163;3–523;3–476;3–510;3–378;3–497;3–453;3–483;3–482;3–500;3–447;3–475;3–512;3–509;3–526;3509;3 631;3–498;3–483;3–500;3–496;3–525;3–499;3–498;3–525; |
| 16263 | 1–252;1–322 |
| 16264 | 1–216;1–225;1–226;1–226;1–226;1–225 |
| 16265 | 1–490;1–456 |
| 16266 | 1–207;1–353 |
| 16269 | 1–166;1–430 |
| 16270 | 1–408;1–141 |
| 16271 | 1–141;1–508;1–502 |
| 16272 | 1–471;44–519 |
| 16274 | 1–336;1–333 |
| 16275 | 1–371;81–552 |
| 16276 | 1–77;1–352;1–458;1–453;1–458 |
| 16277 | 1–411;141–412;141–406;141–371;141–333;141–412;141–412;141–401;141–412;141–412;141–412;141–412;141–412;141–412;141–412;141–391;141– |

TABLE II-continued

(Tiling path)

| Seq Id No. | Positions of biological 5'ESTs |
|---|---|
| | 412;141–412;141–412;141–412;141–401;141–412;141–389 |
| 16278 | 1–283;1–454 |
| 16282 | 1–506;1–384 |
| 16285 | 1–176;1–492 |
| 16287 | 1–394;1–512 |
| 16296 | 1–348;1–363 |
| 16297 | 1–400;1–575 |
| 16299 | 1–306;1–477;1–491;1–477 |
| 16300 | 1–474;1–474 |
| 16301 | 1–449;13–285;17–164 |
| 16302 | 1–272;1–531;1–461;1–462;1–460;1–321;1–556;1–441;1–493;1–503;1–487;1–414;1–510;1–560;1–447;1–487;1–77;1–357;1–461;1–413;1–342;1–575;1–567;1–464;1–526;1–481;1–417;1–585;1–400;1–489;1–577;1–445;1–458;1–174;1–493;1–496;1–522;1–518;1–475;1–331;1–577;1–134;1–363;1–336 |
| 16303 | 1–348;1–180 |
| 16307 | 1–491;291–495 |
| 16308 | 1–457;10–429;27–442 |
| 16309 | 1–103;1–176;2–107 |
| 16310 | 1–248;1–248 |
| 16311 | 1–454;1–535;156–655;156–652;156–640 |
| 16312 | 1–494;1–515;1–425;1–481;1–501;1–472;1–508;1–435;1–396;1–511;1–502;1–424;1–423;1–420;1–337;1–497;1–473;1–488;1–523;1–473;1–542;1–501;1–473;1–424;1–498;1–444;1–411;1–490 |
| 16315 | 1–162;1–144;1–160;1–166;1–165 |
| 16325 | 1–342;1–413 |
| 16327 | 1–535;1–269;81–568;81–393;81–538;81–587;81–577;81–562;81–574 |
| 16328 | 1–270;1–536;1–559;81–539;81–394 |
| 16329 | 1–423;1–489 |
| 16332 | 1–359;22–488;23–404;23–413;23–409;23–420;23–420;23–415;23–412;23–411;23–412;24–274;24–412;24–404;24–379;24–205;24–408;25–395;25–408;27–476;27–394;27–431;41–497;41–497;41–504;41–497;41–498;41–394;41–462;41–497;41–456;43–407;43–144;43–358;43–422;43–422;43–407;43–422;43–412;43–419;43–407;43–399;43–407;46–455;46–492;66–408;66–392;74–422 |
| 16333 | 1–140;1–146 |
| 16334 | 1–451;1–487 |
| 16335 | 1–493;1–317 |
| 16336 | 1–223;1–442;1–379;1–357;1–417 |
| 16337 | 1–484;1–513;1–423;5–227;5–362 |
| 16338 | 1–56;1–164;1–205;1–203;1–148 |
| 16346 | 1–239;1–239;1–239 |
| 16348 | 1–499;1–443 |
| 16351 | 1–257;1–85;1–269;12–84;12–183;12–141;12–99;12–269;12–98;12–85;12–160;12–271;18–151;18–151;18–98;44–159;44–159;45–272;45–299;45–299;45–159;45–292;45–295;45–159;45–304;45–300;45–282;45–159;45–299;45–304;45–156;45–292;45–156;45–293;45–137;45–293;45–159;45–136 |
| 16352 | 1–251;1–375;1–85;1–403;1–331;1–263;1–358;12–84;12–347;12–363;12–85;12–99;12–263;12–158;12–403;12–416;12–138;12–98;12–407;12–265;12–179;18–98;18–148;18–148;44–404;44–156;44–410;44–156;44–405;45–291;45–305;45–133;45–311;45–291;45–284;45–305;45–300;45–311;45–291;45–156;45–307;45–301;45–156;45–311;45–296;45–292;45–267;45–287;45–291;45–311;45–284;45–276;45–311;45–156;45–296;45–153;45–307;45–301;45–156;45–153;45–307;45– |
| | 311;45–134;45–314;45–285;45–305;45–300;45–285;45–304;45–304;45–311;45–311 |
| 16354 | 1–445;1–399;1–98;23–420;29–417;29–417;29–416;29–416;29–123;29–253;29–447 |
| 16355 | 1–433;1–436;1–399;1–436;1–98;21–435;23–424;23–423;29–421;29–253;29–418;29–433;29–423;29–416;29–427;29–416;29–123;29–435 |
| 16358 | 1–473;1–173 |
| 16359 | 1–323;1–416;1–452;1–494;1–451 |
| 16360 | 1–432;1–408;1–404 |
| 16361 | 1–281;1–281 |
| 16363 | 1–505;1–482 |
| 16364 | 1–443;1–457 |
| 16365 | 1–299;1–438 |
| 16367 | 1–483;1–519 |
| 16368 | 1–382;1–382;1–390;2–333;2–389;2–378;2–389;2–388;2–389;2–384;3–388;4–391;4–372;4–377;4–389;4–389;4–383 |
| 16369 | 1–452;2–54 |
| 16370 | 1–478;1–470;1–430 |
| 16371 | 1–406;3–399 |
| 16372 | 1–451;2–500;2–335;2–501;2–352;2–396;2–507;2–476;2–542;2–495;2–518;2–479;2–500;3–376;35–529 |
| 16374 | 1–495;1–444;1–462;1–488;1–445 |
| 16376 | 1–402;1–469;1–463;1–491;1–341;1–465;1–469 |
| 16378 | 1–247;20–302;31–309;31–109 |
| 16379 | 1–301;1–424 |
| 16380 | 1–400;1–372 |
| 16382 | 1–80;1–82;1–68;1–68;1–82;1–82;1–82;1–80;1–80;1–68;1–80;1–80;1–82;1–80 |
| 16383 | 1–497;1–431;1–487 |
| 16384 | 1–472;1–372 |
| 16385 | 1–344;1–334;1–346;1–345 |
| 16386 | 1–443;1–490;1–404;1–435 |
| 16387 | 1–391;1–359 |
| 16388 | 1–440;1–490 |
| 16389 | 1–132;1–119;1–161;1–118;1–118;1–100;1–148;1–118 |
| 16390 | 1–365;44–440 |
| 16393 | 1–360;4–56;4–403;14–404;14–379;14–402;14–386;14–386;14–393;14–404;14–385;14–393;14–383;14–386;14–390;14–397;14–381;14–393;14–390;14–389;14–406;14–389;14–390;14–390;14–383;14–405;14–390;14–395;14–393;14–386;14–380;14–175;14–398;14–393;14–405;14–404;14–390;14–393;14–402;14–405;14–377;14–406;14–390;14–395;14–403;14–404;14–390;14–390;14–389;14–400;14–383;14–402;14–390;14–401;14–259;14–405;14–403;14–394;14–349;15–394;21–96;21–96;21–96;21–96;21–96;21–96;21–96;21–96;21–96;21–96;21–96;21–96;21–96;21–96;21–96 |
| 16395 | 1–440;1–446;1–336;1–439;1–449 |
| 16396 | 1–359;3–506;3–403;13–465;48–482;48–497;48–525;48–451;48–506;49–280;49–523;49–448;49–505;49–434;49–538;49–521;52–505;52–536;66–555;80–538;80–463;80–549;80–538;80–279;80–520;80–313;80–560;80–504;80–552;80–538;86–534;86–538;86–538;86–518;86–362;86–538;87–418;87–246;87–442;88–566;88–557;88–532;88–588;88–498;88–545;88–555;88–569;88–566;89–533;89–547;89–323;89–220;90–521;92–527;92–594;104–549;104–597;104–559;111–545;111–594;111–611;111–556;111–165;111–585;111–561;113–551;113–591;118–579 |
| 16397 | 1–472;14–465 |
| 16399 | 1–508;1–478;51–433 |

TABLE II-continued (Tiling path)

| Seq Id No. | Positions of biological 5'ESTs |
|---|---|
| 16401 | 1–536;350–848 |
| 16402 | 1–257;1–257;1–257;1–231;1–257;1–257;1–257;1–257 |
| 16403 | 1–421;8–321 |
| 16404 | 1–443;1–496 |
| 16410 | 1–137;1–53;1–153;1–112;1–147;1–443;1–167;1–528;52–568 |
| 16411 | 1–510;1–480;4–500;4–512;4–464;4–503;4–496;4–485;4–480;4–498;4–496;4–496;4–470;4–495;4–460;4–494;4–496;4–480;4–495;4–407;4–484;4–526;4–483;4–495;4–494;4–485;4–485;4–460;4–452;4–496;4–456;4–449;4–494;4–526;4–495;4–495;4–494;4–480;4–460;4–481;4–482;4–485;4–485;4–504;4–470;4495;4–485;4–526;4–512;4–460;4–498;4–485;4–460;4–495;4–498;4–480;4–526;4–497;4–495;4–485;4–497;4–494;4–503;4–460;4–498;4–145;4–498;4–495;4–484;4–526;4–510;4–478;4–501;4–496;4–526;4–508;4–501;4–499;4–502;4–485;4–485;4–482;4–470;4–498;4–504;4–460;4–460;4–512;4–485;4–502;4–495;4–507;4–480;4–496;4–483;4–495;4–498;4–407;4–505;4–494;4–400;4–482;4–481;4–468;4–460;4–457;4–485;4–480;4–526;4–515;4–493;4–497;4–507;4–501;4–485;4–482;4–497;4–498;4–485;4–507;4–502;4–503;4–526;4–502;4–513;4–485;4–482;4–485;4–497;4–526;4–501;4–402;4–450;4–482;4–499;4–482;4–502;4–510;4–498;4–239;4–507;4–442;4–495;4–485;4–514;4–485;4–482;4–506;4–501;4–455;4–495;4–480;4–470;4–505;4–452;4–495;4–526;4–498;4–375;4–502;4–496;4–506;4–498;4–501;4–510;4–502;4–485;4–495;4–498;4–504;4–49 |
| 16412 | 1–138;1–54;1–371;1–372;1–326;1–372;1–223;1–349;1–154;1–317;1–305;1–113;1–300;1–148;1–273;1–170;1–349 |
| 16422 | 1–388;1–392 |
| 16423 | 1–464;1–413;1–178 |
| 16425 | 1–193;1–155 |
| 16427 | 1–397;1–504 |
| 16436 | 1–139;1–135;1–135;1–139;1–135;1–139 |
| 16439 | 1–505;1–75;1–361 |
| 16443 | 1–96;1–392;1–470;2–489 |
| 16444 | 1–367;1–492 |
| 16445 | 1–312;1–373;1–388;1–372 |
| 16446 | 1–173;1–468;1–485 |
| 16447 | 1–363;4–269 |
| 16448 | 1–482;4–489;5–478;5–380;5–458 |
| 16449 | 1–206;21–214;21–216;21–466;21–216;21–216;21–216;28–135 |
| 16451 | 1–93;1–91 |
| 16452 | 1–109;1–350;1–132;1–118;1–115;1–122;1–150;1–355;5–149 |
| 16453 | 1–109;1–118;1–115;1–175;1–122;1–151;1–172;1–133;5–150 |
| 16459 | 1–368;1–374 |
| 16460 | 1–416;1–486;1–477;33–293;33–476 |
| 16461 | 1–191;34–479;34–481;34–521;34–490;34–505;34–230 |
| 16462 | 1–495;1–349;4–59;4–296 |
| 16463 | 1–445;1–454 |
| 16466 | 1–489;1–457 |
| 16467 | 1–101;1–86 |
| 16470 | 1–392;1–364 |
| 16471 | 1–123;1–115;1–237;1–234;1–390;1–248;1–470;1–372;1–486;1–370;1–240;1–424;1–196;1–369;1–404;1–234;1–387;1–67;1–248;1–388;1–337;1–463;7–486;45–529 |
| 16473 | 1–462;1–443;1–442 |
| 16474 | 1–442;9–452 |
| 16477 | 1–138;1–160;1–113;1–103;1–111;1–128;4–70;4–159;4–157;4–161;4–146;4–118;4–115;4–159;4–110;4–113;4–159;4–158;4–127;4–114;4–114;4–114;4–157;4–158;4–108;4–114;4–135;4–160;4–150;4–160;4–136;4–118;4–135;4–160;4–150;4–160;4–158;4–162;4–109;4–158;4–158;4–146;4–101;4–104;4–113;4–158;4–135;4–128;4–114;4–158;4–106;4–87;4–159;4–158;4–116;4–114;4–158;4–113;4–103;4–158;4–158;4–157;4–136;4–138;4–131;4–158;4–140;4–135;4–161;4–108;4–158;4–109;4–161;4–115;4–140;4–160;4–142;4–140;4–159;4–118;4–161;4–137;4–151;4–145;4–124;4–160;4–135;4–118;4–157;4–118;4–158;4–117;4–161;4–70;4–158;4–128;4–109;4–157;4–158;4–104;4–125 |
| 16484 | 1–439;1–441 |
| 16488 | 1–514;1–496;1–479;13–523;31–105;31–251;31–541;31–498;31–495;31–535;31–193;37–306;37–539;37–342;37–342;37–342;37–349;38–560;38–326;61–543;61–523;66–564;66–526;66–502;66–520;66–560;113–564 |
| 16497 | 1–435;1–455;1–412;1–421;1–486;1–485;1–466;1–277;1–497;1–412;1–513;1–486;1–337;1–361;1–364;1–472;1–491;1–487;1–487;1–485;1–479;1–406;1–230;1–513;1–473;1–470;1–492;1–497;1–478;1–513;1–343;1–408 |
| 16498 | 1–418;13–513;39–492;39–501 |
| 16502 | 1–327;2–429 |
| 16503 | 1–272;1–272;1–269;1–269;108–247;108–270;108–200 |
| 16506 | 1–484;20–433 |
| 16507 | 1–555;7–466;7–555 |
| 16508 | 1–477;1–418;1–477;1–420 |
| 16511 | 1–379;1–473;1–461;1–433;1–490;1–491;1–509;1–406 |
| 16513 | 1–131;1–131 |
| 16517 | 1–403;1–105;1–403 |
| 16518 | 1–353;1–446;1–96 |
| 16519 | 1–305;1–382;1–153 |
| 16521 | 1–200;23–426;23–129 |
| 16523 | 1–187;1–193 |
| 16525 | 1–401;1–411;6–410;6–413 |
| 16526 | 1–101;1–537;4–482;40–482;137–192 |
| 16529 | 1–400;1–430;1–413;1–404;1–423;6–422;6–426 |
| 16534 | 1–121;1–125;1–159 |
| 16554 | 1–539;1–479;1–472 |
| 16560 | 1–472;1–358 |
| 16561 | 1–434;378–875;378–903 |
| 16563 | 1–438;3–121 |
| 16564 | 1–417;5–125 |
| 16565 | 1–222;1–222;46–222;46–222 |
| 16566 | 1–240;9–431 |
| 16567 | 1–112;1–112;1–112 |
| 16568 | 1–496;96–606 |
| 16571 | 1–484;1–289;1–382;1–452 |
| 16572 | 1–461;1–453 |
| 16573 | 1–222;1–166 |
| 16574 | 1–400;1–434;1–430;54–446;54–272;54–382;107–478;107–495 |
| 16576 | 1–244;1–355;1–389;1–396 |
| 16577 | 1–244;1–354;1–387;1–403 |
| 16579 | 1–501;1–508 |
| 16580 | 1–342;1–240 |
| 16582 | 1–178;1–380;1–378;1–380;3–381 |
| 16583 | 1–454;1–477;1–488;1–481 |
| 16585 | 1–447;1–432;1–443 |
| 16586 | 1–157;33–87;33–94 |
| 16589 | 1–493;1–486;1–499;1–475;1–224 |
| 16590 | 1–401;1–421 |

TABLE II-continued (Tiling path)

| Seq Id No. | Positions of biological 5'ESTs |
|---|---|
| 16591 | 1–515;1–424;1–484;1–497 |
| 16592 | 1–149;28–506 |
| 16593 | 1–119;1–187 |
| 16595 | 1–510;1–502;1–320 |
| 16596 | 1–422;1–197 |
| 16597 | 1–488;1–369;1–479;1–499;1–447;1–480;1–480;1–484;1–499;1–355;1–498;1–469;1–480;1–428;1–469;1–477;1–368;1–499;1–422;1–480;1–468;1–453;1–433;1–574;1–527;1–480;2–499 |
| 16598 | 1–336;1–328;1–331;1–355;1–355;1–355 |
| 16599 | 1–271;1–327;41–391;155–377;155–388;205–385;205–404 |
| 16600 | 1–396;1–442 |
| 16601 | 1–416;1–487 |
| 16602 | 1–275;1–257;1–202 |
| 16603 | 1–306;1–308;1–334;1–69;1–343;1–314;1–333;1–71;1–334;1–307;1–327;1–313;1–314 |
| 16604 | 1–450;1–468 |
| 16605 | 1–230;1–235;1–244;1–241;30–132 |
| 16612 | 1–440;1–402 |
| 16613 | 1–467;1–424 |
| 16614 | 1–523;4–258 |
| 16615 | 1–493;1–471;1–156;1–399;31–285 |
| 16616 | 1–434;1–423 |
| 16617 | 1–298;1–106 |
| 16618 | 1–458;1–424;1–432;1–431;1–458;1–444;1–458;1–469;1–445;1–193;1–435;1–461 |
| 16621 | 1–491;1–338 |
| 16622 | 1–222;1–422;1–425;1–431;1–418 |
| 16623 | 1–60;1–57 |
| 16624 | 1–211;1–458 |
| 16625 | 1–144;1–144;12–488;12–144 |
| 16626 | 1–473;1–454 |
| 16627 | 1–419;2–397;2–454;2–461;2–490;2–479;2–479;2–389;2–384;2–479 |
| 16628 | 1–323;1–325;1–334;1–62;1–334 |
| 16633 | 1–68;1–433;1–388 |
| 16634 | 1–132;1–182;1–182;1–107;1–166;1–182;1–169 |
| 16635 | 1–399;1–372 |
| 16637 | 1–413;1–443;1–280 |
| 16638 | 1–480;1–406 |
| 16639 | 1–367;1–367 |
| 16640 | 1–392;7–390 |
| 16641 | 1–452;1–482 |
| 16642 | 1–464;1–455 |
| 16643 | 1–75;1–123;1–130;1–135;1–134;1–135;1–91;1–125;3–90;55–126 |
| 16644 | 1–143;1–348;1–345;1–336;1–345 |
| 16645 | 1–414;1–281 |
| 16648 | 1–466;6–458 |
| 16651 | 1–415;1–434;1–516 |
| 16652 | 1–411;1–377;2–436 |
| 16653 | 1–369;1–408;1–124;1–517;1–464;1–473;1–517;1–517;1–498;1–448 |
| 16654 | 1–375;1–375;1–353;1–374;1–375 |
| 16655 | 1–367;1–354 |
| 16656 | 1–371;1–430 |
| 16657 | 1–430;373–900;373–757;373–761;373–879;374–823;375–901;376–912;377–849;377–865;378–761;378–906;388–803;388–868;388–784;388–803;391–761;394–748;396–901;396–793;396–702;396–885;401–906;401–901;401–911;401–902;401–722;401–750;401–891;401–761;401–750;401–914;401–828;401–794;401–762;401–901;404–902;404–911;404–892;404–856;404–761;406–761;407–912;407–891;407–674;409–910;409–895 |
| 16659 | 1–457;1–198;1–444 |
| 16660 | 1–445;1–387;1–463;1–445 |
| 16661 | 1–475;1–464;1–446;1–450 |
| 16662 | 1–452;1–438 |
| 16663 | 1–455;10–326;10–475 |
| 16665 | 1–439;1–504;4–119 |
| 16667 | 1–528;1–401;1–203;1–325;1–473;1–475 |
| 16668 | 1–469;1–472 |
| 16670 | 1–550;4–417;4–255;4–473;4–441;27–235 |
| 16671 | 7–427;7–489;49–497;49–259;49–308;49–478;49–517 |
| 16674 | 1–498;1–506;1–230;1–498;1–527;1–318;1–506;1–521;1–506;1–498;1–249 |
| 16675 | 1–183;6–395 |
| 16676 | 1–609;1–470 |
| 16679 | 1–115;1–216;1–210;1–216;1–216;1–204;1–216 |
| 16681 | 1–463;1–379;1–499;1–454;1–445;1–531;1–497 |
| 16682 | 1–430;1–571;1–439;1–469 |
| 16683 | 1–85;1–56;1–57;1–87;1–100;1–88;1–81;1–84;1–80;1–96;1–93;1–95;23–80 |
| 16684 | 1–85;1–56;1–85;1–81;1–85;1–57;1–80;1–84;23–244;23–239;23–235;23–264;23–244;23–243;23–244;23–243;23–253;23–243;23–357;23–361;23–256;23–247;23–80;23–243;23–243;23–260;23–256;23–254;23–360 |
| 16697 | 1–394;1–377 |
| 16698 | 1–447;1–472;1–370;1–450 |
| 16699 | 1–498;1–297 |
| 16700 | 1–482;1–476;1–513;1–432;1–449;1–478;1–457 |
| 16701 | 1–155;1–155 |
| 16702 | 1–486;1–446;1–464;1–409;1–477;1–491;1–498;1–452;1–467;1–487;1–260 |
| 16703 | 1–241;1–211 |
| 16704 | 1–418;1–472;1–481;1–466 |
| 16709 | 1–269;1–396;1–417;1–212;1–484;1–408;1–362;1–448;1–470;1–448;1–459;1–484;3–453;3–472;39–468 |
| 16715 | 1–378;1–443;1–385;2–146 |
| 16716 | 1–451;1–395;1–496 |
| 16717 | 1–159;1–176 |
| 16718 | 1–372;1–486;1–451;1–527;1–478;1–497;1–475;1–467 |
| 16722 | 1–214;1–214;1–214;1–214;1–211;1–214;1–214;1–211;1–214;1–214;1–214;1–214;1–214;1–214 |
| 16723 | 1–476;12–485 |
| 16726 | 1–482;107–569;107–569;107–575;107–581;107–562 |
| 16728 | 1–492;1–480;1–480;1–479 |
| 16737 | 1–457;1–527 |
| 16738 | 1–128;1–128;1–128;1–117;1–117;1–117;1–117;1–118;1–117;1–118;1–118;1–128;1–117;1–118;1–118;1–118;1–117;1–118;1–128;1–118;1–128;1–128;1–118;1–128;1–118;1–117;1–118;1–118;1–117;1–117;1–117;1–128;1–121;1–118;1–118 |
| 16739 | 1–116;1–116 |
| 16742 | 1–527;1–558;1–565;1–488 |
| 16743 | 1–339;1–342 |
| 16744 | 1–432;1–282 |
| 16745 | 1–536;1–536 |
| 16746 | 1–87;1–87;1–89;1–89;1–84;1–89;1–84;1–87;1–89;1–87;1–89;54–498 |
| 16747 | 1–428;1–461 |
| 16748 | 1–473;1–467;1–474 |
| 16749 | 1–484;1–503;1–498;1–480;1–477 |
| 16750 | 1–293;41–386;41–265;41–438;41–530;41–402;41–468;41–400 |
| 16751 | 1–65;19–462;31–194;308–794 |
| 16752 | 1–65;9–337;19–394;31–197 |
| 16753 | 1–490;36–475 |
| 16754 | 1–488;1–440;33–367;33–139 |
| 16756 | 1–245;1–245;1–244 |

TABLE II-continued

(Tiling path)

| Seq Id No. | Positions of biological 5'ESTs |
|---|---|
| 16757 | 1–248;1–203 |
| 16758 | 1–217;1–206;1–206;1–120;1–216;1–216;1–217;1–222;1–222;1–216;1–216;1–217;1–217;1–203;1–217 |
| 16761 | 1–324;1–525;1–511 |
| 16764 | 1–374;1–498;1–418;1–374;1–442;1–442;1–448;1–314 |
| 16765 | 1–330;1–322;1–325;1–300;1–322;1–330 |
| 16766 | 1–121;22–117;26–233;26–112 |
| 16769 | 1–460;1–464 |
| 16770 | 1–346;1–342;1–338;1–358 |
| 16771 | 1–412;1–412 |
| 16772 | 1–461;1–463;1–468;1–505;1–492;1–478;1–439;1–217;1–542;1–494;1–480;1–371;1–232;1–489;1–464;1–397;1–218;1–463;1–483 |
| 16773 | 1–215;1–398;35–418 |
| 16774 | 1–251;1–256;1–256 |
| 16775 | 1–358;1–355;1–347;1–356;2–354;2–354;3–342;3–234;3–190 |
| 16776 | 1–112;1–113;1–113;1–132;1–128;3–127;3–100;3–114;3–113;3–128;3–128;3–113;3–117;3–130;3–128;4–111;4–130;5–108;5–103;5–130;5–95;5–106;5–130;5–103;5–128;5–127;5–130;5–71;5–130;5–121;5–131;5–102;5–126;5–126;5–107;5–126;5–130;5–126;5–130;5–94;5–129 |
| 16777 | 1–233;1–189;2–253 |
| 16787 | 1–118;1–196;1–104;1–116;1–213 |
| 16790 | 1–540;1–475;16–421;16–651;16–501;16–531;27–436;27–527;27–529;27–497;28–296;28–543;28–266;29–613;29–605;30–541;30–624;30–518;30–347;30–453;30–456;30–586;30–597;30–528;30–541;30–496;30–493;30–453;30–490;30–450;30–496;30–528;30–531;30–665;30–405;30–501;30–576;30–493;30–493;30–540;30–493;30–436;30–617;30–493;30–552;30–682;30–676;30–514;30–539;30–272;30–639;30–551;30–456;30–548;30–403;30–517;30–436;30–423;30–546;30–582;30–490;30–531;30–543;30–439;30–439;30–476;30–496;30–476;30–542;30–490;30–476;30–453;30–519;30–549;30–493;30–439;30–540;30–501;30–423;30–517;30–543;30–489;30–345;30–476;30–540;30–424;30–540;30–489;30–484;30–540;30–531;30–493;30–530;30–456;30–517;30–531;30–665;30–517;30–567;30–548;30–541;30–552;30–546;30–595;30–453;30–540;30–493;30–529;30–356;30–421;30–422;30–543;30–527;30–490;30–423;30–527;30–485;30–613;30–488;30–516;30–528;30–394;30–496;30–435;30–543;30–575;30–436;30–202;30–560;30–665;30–487;30–598;30–433;30–493;30–563;30–519;30–496;30–312;30–539;30–496;30–624;30–548;30–519;30–424;30–439;30–439;30–4 |
| 16794 | 1–470;1–482 |
| 16795 | 1–117;31–429 |
| 16796 | 23–334;23–406;23–332;71–423 |
| 16798 | 1–108;1–80 |
| 16808 | 1–447;1–425;1–428 |
| 16809 | 1–430;1–437;1–457;1–424 |
| 16810 | 1–243;1–262;1–400;1–390 |
| 16811 | 1–463;1–528 |
| 16815 | 1–453;110–574;110–562;110–547;110–574 |
| 16817 | 1–233;1–395;1–361;1–455;1–432 |
| 16818 | 1–118;1–290;1–265 |
| 16820 | 1–311;1–524;1–495;1–340 |
| 16821 | 1–559;1–440 |
| 16822 | 1–483;1–492;1–500;1–499;1–504 |
| 16823 | 1–531;1–166 |
| 16824 | 1–194;1–183;19–93;19–107;70–371;70–154;71–195;71–160 |
| 16826 | 1–348;1–448 |
| 16828 | 1–558;1–486 |
| 16830 | 1–450;1–293 |
| 16838 | 1–268;1–263;1–256 |
| 16839 | 1–415;1–463;1–526;1–339;1–485;1–344;1–282;1–412;1–344 |
| 16840 | 1–515;1–386;1–474 |
| 16841 | 1–334;1–89;1–343 |
| 16844 | 1–459;1–453 |
| 16845 | 1–372;1–93;1–501;2–410;11–432 |
| 16846 | 1–471;1–436;1–349 |
| 16847 | 1–197;1–194;1–174;1–174 |
| 16848 | 1–432;1–130 |
| 16849 | 1–447;1–255;1–475;1–493;1–495 |
| 16850 | 1–429;1–270 |
| 16851 | 1–427;297–843 |
| 16853 | 1–175;10–92;10–107;10–70;10–72;10–72;10–126;10–155;10–87 |
| 16855 | 1–517;1–310 |
| 16856 | 1–275;1–250 |
| 16857 | 1–478;1–476 |
| 16859 | 1–418;1–418;1–392;1–436;1–237;1–425 |
| 16860 | 1–419;1–408;1–373 |
| 16861 | 1–445;1–416 |
| 16863 | 1–411;1–430 |
| 16864 | 1–436;35–391 |
| 16865 | 1–375;1–111;1–386;1–390;1–399;1–81;1–246;1–392;1–400;1–400;1–381;1–382;1–381;1–382;1–399;1–381;1–399;1–395;1–391;1–383;1–382;1–394;1–379;1–399;1–381;1–391;1–400;1–147;1–392;1–386;1–83;1–386;1–400;1–389;1–386;1–400;1–313;1–389 |
| 16866 | 1–291;1–286;1–302 |
| 16867 | 1–156;1–156;1–156;1–156;1–155;1–156;1–155;1–156;1–156;1–155;1–156;1–156;1–156;1–155;1–156;1–155;1–156;1–156;1–155;1–156;1–155;1–156;1–144;1–156;1–65;1–155;1–155;1–156;1–155;1–156;1–155;1–156;1–156;1–156;1–155;1–156;1–156;1–155;1–155 |
| 16868 | 1–122;1–112 |
| 16874 | 1–461;1–281 |
| 16875 | 1–237;1–237 |
| 16876 | 1–50;1–474 |
| 16877 | 1–454;1–304 |
| 16878 | 1–471;1–449;1–476;1–562;1–499;1–563;1–325;1–500;1–551;1–583;1–465;1–468;1–486;1–485;1–552;1–551;1–56;1–457;1–471;1–486;1–445;1–480;1–358;1–230;1–479;1–442;1–365;1–495;1–497;1–333;1–486;1–421;1–442;1–491;1–496;1–562;1–353;1–175;1–496;1–453;1–440;1–563;1–450;1–488;1–450;1–465;1–434;1–443;1–77;1–378;1–571;1–563;1–419;1–188;1–469;1–484;1–457;1–478;1–487;1–190;1–496;2–403 |
| 16880 | 1–426;17–370;56–541;56–488;56–461;56–347;56–172;56–548;56–434 |
| 16881 | 1–337;36–602 |
| 16882 | 1–424;1–371;1–383;1–277 |
| 16883 | 1–313;1–299 |
| 16884 | 1–439;1–216;1–474;1–474;1–482;1–346 |
| 16885 | 1–514;1–432;1–474 |
| 16886 | 1–470;1–434;1–295 |
| 16887 | 1–543;1–524;1–508;1–356;1–429;1–582;1–584;1–583;1–561;1–602;1–557;1–528;1–582;1–582;1–585;1–525;1–582;1–485;1–582;1–583;1–582 |
| 16888 | 1–169;4–127 |
| 16889 | 1–342;28–333 |
| 16890 | 1–370;2–366;5–380;18–425;24–431 |

TABLE II-continued

(Tiling path)

| Seq Id No. | Positions of biological 5'ESTs |
|---|---|
| 16891 | 1–138;1–136;1–157;1–150 |
| 16892 | 1–405;1–405 |
| 16894 | 1–453;10–513 |
| 16895 | 1–438;1–496 |
| 16896 | 1–466;1–472;1–357;1–561 |
| 16898 | 1–337;1–373;1–540;1–311;1–337 |
| 16899 | 1–473;1–426;1–339;1–407;1–465;2–453 |
| 16900 | 1–426;256–681 |
| 16901 | 1–368;1–337;51–338;51–338;51–338 |
| 16902 | 1–524;1–306;1–576 |
| 16904 | 1–177;1–198;1–199;1–456 |
| 16905 | 1–480;1–448;1–496;1–234;1–122;1–462;1–333;1–491;1–513;1–281;1–527;1–480;1–490;1–496;1–442;1–480;1–481;1–514;1–493;1–512;1–526;1–491;1–501;1–501;1–478;1–480;1–489;1–492;1–464;1–511;1–487;1–445;1–509;1–402;1–482;1–490;1–509;1–513;1–522;1–253;1–492;1–486;1–496;1–493;1–480;1–514;1–452;1–413;1–520 |
| 16906 | 1–431;1–135 |
| 16908 | 1–432;1–422;1–449 |
| 16909 | 1–334;1–349;1–348 |
| 16910 | 1–216;1–216;1–216;9–98 |
| 16911 | 1–350;1–435 |
| 16912 | 1–472;1–427 |
| 16913 | 1–422;1–439 |
| 16914 | 1–385;1–449 |
| 16915 | 1–382;1–305;1–510;1–476 |
| 16916 | 1–192;1–193;1–193;1–193;1–180;1–193 |
| 16917 | 1–487;1–494;1–503;1–471;1–420;1–435;1–373;1–399;1–119;1–445;1–391 |
| 16919 | 1–505;1–457 |
| 16920 | 1–478;1–458 |
| 16924 | 1–152;1–154;1–154 |
| 16925 | 1–175;1;215;1–208;1–166;1–144;1–215;1–178;1–212;1–219;2–217;3–104 |
| 16947 | 1–477;1–528;1–528 |
| 16948 | 1–425;9–308 |
| 16959 | 1–403;1–370;1–521;1–372;1–458;1–262;1–461;1–371;1–448;1–410;1–492;1–372;1–405;1–448;1–429;1–326;1–200;1–403;7–399;16–428;16–477;16–279;16–469;16–526 |
| 17000 | 1–372;1–349;1–361;1–360 |
| 17011 | 1–431;1–335;1–474;1–431 |
| 17032 | 1–491;1–57 |
| 17043 | 1–487;1–470 |
| 17065 | 1–207;1–207;1–219;1–119;1–215 |
| 17076 | 1–429;1–470;1–487 |
| 17084 | 1–395;1–418 |
| 17085 | 1–248;1–248;1–249;1–248 |
| 17086 | 1–463;1–234;1–513;1–502 |
| 17087 | 1–137;1–223 |
| 17089 | 1–487;1–460 |
| 17091 | 1–214;1–163;1–132;6–130;25–133;25–189 |
| 17092 | 1–263;1–291 |
| 17093 | 1–508;1–472 |
| 17094 | 1–243;1–150;1–414 |
| 17098 | 1–72;1–72;1–72;1–68;1–72;1–72 |
| 17099 | 1–380;1–449 |
| 17100 | 1–466;308–710;312–381 |
| 17101 | 1–414;1–482;1–482;1–408;1–454;1–402;1–434;1–442;1–213;1–482;1–419 |
| 17102 | 1–466;1–477;1–498;1–498;1–534;1–471;1–428 |
| 17105 | 1–455;1–542 |
| 17106 | 1–77;1–92 |
| 17107 | 1–477;1–287 |
| 17108 | 1–411;1–275 |
| 17110 | 1–139;1–138;1–139;1–138 |
| 17112 | 1–449;1–399 |
| 17113 | 1–510;1–455 |
| 17117 | 1–91;1–91;1–91;1–91;1–91;1–91;1–91;1–91;1–91 |
| 17118 | 1–310;1–500;1–89;1–327;1–442;1–496;1–488;1–432;1–507 |
| 17119 | 1–405;3–426 |
| 17121 | 1–471;1–469 |
| 17122 | 1–448;1–452 |
| 17123 | 1–295;1–302;1–301;1–271;1–304;1–295;1–306;1–306;1–310;1–305;1–295;1–271;1–312 |
| 17125 | 1–430;1–545;1–480;1–562;1–462 |
| 17127 | 1–505;1–492;1–465 |
| 17128 | 1–379;1–338 |
| 17129 | 1–399;1–407;1–414;1–406;1–412;1–415;1–414 |
| 17130 | 1–547;1–397;1–298;1–439 |
| 17131 | 1–455;1–470;234–414 |
| 17132 | 1–487;46–520 |
| 17133 | 1–369;1–351;1–351;1–369;1–371;1–351;1–344;1–368;1–369;1–368;1–345 |
| 17134 | 1–439;1–472;1–510 |
| 17135 | 1–476;21–192 |
| 17137 | 1–447;1–434;1–441 |
| 17138 | 1–336;1–346 |
| 17139 | 1–294;1–457;1–459;1–487;1–410;1–469;1–503 |
| 17141 | 1–90;1–195;1–250 |
| 17143 | 1–168;1–168;1–167;1–168;1–169;1–168;1–126;1–168;1–127;1–168;1–168;1–143;1–168;1–127;1–168;1–119;1–137;1–167;1–128;1–128;1–167;1–168;1–168;1–168;1–168;1–128;1–116;1–168;1–113;1–168;1–168;1–126;1–127;1–152;1–168;1–128;1–168;1–116;1–127;1–168;1–168;1–150;1–168;1–168;1–168;1–138;1–136;1–78;1–168;1–121;1–86;1–126;1–122;1–168;1–131;1–150;1–120;1–168;1–122;1–168;1–164;1–132;1–117;1–126;1–163;1–70;2–153 |
| 17150 | 1–376;1–505;1–364;1–462 |
| 17152 | 1–107;1–107;1–107;1–107;1–107;1–107;1–107;1–107;1–107;1–114;1–107;1–107;1–107;1–107;1–107 |
| 17153 | 1–141;1–269 |
| 17154 | 1–430;1–498;1–400;1–433;39–201 |
| 17155 | 1–449;1–199 |
| 17156 | 1–342;1–356;1–101 |
| 17157 | 1–515;1–479;1–486 |
| 17158 | 1–500;1–575 |
| 17161 | 1–417;2–192 |
| 17162 | 1–383;1–195;1–410;1–416;1–384 |
| 17163 | 1–520;1–378;1–476 |
| 17164 | 1–376;1–372;1–463;1–501 |
| 17166 | 1–297;1–460;1–397;1–422;1–457;1–341;1–440;1–179;1–354;1–477;1–456;1–449;1–103;1–364;1–458;1–462;1–326;1–456;1–457;1–314;1–352;1–362 |
| 17167 | 1–297;1–625;1–397;1–422;1–487;1–457;1–495;1–551;1–440;1–341;1–449;1–478;1–484;1–364;1–564;1–507;1–314;1–352;1–460;1–362;1–477;1–550;1–103;1–571;1–354;1–179;1–456;1–449;1–477;1–458;1–565;1–551;1–462;1–457;1–326;1–456;4–551 |
| 17170 | 1–453;1–438;1–472;7–418;7–474;7–479;11–476;14–426;14–410;17–351;25–222;25–337;25–349;25–498;25–480;25–258;30–480;30–506;30–465 |
| 17171 | 1–350;4–483;22–219;22–482;22–490;22–564;22–255;24–460;53–515 |
| 17174 | 1–347;1–105 |
| 17175 | 1–477;3–437 |
| 17176 | 1–431;356–844;356–853;356–845;356–836;356–745;356–808;356–814;356–752 |
| 17177 | 1–498;1–480 |
| 17178 | 1–91;1–103;1–132;1–142;1–142;1–142;1–140;1–132;1–132;1–123;1–132;1–132;1– |

TABLE II-continued

(Tiling path)

| Seq Id No. | Positions of biological 5'ESTs |
|---|---|
| | 132;1–132;1–142;1–50;1–122;1–132;1–137;1–132;1–142;1–131;1–140;1–131;1–133;1–142;1–122;1–130;1–142;1–132;1–132;1–132;1–122;1–142;1–132;1–123;1–123;1–141;1–142;1–142;1–135;1–138;1–131;1–132;1–106;1–132;1–132;1–132;1–95;1–138;1–142;1–132;1–132;1–131;1–108 |
| 17179 | 1–571;1–566 |
| 17180 | 1–165;1–165 |
| 17181 | 1–372;1–433 |
| 17189 | 1–491;50–453 |
| 17190 | 1–375;66–290 |
| 17191 | 1–387;1–450 |
| 17192 | 1–527;1–348;1–527 |
| 17193 | 1–121;58–416;58–443;58–426;58–424;58–302;58–415;58–431;58–362 |
| 17194 | 1–70;1–134;1–457;1–491;1–232;1–424;1–519;1–431;1–424 |
| 17195 | 1–319;1–319;1–319;1–308;1–305;1–302;1–308;1–304 |
| 17196 | 1–348;1–315 |
| 17197 | 1–451;20–504;40–223;40–454;40–153;42–521;42–300;42–521;42–475;42–397;45–538;45–151;45–374;45–475;45–550;45–194;45–531;45–414;45–526;46–162;46–164;47–565;47–287;54–565 |
| 17198 | 1–54;1–51;1–51;1–54;1–51;1–51;1–54;1–51;1–51;1–51;1–51;1–51;1–54;1–54;1–54;1–54;1–51;1–54;1–51;1–51;1–54;1–54;1–54;1–51;1–54;1–51;1–54;1–54;1–54;1–51;1–54;1–51;1–54;1–54;1–51;1–51;1–51;1–51 |
| 17201 | 1–261;1–203;1–401;1–377;1–399;1–401;1–401;1–368;1–387;1–134;1–398;1–373;1–260;1–262;1–252;1–399;1–387;1–255;1–225 |
| 17203 | 1–331;1–414 |
| 17204 | 1–384;1–398;1–386 |
| 17205 | 1–369;1–133;1–127;1–70;2–119 |
| 17206 | 1–391;1–438;1–424;1–465;1–268;1–278;1–70;1–133;1–422;1–127;1–393;1–444;1–296;1–395;2–119 |
| 17207 | 1–580;1–554 |
| 17208 | 1–450;2–79 |
| 17211 | 1–441;1–398;1–462 |
| 17212 | 1–290;1–447 |
| 17215 | 1–393;1–404 |
| 17216 | 1–80;1–439 |
| 17217 | 1–432;1–182 |
| 17218 | 1–221;1–138;1–59 |
| 17219 | 1–263;1–85;1–390;1–381;1–380;1–390;1–400;1–388 |
| 17220 | 1–288;1–493;1–535;1–482;1–138;1–368;1–505;1–480;1–509 |
| 17221 | 1–369;34–546;35–565;35–507;35–486;35–501 |
| 17222 | 1–369;34–546;35–507;35–486;35–501;35–571 |
| 17224 | 1–436;1–447;1–406;1–425;1–479;1–473;1–436;1–392;1–456;1–470;1–477;1–473;1–406;1–472;1–404;1–442;1–450;1–477;1–410;1–473;1–477;1–364;1–406;1–477;1–477;1–475;1–461;1–442 |
| 17225 | 1–249;1–285 |
| 17226 | 1–412;1–462;1–413 |
| 17227 | 1–126;1–126;1–126;1–126;1–126;1–126;1–126;1–126;1–126;1–71;1–126;1–126;1–126;1–126;1–107;1–116;1–126;1–100;3–126 |
| 17228 | 1–222;1–377 |
| 17230 | 1–453;1–429 |
| 17231 | 1–233;1–247;1–248;1–248;1–248;1–241;1–246;1–247;1–246;1–210;1–246;1–202;1–247;1–247;1–222;1–229;1–242;1–244 |
| 17236 | 1–280;1–286 |
| 17237 | 1–352;1–348;1–463;1–460;96–158 |
| 17238 | 1–414;7–388;7–415;7–62;7–409 |
| 17239 | 1–276;1–272 |
| 17240 | 1–172;1–324 |
| 17241 | 1–523;1–357 |
| 17242 | 1–257;1–329 |
| 17243 | 1–468;1–510 |
| 17244 | 1–468;1–466 |
| 17245 | 1–249;1–424;1–343;1–407;3–173 |
| 17247 | 1–311;1–311 |
| 17248 | 1–229;1–384 |
| 17249 | 1–287;1–193;1–457 |
| 17250 | 1–291;1–125 |
| 17251 | 1–258;1–274;1–274 |
| 17253 | 1–409;1–559;1–519;1–457 |
| 17254 | 1–331;16–433 |
| 17255 | 1–333;1–321;1–335 |
| 17256 | 1–490;283–722 |
| 17257 | 1–261;4–276;29–447;29–200 |
| 17258 | 1–479;5–263;6–278;31–202 |
| 17259 | 1–350;1–351 |
| 17260 | 1–382;1–480 |
| 17262 | 1–536;1–235 |
| 17263 | 1–464;1–466;1–310;29–260 |
| 17264 | 1–383;1–349;1–454;23–204;27–326 |
| 17265 | 1–479;1–489 |
| 17266 | 1–329;1–461;1–463;1–395;1–462;1–454;1–457;1–457;1–447;1–434;1–468;1–457;1–451;1–408;1–450;1–444;1–442;1–452;1–424;1–457;1–169;1–453;1–450;1–447;1–451;1–451;1–443;1–462;1–472;1–365;1–452 |
| 17267 | 1–354;1–402;1–458;1–439;1–544;1–444;1–459;1–102;1–444 |
| 17268 | 1–520;1–508;11–453;40–509;40–507;40–509;40–527;40–486;40–512;40–283;40–442;40–512;40–528;40–528;40–455;40–456;40–528;40–470;40–498;40–442;40–363;40–528;40–487;40–497;40–402;40–530;40–528;40–498;40–425;40–478;40–472;40–478;40–512;40–555;40–498;40–452;40–523;40–261;40–527;40–528;40–475;40–443;40–439;40–403;40–134;40–506;40–506;40–528;40–438;40–528;40–509;40–512;40–496;40–385;40–300;40–509;40–99;44–477 |
| 17269 | 1–530;1–518;11–462;40–546;40–546;40–508;40–434;40–519;40–517;40–581;40–519;40–535;40–549;40–546;40–549;40–545;40–496;40–451;40–571;40–568;40–522;40–280;40–568;40–549;40–580;40–549;40–522;40–567;40–544;40–567;40–570;40–464;40–465;40–544;40–535;40–568;40–569;40–580;40–546;40–568;40–508;40–567;40–451;40–545;40–549;40–559;40–569;40–497;40–488;40–568;40–412;40–507;40–549;40–535;40–535;40–568;40–581;40–571;40–567;40–582;40–508;40–535;40–581;40–562;40–544;40–584;40–563;40–575;40–413;40–568;40–586;40–567;40–482;40–488;40–575;40–581;40–581;40–522;40–508;40–581;40–584;40–461;40–568;40–533;40–568;40–568;40–262;40–569;40–584;40–535;40–535;40–583;40–549;40–572;40–485;40–565;40–568;40–452;40–448;40–557;40–516;40–570;40–522;40–516;40–568;40–543;40–447;40–563;40–549;40–535;40–547;40–581;40–519;40–134;40–545;40–568;40–568;40–579;40–302;40–396;40–506;40–549;40–519;40–99;40–549;43–581;44–487 |
| 17270 | 1–219;1–59;1–94;14–456;14–451;33–464 |
| 17274 | 1–321;1–283 |

TABLE II-continued

(Tiling path)

| Seq Id No. | Positions of biological 5'ESTs |
|---|---|
| 17275 | 1–473;1–413 |
| 17278 | 1–486;1–376;1–135 |
| 17279 | 1–421;1–340 |
| 17280 | 1–500;1–475;16–524;16–447;16–180;16–474;16–505 |
| 17281 | 1–260;1–267;1–448 |
| 17282 | 1–486;1–475 |
| 17283 | 1–468;39–439 |
| 17284 | 1–492;1–394;1–474;1–499 |
| 17287 | 1–369;1–154 |
| 17288 | 1–510;1–483 |
| 17289 | 1–501;1–436;1–493 |
| 17290 | 1–559;1–455 |
| 17293 | 1–446;1–399;1–471 |
| 17298 | 1–422;1–488;1–471 |
| 17300 | 1–147;3–139;3–126;3–372;3–152;3–151;3–139;3–75;3–139;3–277;3–85;5–125;5–139;5–139;5–115;5–152;5–139;6–139;6–139;6–132;6–152 |
| 17301 | 1–83;1–73;1–123;3–122;3–130;3–112;4–92 |
| 17302 | 1–204;1–197 |
| 17304 | 1–307;1–348 |
| 17305 | 1–456;1–278 |
| 17306 | 1–411;21–442 |
| 17307 | 1–62;1–499 |
| 17308 | 1–56;1–85;1–82;1–79;1–80;1–73;1–61;1–87;1–55;1–137;1–78;1–81;1–82 |
| 17309 | 1–332;11–478 |
| 17314 | 1–471;1–443;1–460 |
| 17315 | 1–274;38–412 |
| 17316 | 1–520;1–457;1–486;1–466;1–457;1–479;1–503;1–169;1–491;1–425;1–435;3–474 |
| 17317 | 1–453;1–429;1–317;1–492;1–469;1–461 |
| 17318 | 1–83;1–75;1–83;1–83;1–83;1–83;1–83;1–83;1–83;1–83;1–84;1–74;1–84;1–83;1–83;1–83;1–83;1–82;1–50;1–74 |
| 17319 | 1–514;1–503;1–525;1–513 |
| 17320 | 1–250;1–250 |
| 17321 | 1–490;1–83 |
| 17322 | 1–402;4–86 |
| 17324 | 1–498;1–454 |
| 17325 | 1–424;1–293;1–492;1–517 |
| 17326 | 1–396;1–312 |
| 17327 | 1–453;1–542 |
| 17328 | 1–595;1–353;1–483 |
| 17329 | 1–541;1–149;1–467 |
| 17330 | 1–368;1–104;1–191;1–160;1–518;1–445;1–489;1–345;1–427;1–333;1–406;1–489;1–400;1–468;2–190;2–205;316–751;330–757;330–427;330–464;330–736;330–749;330–544;330–763;330–728;330–553;330–733;330–677;330–736;330–794;451–902;462–677;462–812;554–671;592–1053;673–1041;673–1040;673–999;880–1349;1241–1549 |
| 17331 | 1–156;3–346 |
| 17332 | 1–492;1–440;1–433 |
| 17333 | 1–447;1–420;1–425;4–431 |
| 17334 | 1–469;1–499 |
| 17337 | 1–447;1–390;1–447 |
| 17338 | 1–169;1–169 |
| 17339 | 1–481;13–197 |
| 17340 | 1–406;1–476;1–536;1–477;1–390;1–493;2–250;6–445;42–500;42–218;42–494;42–278;42–459;42–365 |
| 17341 | 1–365;1–443 |
| 17342 | 1–392;33–316 |
| 17343 | 1–299;1–299;1–299;1–299;1–175;1–299;1–299;1–299;1–299;1–299;1–301;1–299;1–301;1–299;1–301;1–301;1–121 |
| 17345 | 1–380;1–435 |
| 17347 | 1–469;15–441;15–470 |
| 17348 | 1–478;1–488;1–480;235–672 |
| 17349 | 1–501;1–483;1–480;48–503;48–512;56–450;72–543 |
| 17350 | 1–97;1–230;1–109;1–167;1–111;1–214;1–198;1–230;1–257;1–231;1–231;1–221;1–231;1–230;1–215;1–231;1–257;1–231;1–222;1–230;1–92;1–231;1–138;1–228;1–231;1–231;1–123;1–222;1–257;1–257;1–230;1–231;1–219;1–121;1–257;1–122 |
| 17351 | 1–97;1–246;1–246;1–246;1–246;1–245;1–246;1–246;1–230;1–167;1–109;1–246;1–246;1–246;1–111;1–198;1–214;1–230;1–246;1–246;1–246;1–246;1–246;1–231;1–246;1–246;1–246;1–246;1–246;1–232;1–246;1–246;1–245;1–246;1–246;1–245;1–246;1–221;1–245;1–232;1–246;1–246;1–230;1–243;1–1–238;1–245;1–215;1–234;1–244;1–246;1–247;1–232;1–247;1–233;1–246;1–222;1–230;1–92;1–232;1–246;1–246;1–138;1–245;1–246;1–246;1–228;1–246;1–247;1–232;1–231;1–246;1–123;1–246;1–2261–246;1–222;1–246;1–248;1–246;1–246;1–246;1–246;1–239;1–230;1–233;1–246;1–246;1–245;1–246;1–238;1–245;1–246;1–219;1–246;1–121;1–246;1–246;1–246;1–122 |
| 17352 | 1–445;1–444;1–476;1–447 |
| 17353 | 1–414;4–319 |
| 17354 | 1–479;1–502;1–500;1–473;1–499;1–286 |
| 17355 | 1–402;1–345 |
| 17356 | 1–445;1–452;1–486;1–463;1–289;1–412;1–411;1–432;1–506 |
| 17357 | 1–291;1–290;1–291;1–127;1–250;1–291;1–291;1–291;1–290;1–291;1–290;1–126;1–290;1–291;1–291 |
| 17358 | 1–477;1–503 |
| 17359 | 1–482;1–357;1–389;1–424;1–384 |
| 17360 | 1–482;1–443;1–483 |
| 17361 | 1–423;1–468 |
| 17363 | 1–501;1–408;1–535 |
| 17364 | 1–298;2–393;2–408;2–416 |
| 17365 | 1–471;1–465;1–446 |
| 17367 | 1–408;1–174;1–437 |
| 17368 | 1–460;1–456;5–265 |
| 17369 | 1–492;158–591;319–573;319–591;319–578 |
| 17370 | 1–418;1–436;1–443;1–395;1–261 |
| 17373 | 1–483;1–502 |
| 17374 | 1–472;1–479 |
| 17375 | 1–358;1–500;1–500;1–500;1–501;1–480 |
| 17376 | 1–415;1–434;1–359 |
| 17377 | 1–412;1–441 |
| 17381 | 1–454;1–450;1–390;1–445;1–304;1–347;1–390;1–447;1–441;1–450;5–240 |
| 17383 | 1–384;1–411;1–475;1–472;1–346;1–472;1–472;1–472;1–201;1–412;1–472;1–472;1–472;1–470;1–472;1–421;1–460;1–472;1–411;1–472;1–434;1–463;1–271;1–245;1–472;1–472;1–418;1–409;1–458;1–422;1–472;1–472;1–472;1–472;1–481;1–472;1–410;1–391 |
| 17386 | 1–481;1–451 |
| 17388 | 1–278;1–318;1–312;1–312;1–312;1–312 |
| 17389 | 1–304;1–304;1–287;1–304;1–200;1–304 |
| 17390 | 1–232;1–219 |
| 17391 | 1–451;1–462;1–456;1–422;1–463;16–458;27–464;31–450;31–182;31–437;31–450;31–450;31–435;33–464;33–453;33–334;33–456;33–412;33–455;34–334;34–451;38–459;38–464;40–213;40–450;40–466;40–462;40–455;40–450;40–432;40–450;40–453;40–445;40–454;40–458;40–256;40–434;40–297;40–438;40–457;40–450;40–448;40–448;40–450;40–449;40–117;40–450;40–311;40–450;40–432;40–457;40–448;40–450;40–450;40–438;40– |

TABLE II-continued (Tiling path)

| Seq Id No. | Positions of biological 5'ESTs |
|---|---|
|  | 465;40–289;40–449;40–453;40–424;40–453;40–453;40–453;40–425;40–453;40–453;40–457;40–450;40–467;40–453;40–449;40–425;40–449;40–439;40–431;40–437;40–444;40–421;40–457;40–465;40–459;40–414;40–429;41–450;43–299;43–431;43–436;43–450;43–431;43–450;43–450;43–450 |
| 17392 | 1–78;1–297;1–300;1–293 |
| 17394 | 1–579;1–453 |
| 17396 | 1–464;1–375;1–371 |
| 17397 | 1–201;1–181 |
| 17398 | 1–453;1–383;1–457 |
| 17399 | 1–471;1–478;1–509;1–489;1–470;1–438;1–489;1–478;1–500;1–408;1–522;1–500;1–463;1–493;1–452;1–451;1–426;1–530;1–194;1–208;1–511 |
| 17400 | 1–456;1–273;1–493;1–459 |
| 17401 | 1–353;1–560;1–459;1–483;1–439 |
| 17402 | 1–462;1–491;28–439;28–480;28–270;30–381;446–741 |
| 17403 | 1–404;1–270;1–412 |
| 17404 | 1–272;1–285;1–285;1–240;1–281 |
| 17405 | 1–261;1–286;1–398 |
| 17407 | 1–117;1–174;1–173;1–173;1–173;1–173 |
| 17408 | 1–227;1–440;1–432;1–355 |
| 17409 | 1–160;1–547 |
| 17410 | 1–237;26–473 |
| 17411 | 1–452;32–430;32–388 |
| 17412 | 1–237;1–238;1–238;1–234;1–238;1–237;1–227;1–224;1–235;1–238;1–240;1–228;1–240;1–194;1–238;1–238;1–228;1–238;1–239;1–238;1–238;1–234;1–238;1–238;1–221;1–89;1–238;1–238;1–224;1–238;1–201;1–122;1–239;1–236;1–104;1–237;1–238;1–238;1–223;1–232;1–238;1–237;1–237;1–229;1–237;1–238;1–240;1–231;1–238;1–238;1–237;1–237;1–238;1–240;1–238;1–202;1–226;1–238;1–233 |
| 17424 | 1–504;1–481;1–381 |
| 17425 | 1–496;1–578 |
| 17426 | 1–432;1–343 |
| 17427 | 1–380;5–399 |
| 17428 | 1–481;1–340;1–496 |
| 17429 | 1–137;17–249;51–198;51–160 |
| 17430 | 1–220;1–337;1–145 |
| 17431 | 1–390;1–389;1–391 |
| 17432 | 1–255;1–427;1–307 |
| 17433 | 1–391;1–385;1–390 |
| 17434 | 1–53;1–51;1–82 |
| 17435 | 1–424;1–448 |
| 17437 | 1–497;20–151;20–431 |
| 17438 | 1–479;1–507 |
| 17440 | 1–292;1–214;1–383 |
| 17441 | 1–404;11–402 |
| 17442 | 29–128;29–130;29–129;30–113;30–125;30–131 |
| 17443 | 1–86;3–349 |
| 17445 | 1–465;1–398;1–448;1–471;1–454 |
| 17456 | 1–346;1–317 |
| 17458 | 1–432;1–509;1–596;1–470;1–499;1–516;1–514 |
| 17459 | 1–316;4–302;4–356;4–440;4–346;4–241;4–350;4–478;4–355;4–374 |
| 17460 | 1–466;47–362;50–287;50–396;50–401;50–392;50–420;50–402;50–348 |
| 17461 | 1–454;1–63 |
| 17462 | 1–364;1–359;1–358;1–359 |
| 17463 | 1–423;1–429;1–429;1–329;1–477 |
| 17464 | 1–197;1–468;1–470;1–474;1–437;1–447;1–144;1–489;1–473;1–495;373–848;373–844;373–824;373–835;373–874 |
| 17468 | 1–169;1–423;1–521 |
| 17469 | 1–356;20–346 |
| 17471 | 1–550;1–349 |
| 17472 | 1–97;1–113 |
| 17473 | 1–231;1–244;1–246;1–244 |
| 17474 | 1–440;1–233 |
| 17476 | 1–281;1–318;1–318 |
| 17477 | 1–67;1–67;1–64;1–64;1–65;1–67;1–64;1–65;1–67;1–67;1–65;1–67;1–65;1–64;1–65;1–67;1–67;1–67;1–65;1–65;1–64;1–64;1–65;1–65;1–65;1–65;1–64 |
| 17479 | 1–486;1–459;1–536;1–419 |
| 17481 | 1–503;1–416;1–496;1–504;24–523;34–367 |
| 17482 | 1–415;5–466;34–367 |
| 17484 | 1–401;1–452;1–441;1–299;1–420;1–491;1–415 |
| 17487 | 1–415;1–415 |
| 17488 | 1–482;2–385;2–480;2–482;2–416;2–252;2–389;2–402;2–392;2–428;2–154;2–417;3–486;3–513;3–521;3–518;3–384;3–401;3–485;19–474;19–481;23–303;23–460;23–536;23–394;23–612;23–382;23–512;29–482;29–413;29–475;29–550;29–499;29–538;33–549;33–521;33–511;33–463 |
| 17489 | 1–399;1–428;1–432 |
| 17492 | 1–375;226–379 |
| 17496 | 1–468;1–474;1–475;1–466;1–460;1–483;1–476 |
| 17498 | 1–521;115–496 |
| 17500 | 1–89;1–92 |
| 17504 | 1–492;1–442 |
| 17505 | 1–63;1–63 |
| 17506 | 1–90;1–91;1–91;1–91;1–92;1–92;1–90;1–91;1–91;1–91;1–91;1–92;4–92 |
| 17507 | 1–459;22–406;26–467;35–517;50–530;50–469;50–523;50–470 |
| 17508 | 1–245;1–224;14–232;25–446 |
| 17509 | 1–514;1–474 |
| 17511 | 1–522;1–347;1–445 |
| 17512 | 1–266;1–383;1–546;1–474;1–546;1–282 |
| 17513 | 1–478;1–483;2–251 |
| 17514 | 1–415;1–172 |
| 17515 | 1–440;1–113;1–474;1–490 |
| 17517 | 1–492;1–433;1–486 |
| 17518 | 1–421;1–578 |
| 17519 | 1–484;1–512 |
| 17521 | 1–326;1–355;1–325;1–401;1–372;1–333;1–384;1–333;1–326;1–354;1–379;1–326;1–371;1–278;1–149;1–315;1–326;1–354;5–364;5–384;336–566 |
| 17522 | 1–326;1–325;1–401;1–372;1–355;1–384;1–333;1–326;1–354;1–333;1–379;1–326;1–371;1–278;1–149;1–561;1–315;1–354;1–326;5–364;5–384 |
| 17523 | 1–415;1–156 |
| 17524 | 1–458;1–156 |
| 17525 | 1–541;127–580 |
| 17526 | 1–503;1–318;1–514 |
| 17528 | 1–209;1–133 |
| 17529 | 1–228;1–168;1–381 |
| 17530 | 1–423;1–365;1–404;1–412;1–414;1–423;1–417;251–423;251–423;251–423;251–407;251–423;251–423;251–423;251–412;251–423;251–423;251–425;251–423;251–423;251–423;251–411;251–421;251–407;251–346;251–373;251–372;251–372;251–401;251–423;251–423;251–407;251–374;251–424;251–381;251–401;251–412;251–423;251–393;251–408;251–423;251–423;251–373;251–423;251–381;251–407;251–423;251–401;251–381;251–422;251–423;251–388;251–372;251–423;251–423;251–372;251–406;251–423;251–407;251–412;251–423;251–422;251–406;251–410;251–423;251–396;251–423;251–423;251–418;251–423;251–411;251– |

TABLE II-continued (Tiling path)

| Seq Id No. | Positions of biological 5'ESTs |
|---|---|
| | 416;251–412;251–423;251–423;251–423;251–400;251–423;251–372;251–387;251–423;251–423;251–364;251–356;251–423;251–423;251–423;251–412;251–423;251–422;251–397;251–423;251–412;251–423;251–423;251–423;251–423;251–410;251–421 |
| 17531 | 1–387;1–449 |
| 17532 | 1–218;1–236;1–225 |
| 17533 | 1–319;1–364;1–387;1–464;1–458;1–319;1–464;1–387;1–458;1–464;1–452;1–290;1–376;1–416;1–517;1–387;1–382 |
| 17534 | 1–485;1–470 |
| 17535 | 1–178;1–243 |
| 17536 | 1–352;1–291 |
| 17537 | 1–476;1–460;1–311;87–589;87–536 |
| 17538 | 1–475;1–459;1–310;1–483 |
| 17539 | 1–468;1–500;1–544 |
| 17540 | 1–394;1–393 |
| 17541 | 1–410;1–342;1–419;1–413;1–420;1–390;1–419;1–416;1–341;1–402;1–137;1–252;1–420;1–360;1–145;1–424;1–342;1–402;1–421;1–390;1–421;1–419;1–414;1–354;1–326;1–384;1–421;1–380;1–421;1–385;1–419;1–410;1–417;1–360;1–388;1–416;1–381;1–410;1–390;1–418;1–145;1–419;1–419;1–421;1–406;1–413;1–413;1–409;1–420;1–416;1–420;1–422;1–421;1–421;1–70;1–326;1–418;1–410;1–423;1–352;1–386;1–183;1–404;1–418;1–413;1–406;1–411;1–424;1–388;1–408;1–413;1–413;1–421;1–91;1–413;1–421;1–360;1–419;1–298;1–405;4–224;4–224;4–224;4–225;4–225;4–225;4–225;4–225;4–225;4–224 |
| 17542 | 1–481;1–347 |
| 17543 | 1–299;1–368;1–400 |
| 17544 | 1–468;1–437;1–430 |
| 17545 | 1–177;1–257 |
| 17546 | 1–460;1–470;1–476;1–502;1–481;1–480;1–487;1–415;1–452;1–466;1–482 |
| 17549 | 1–405;1–120 |
| 17550 | 1–405;1–460;1–354 |
| 17551 | 1–393;1–279 |
| 17552 | 1–165;3–165 |
| 17553 | 1–432;1–344;1–387 |
| 17555 | 1–315;2–378 |
| 17560 | 1–494;282–705;282–781;282–777;282–694;282–822;282–769;282–820;282–785;282–670;282–467 |
| 17561 | 1–424;1–424;1–424;1–424;1–424 |
| 17562 | 1–344;1–433;1–354 |
| 17563 | 1–249;1–260;1–260 |
| 17564 | 1–427;1–435;86–409 |
| 17565 | 1–255;1–264;1–280;1–284;1–255;1–243;1–280;1–229;1–281;1–255;1–281;1–281;1–280;1–284;1–192;1–255;1–255;1–255;1–255;1–255;1–280;1–255;1–228;1–264;1–255;1–238;1–280;1–284;1–264;1–284;1–280;1–255;1–264;1–280;1–280;1–255;1–222;1–280;1–264;1–281;1–280;1–264;1–280;2–280 |
| 17567 | 1–304;1–325 |
| 17568 | 1–136;1–442 |
| 17569 | 1–535;283–627;289–628 |
| 17570 | 1–411;1–337;1–411 |
| 17571 | 1–383;1–426;1–474;1–389;4–410;4–466;8–454;8–503;40–547;40–396;40–264;40–501;40–455 |
| 17572 | 1–269;1–348;1–369;1–138;1–270;1–440;3–330;3–368;3–381;14–225;17–411;30–425;30–421;31–363;31–380;31–423;31–443;32–431;32–428;32–443;32–385;32–433;32–425;32–404;32–383;32–437;32–425;32–373;32–146;32–428;32–437;32–374;32–144;32–380;32–417;32–422;32–431;32–441;32–431;32–390;32–435;32–307;32–423;32–421;32–428;32–413;32–433;32–395;32–413;32–431;32–426;32–428;32–419;32–441;32–430;32–225;32–443;32–123;32–416;32–427;32–427;32–386;32–220;32–359;32–437;32–91;32–430;32–433;32–431;32–431;32–430;32–367;32–424;33–339;33–431;33–421;33–383;33–442;33–432;33–374;33–348;33–294;33–441;33–227;33–430;33–414;33–127;33–440;33–406;33–328;33–388;33–421;33–395;33–225;33–348;33–316;33–193;33–421;33–384;33–440;33–365;33–433;33–430;33–346;33–410;33–439;33–419;33–441;33–441;33–431;33–436;33–425;33–409;33–145;33–121;33–412;33–294;33–440;33–426;33–357;33–131;33–414;33–404;33–433;33–395;33–403;33–394;33–413;33–121;33–439;33–434;33–332;33–414;33–430;33–433;33–333;33–372;33–442;33–441;33–315;33–370;33–421;33–442;33–425;33–440;33–348;33–346;33–42 |
| 17574 | 1–425;1–482;1–566;485–939;485–913;485–1010;718–1157 |
| 17575 | 1–224;1–228;1–228;1–218 |
| 17576 | 1–421;1–372;1–396 |
| 17577 | 1–476;1–471;1–407;1–471;1–479;1–554;1–275;1–139 |
| 17578 | 1–73;1–183;1–174;1–112 |
| 17579 | 1–101;1–62;1–58;10–96;10–105;10–253;10–83 |
| 17580 | 1–306;1–176;2–184;13–294;31–184;31–184;31–166;31–184;31–132;31–162;31–267;31–367;31–261;31–184;31–184;31–184;31–300;31–184;31–319;31–184;31–184;31–246;31–184;31–184;31–182;31–184;31–184;31–184;31–184;31–184;31–184;31–184;31–184;31–184;31–246;31–158;31–184;31–183;31–88;31–184;31–308;31–184;31–246;36–182;39–184;39–349;39–305;39–184;39–184;39–213;39–363;39–368;39–179;39–357;39–159;39–358;39–184;39–246;39–185;39–184;39–246;39–170;39–358;39–184;39–184;39–307;39–332;39–127;39–184;39–320;39–258;39–307;39–184;39–305;39–184;39–112;39–184;39–175;46–246 |
| 17581 | 1–425;1–482;1–556 |
| 17582 | 1–224;1–311 |
| 17586 | 1–379;1–379 |
| 17587 | 1–472;1–454 |
| 17588 | 1–460;1–480;1–480 |
| 17591 | 1–366;1–104;1–478 |
| 17592 | 1475;1–422;1–444;1–410;1–447 |
| 17593 | 1–472;40–323 |
| 17595 | 1–356;1–441;1–454;1–503 |
| 17596 | 1–363;18–74;18–73;18–439;85–139;85–139 |
| 17597 | 1–412;19–70 |
| 17599 | 1–639;1–491 |
| 17600 | 1–468;1–449;1–487;1–460 |
| 17601 | 1–404;1–425 |
| 17602 | 1–329;1–326;1–327;1–326;1–329;1–329 |
| 17603 | 1–92;1–92;1–92;1–90;1–92;1–92;1–92;1–92 |
| 17604 | 1–352;1–120;1–339 |
| 17605 | 1–422;1–419;1–221;1–435 |
| 17606 | 1–504;1–454 |
| 17613 | 1–499;1–504 |
| 17614 | 1–442;1–382 |
| 17615 | 1–165;1–169 |
| 17616 | 1–69;1–416;1–458;1–92;1–131 |
| 17617 | 1–398;1–399;1–397;1–390;1–399;1–391;1–390;1–396;1–397;1–391 |

TABLE II-continued

(Tiling path)

| Seq Id No. | Positions of biological 5'ESTs |
|---|---|
| 17618 | 1–476;1–367 |
| 17619 | 1–277;1–277;1–277;1–277;1–259;1–277;1–277 |
| 17620 | 1–137;1–462 |
| 17621 | 1–546;1–410;1–536;10–493;10–277;10–597 |
| 17627 | 1–367;1–358 |
| 17628 | 1–416;190–557;190–700 |
| 17632 | 1–140;1–80;1–140;1–140;1–145;1–140 |
| 17633 | 1–479;1–485;1–475;1–484;1–495;1–457;1–488;1–457;1–509;1–466;1–484;1–487;1–492;1–481;1–457 |
| 17634 | 1–444;1–471 |
| 17636 | 1–368;31–461 |
| 17638 | 1–339;1–488;1–412;1–518;1–471;1–461;1–213;1–490;1–452;1–492;1–485;1–477;1–415;1–473;1–477;1–475;1–406;1–485;1–500;1–207;1–484;1–156;1–345;1–485;1–438;1–395;1–480;1–485;1–470 |
| 17639 | 1–358;1–275;1–405;1–464;1–502;1–441;1–534 |
| 17640 | 1;367;1–521;1–618;1–521;1–434;1–487;1–517;1–487;1–501;1–667;1–527;1–511;1–537;1–415;1–199;1–446;1–441;1–497;1–224;1–317;1–508;1–508;1–525;1–452 |
| 17641 | 1–93;1–351 |
| 17642 | 1–459;1–433 |
| 17643 | 1–440;1–78;1–448;1–474;1–515;1–508;1–487 |
| 17644 | 1–64;1–64;1–64;1–64;1–64;1–64;1–64;1–64;1–64;1–64;1–64;1–64;1–64;1–64;1–64;1–66;1–64;1–64;1–64;1–64;1–64;1–64;1–64;1–64;1–64;1–64;1–64;1–64;1–64;1–64;1–66;1–64;1–64;1–66;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–64;1–66;1–64;1–64;1–64;1–64;1–64;1–64;1–64;1–64;1–64;1–64;1–64;1–64;1–64;1–65;1–64;1–64;1–64;1–64;1–64;1–64;1–64;1–64;1–64;1–64;1–64;1–64;1–64;1–64;1–64;1–64;1–64;1–64;1–66;1–64;1–64;1–64;1–64;1–64;1–64;1–64;1–64;1–64;1–64;1–64;1–64;1–66;1–64;1–64;1–66;1–64;1–64;1–64;1–64;1–64;1–64;1–64;1–64;1–64;1–64;1–64;1–64;1–64;1–65;1–64;1–64;1–64;1–66;1–64;1–64;1–66;1–64;1–64;1–64;1–64;1–64;1–64;1–64;1–64;1–64;1–64;1–64;1–64;1–64;1–64;1–64;1–64;1–64;1–64;1–64;1–64;1–66;1–64;1–64;1–64;1–64;1–64;1–66;1–64;1–64;1–64;1–64;1–64 |
| 17646 | 1–537;1–506;1–337;1–484 |
| 17649 | 1–62;2–116;2–131;2–98;2–134;2–135;2–128;2–112;79–138;79–131;79–140;79–137;79–139;79–138 |
| 17650 | 1–478;1–482;1–491;1–354;92–593 |
| 17651 | 1–410;1–394;1–511;1–317;1–313;1–319;1–473;1–478;1–473;1–316;1–173;1–319;1–511;1–158;1–316;11–393;47–390;100–604;279–544 |
| 17652 | 1–323;2–323;2–323;2–333;2–329;2–71;2–323;2–323;2–314;2–322;2–321;2–333;2–323;2–323;2–304;2–313;2–304;2–323;2–304;2–323;2–323;2–323;2–320;2–323;2–280;2–252;2–322;2–321;2–323;2–323;2–323;2–322;2–324;2–310;2–322;2–324;2–323;2–333;2–323;2–324;2–321;2–322;2–310;2–323;2–323 |
| 17653 | 1–70;1–98 |
| 17656 | 1–412;1–447;1–487;1–446;1–354;1–438;1–414;1–447;1–472;1–459;1–446 |
| 17657 | 1–163;1–120;1–170;1–123;1–162;1–111;1–153;1–170;1–162 |
| 17658 | 1–453;1–493;1–511;1–336;1–477;1–429 |
| 17659 | 1–475;1–461 |
| 17660 | 1–314;1–305;1–246 |
| 17661 | 1–400;21–243 |
| 17662 | 1–443;1–71 |
| 17665 | 1–200;1–200;1–199 |
| 17666 | 1–461;1–509 |
| 17667 | 1–472;1–483 |
| 17668 | 1–416;5–248 |
| 17669 | 1–251;1–247;1–255 |
| 17671 | 1–472;1–493;1–478 |
| 17673 | 1–485;1–440;1–420;1–482;1–449;1–467;1–499;1–216;1–481;1–368;1–270;1–500;1–499;1–473 |
| 17674 | 1–485;1–216;1–440;1–481;1–420;1–368;1–482;1–495;1–270;1–449;1–473;1–467 |
| 17675 | 1–274;6–435 |
| 17676 | 1–475;1–286 |
| 17677 | 1–217;10–116 |
| 17678 | 1–306;1–306;1–268;1–293;1–306;1–307 |
| 17679 | 1–547;1–462;1–419;1–217;1–455;1–464;1–490;1–430;1–464 |
| 17680 | 1–329;1–327;1–433 |
| 17681 | 1–449;1–100;1–497;1–483;1–476 |
| 17682 | 1–449;1–100;1–483;1–510;1–476 |
| 17683 | 1–103;1–160;1–115;1–100;1–112;1–151;1–81 |
| 17685 | 1–339;1–339;69–410 |
| 17686 | 1–216;1–220 |
| 17688 | 1–378;1–392;1–491;1–400 |
| 17689 | 1–476;1–275;1–393 |
| 17692 | 1–429;1–447 |
| 17693 | 1–426;1–446 |
| 17694 | 1–384;46–386 |
| 17695 | 1–428;1–295 |
| 17697 | 1–213;1–249;1–241 |
| 17698 | 1–213;4–245 |
| 17700 | 1–531;1–504;1–484 |
| 17702 | 1–448;18–219;20–105;23–231 |
| 17703 | 1–265;7–387;8–217 |
| 17704 | 1–290;1–443 |
| 17705 | 1–474;1–474;1–371;1–402 |
| 17706 | 1–132;1–140;1–143;1–143;1–143;1–143;1–132;1–143;1–143;1–140;1–143;1–140;1–143;1–143;1–143;1–141;1–143;1–140;1–143;1–140;1–140;1–143;1–143;1–143;1–143;1–140;1–143;1–132;1–143;1–143 |
| 17707 | 1–460;1–465;1–536;1–454;2–305 |
| 17710 | 1–218;1–229;1–229;1–229;1–222;1–218;1–214;1–229;1–216;1–229;1–228;1–230;1–216;1–212;1–218;1–216;1–230;1–229;1–229;1–174;1–229;1–229;1–194;1–215;1–230;1–229;1–229;1–229;1–229;1–229;1–229;1–229;1–226;1–199;1–163;1–214;1–229;1–221;1–228;1–229;1–229;1–229;1–229;1–219;1–229;1–229;1–229;1–218;1–217 |
| 17711 | 1–489;1–398 |
| 17712 | 1–360;1–484;1–460;1–440;1–322;1–539;1–438;1–296;1–326;1–442;1–424;1–137;1–372;1–419;1–422;1–566;1–484;1–105;1–438;1–508;1–275;1–277;1–438;1–438;1–397 |
| 17714 | 1–477;1–483 |
| 17715 | 1–71;1–173;1–71;1–71;1–223;1–71;2–104 |
| 17716 | 1–71;1–173;1–71;1–71;1–71;1–72–104;5–536 |
| 17717 | 1–378;1–329;1–420;1–412;1–426;2–420;3–428;3–439;3–437;3–412;3–436;3–438;3–425;3–420;3–303;3–439;3–436;3–422;3–405;3–217;3–361;3–424;3–424;3–426;3–426;3–428;3–422;3–417;3–437;5–435;5– |

TABLE II-continued (Tiling path)

| Seq Id No. | Positions of biological 5'ESTs |
|---|---|
| | 426;5–434;5–330;5–435;5–431;13–428;13–417;14–418;14–307;14–326;14–424;14–421;14–420;14–421;14–412;14–436;14–426;15–438;15–435;15–88;15–328;15–425;15–435;15–88;15–436;15–421;15–88;15–88;16–437;16–426;16–438;16–418;16–437;16–420;16–438;16–417;16–121;16–440;16–421;16–424;16–432;16–396;16–437;16–420;16–423;16–434;16–440;16–335;16–422;16–428;16–438;17–403;20–393;20–412;20–420;20–423;20–437;20–424;20–427;20–437;20–414;20–436;20–420;20–439;20–424;20–423;20–438;20–436;20–437;20–424;20–424;20–440;20–437;20–420;20–422;20–426 |
| 17719 | 1–241;1–86;7–121;7–473 |
| 17720 | 1–265;1–265;1–265;1–252;1–255;1–265;1–248;1–265 |
| 17721 | 1–448;1–424 |
| 17722 | 1–213;1–69;1–265;1–350;1–213;1–306;1–220;1–266;1–207;1–327;1–398;1–208;1–319;1–288;1–176;1–332;1–213;1–196 |
| 17723 | 1–349;23–405 |
| 17724 | 1–436;1–470;1–499 |
| 17725 | 1–294;1–497;1–490 |
| 17726 | 1–60;1–60;1–60;1–60;1–60;1–58;1–60 |
| 17728 | 1–338;1–463;1–366;1–463;1–311;1–490;1–381;1–489;1–405;1–298;1–352;1–393 |
| 17731 | 1–432;1–438 |
| 17733 | 1–129;1–122;1–123 |
| 17734 | 1–486;1–470 |
| 17735 | 1–403;1–477;1–410;1–498 |
| 17736 | 1–64;1–68;1–64;1–64 |
| 17737 | 1–382;1–210 |
| 17738 | 1–512;1–322;1–483;1–455 |
| 17739 | 1–494;1–516 |
| 17740 | 1–453;1–491 |
| 17741 | 1–319;1–166;1–362 |
| 17742 | 1–430;1–402;1–502;1–462;1–490;1–392;1–452;1–213;1–262;28–408 |
| 17743 | 1–102;1–102;1–102;1–102;1–102;1–102;1–102;1–102 |
| 17744 | 1–116;1–149 |
| 17745 | 1–393;1–432 |
| 17746 | 1–459;1–440 |
| 17747 | 1–97;1–93;1–93;1–93;1–93;1–93;1–93;1–93;1–97;1–93;1–93;1–93;1–97;1–97;1–97;1–97;1–93;1–93;1–93;1–93;1–97 |
| 17748 | 1–264;1–388;1–378;1–395;1–386;1–400;1–400;1–399;1–401;1–394;1–401;1–399;1–400;1–395;1–400;1–376;1–400;1–400;1–401;1–374;1–355;1–393;1–400;1–401;1–386;1–240;1–395;1–343;1–400;1–377;1–187;1–399;1–387;1–391 |
| 17749 | 1–393;1–106;1–201;1–281;1–462;1–281;1–230;1–396;1–444;2–203 |
| 17750 | 1–190;1–410 |
| 17751 | 1–120;1–495;1–493;1–462;1–477 |
| 17752 | 1–131;1–129;1–131 |
| 17758 | 1–502;1–477;1–468;1–380;1–443;1–411;1–397;1–374;1–517;1–516;2–437 |
| 17759 | 1–236;1–236 |
| 17760 | 1–448;1–495 |
| 17761 | 1–196;35–522 |
| 17764 | 1–479;1–309;1–405;1–446;1–416;1–501 |
| 17768 | 1–431;1–103;1–111;1–115;1–331;2–115 |
| 17769 | 1–510;1–167 |
| 17770 | 1–472;1–459;1–491;1–451 |
| 17771 | 1–455;1–452 |
| 17772 | 1–418;1–285 |
| 17773 | 1–486;1–470;1–411 |
| 17774 | 1–399;1–355;1–390;1–412;1–362;1–387;1–390;1–390;1–389;1–291;1–400;1–413;1–390;1–399;1–393;1–398;1–306;1–399;1–399;1–387;1–399;1–390;1–347 |
| 17775 | 1–414;55–229;55–395;55–379;55–196 |
| 17776 | 1–282;1–285;1–266;1–282;1–282;1–175;1–282;1–271;1–281;1–279;1–269 |
| 17777 | 1–123;1–123;1–123 |
| 17778 | 1–421;1–449;1–458 |
| 17779 | 1–463;1–498 |
| 17780 | 1–419;5–69;5–446 |
| 17781 | 1–337;1–348 |
| 17782 | 1–392;1–390 |
| 17783 | 1–414;1–469;1–469 |
| 17784 | 1–196;1–212 |
| 17785 | 1–481;1–388 |
| 17786 | 1–441;2–251;2–51;4–187 |
| 17787 | 1–428;1–483 |
| 17789 | 1–553;1–455;1–490;1–491 |
| 17790 | 1–414;1–424 |
| 17791 | 1–451;4–358;11–501 |
| 17793 | 1–303;1–344;1–517;1–471 |
| 17794 | 1–253;1–85 |
| 17795 | 1–419;43–294;91–152 |
| 17796 | 1–349;1–347;1–360;1–336;1–347;1–357;1–343;1–347;1–347;1–360;1–339;1–360;1–346;1–347;1–360;1–281;1–360;1–354;1–353;1–360;1–344;1–360;1–360;1–360;1–180;1–347;1–360;1–360;1–347;1–360;1–345;1–360;1–360;1–340;1–359;1–360;1–360;1–349;1–360;1–347;1–360;1–364;1–362;1–345;1–326;1–346;1–360;1–347;1–351;1–360;1–364;1–360;1–358;1–347;1–347;1–364;1–360;1–359;1–360;1–360;1–359;1–360 |
| 17797 | 1–399;1–504 |
| 17799 | 1–434;1–437;1–192;1–449;1–490;1–525;1–402;1–490;1–446;1–509;1–490;1–466;1–468;1–419 |
| 17801 | 1–234;1–385;1–506;4–354 |
| 17802 | 1–459;1–395 |
| 17803 | 1–410;1–374;1–405;1–395;1–380;1–408;1–411;1–391;1–321;1–385;1–409;1–413;1–369;1–396;1–223;1–395;1–398;1–413 |
| 17804 | 1–477;1–425 |
| 17805 | 1–410;1–426 |
| 17806 | 1–292;1–365 |
| 17807 | 1–301;1–309;1–314;1–284 |
| 17808 | 1–386;4–432 |
| 17809 | 1–324;1–441 |
| 17810 | 1–285;1–374 |
| 17811 | 1–417;1–60;1–416;1–417;1–162;1–365;1–419;1–435;1–396;1–417;1–417 |
| 17813 | 1–429;1–434 |
| 17815 | 1–485;1–443;1–412;1–507;1–492;1–469;1–573 |
| 17817 | 1–392;1–269;1–485;1–416;1–475;1–495;1–109;1–482;5–287;5–82 |
| 17820 | 1–483;1–397;1–480;1–505;1–493;1–296;1–424;1–442;1–502;1–317;1–491;1–479;1–485;1–306;1–542;1–507;1–466;1–441;1–415;1–443;1–480;1–491;1–519;1–474;1–315;1–109;1–411;1–472 |
| 17821 | 1–138;1–269 |
| 17825 | 1–282;1–282;1–282 |
| 17827 | 1–407;1–444;1–235 |
| 17828 | 1–329;32–178;32–111;32–178;32–108 |
| 17829 | 1–464;1–415;50–449 |
| 17830 | 1–314;127–394 |
| 17831 | 1–333;1–309;1–388 |
| 17832 | 1–396;1–392 |
| 17833 | 1–428;2–427;34–445 |
| 17834 | 1–401;10–374;10–227;10–90;10–515 |
| 17835 | 1–453;1–452;1–449;1–452 |
| 17836 | 1–377;1–342;1–365;1–373 |

TABLE II-continued (Tiling path)

| Seq Id No. | Positions of biological 5'ESTs |
|---|---|
| 17837 | 1–290;1–306;1–308;1–308;1–307;1–295;1–305 |
| 17838 | 1–451;1–419;1–337;1–450 |
| 17839 | 1–381;1–349 |
| 17840 | 1–421;38–400 |
| 17841 | 1–416;1–53 |
| 17842 | 1–428;1–428 |
| 17843 | 1–468;1–472;1–490;1–460;1–543 |
| 17844 | 1–420;1–432 |
| 17845 | 1–257;1–257;1–257;1–179;1–257;1–257;1–257;1–185;1–254;1–257;1–257;1–257 |
| 17846 | 1–383;29–387 |
| 17847 | 1–343;1–343;1–339;1–343;1–313;1–343;1–343;1–343;1–343;1–343;1–343;1–314;2–299 |
| 17848 | 1–514;1–608 |
| 17849 | 1–269;1–245 |
| 17850 | 1–346;1–335;1–319;1–119;1–333;1–347;1–346;1–327;1–346;1–333;1–330;1–211;1–345;1–330;1–341;1–330;1–334;1–332;1–347;1–346;1–327;1–322;1–347;1–320;1–346;1–326;1–330;1–178;1–326;1–335;1–330;1–337;1–336;1–328;2–340;2–196;2–330;2–335;2–347;2–335;2–117;2–327;2–323;7–320;7–321 |
| 17852 | 1–407;153–585 |
| 17853 | 1–541;1–435;1–561 |
| 17855 | 1–180;1–181;1–181;1–182 |
| 17856 | 1–366;1–436 |
| 17857 | 1–377;1–382;1–405;105–368;157–378 |
| 17859 | 1–181;1–379;1–397;1–267 |
| 17862 | 1–414;1–283 |
| 17865 | 1–401;5–303 |
| 17869 | 1–349;1–344;1–345 |
| 17870 | 1–122;1–87;1–113;1–89 |
| 17873 | 1–433;1–350;1–355;1–470;1–425;1–463 |
| 17874 | 1–307;1–366;1–378;1–379;1–333;1–343;1–379 |
| 17876 | 1–422;1–430 |
| 17877 | 1–201;1–201;1–201 |
| 17878 | 1–512;1–496 |
| 17879 | 1–411;1–408;1–420;1–179;1–420;1–411;1–411;1–420;1–420;1–405;1–411;1–149;1–411;1–358;1–407;1–346;1–334 |
| 17881 | 1–378;1–294;24–493;36–423;39–492;39–408;39–481;39–482;59–448;59–479;59–477;60–481;60–467;60–448;60–435;60–482;60–478;60–494;60–492;60–504;60–200;60–501;60–469;60–483;60–410;60–490;60–478;60–501;60–388;60–358;60–477;60–481;60–487;61–486;61–493;61–480;61–203;61–501;61–451;61–493;61–501;61–472;61–494;61–495;61–422;61–445;61–482;61–444;61–500;61–493;61–472;61–496;61–468;61–492;61–480;61–485;61–469;61–438;61–487;61–485;61–477;61–483;61–432;61–476;61–435;61–504;61–501;61–495;61–406;61–503;61–482;61–503;61–356;61–278;61–475;61–478;61–493;61–430;61–501;61–493;61–492;61–489;61–497;61–496;61–482;61–484;61–473;61–473;61–459;61–503;61–478;61–314;61–306;61–481;61–481;61–450;61–493;61–434;61–504;61–488;61–425;61–499;61–493;61–456;61–358;61–501;61–499;61–448;61–478;61–445;61–480;61–499;61–483;61–493;61–478;61–367;61–493;61–476;61–484;61–373;61–480;61–355;61–496;61–424;63–470;65–351;65–482;65–469;65–416;65–486;65–482;70–485;75–491;75–480;82–263;82–442;82–494;82–479;82–482;96–487;198–469;361–493 |

TABLE II-continued (Tiling path)

| Seq Id No. | Positions of biological 5'ESTs |
|---|---|
| 17882 | 1–294;60–200;61–203;61–278;61–314;61–306;75–532;75–565;75–636;82–263 |
| 17883 | 1–438;1–427;2–354;2–144;2–425;2–370;2–413;2–431;2–421;2–434;3–425;3–422;3–422;3–302;3–426;4–432;4–411;4–458;4–445;4–449;4–332;4–445;4–392;4–423;4–463;4–436;4–421;5–389;5–374;5–437;5–388;5–424;5–147;5–416;5–426;5–395;5–437;5–300;5–445;5–416;5–440;5–439;5–421;5–444;5–366;5–430;5–431;5–437;5–440;5–412;5–424;5–459;5–429;5–413;5–382;5–436;5–429;5–451;5–445;5–376;5–379;5–420;5–350;5–439;5–449;5–447;5–426;5–447;5–394;5–427;5–419;5–422;5–437;5–445;5–447;5–437;5–436;5–438;5–441;5–417;5–426;5–472;5–428;5–433;5–417;5–403;5–444;5–422;5–258;5–250;5–425;5–425;5–222;5–378;5–437;5–449;5–424;5–422;5–443;5–437;5–400;5–432;5–420;5–443;5–302;5–392;5–389;5–428;5–437;5–427;5–422;5–311;5–437;5–443;5–369;5–368;5–440;5–299;5–444;5–424;5–317;7–414;9–430;9–360;9–295;9–413;9–426;9–426;14–429;19–424;19–435;26–386;26–207;26–438;26–423;26–426;40–431;142–413;305–437 |
| 17887 | 1–376;1–433;1–433;1–422;1–422;1–427;1–433;1–422;3–393 |
| 17888 | 1–482;1–486;1–485;1–494 |
| 17889 | 1–473;1–478 |
| 17890 | 1–462;1–460 |
| 17891 | 1–60;1–93;1–148;1–132;1–183 |
| 17892 | 1–426;23–143;42–270;44–245;45–284;60–204;60–193 |
| 17893 | 1–399;1–391 |
| 17894 | 1–510;1–80;1–447;1–519 |
| 17896 | 1–353;1–348;1–352;1–424;1–352;1–352;1–348;1–367;1–353;1–352;1–422;1–340;1–407;1–232;1–354 |
| 17897 | 1–354;1–261;1–448;1–289;15–435;29–413 |
| 17898 | 1–424;31–484;31–398 |
| 17899 | 1–353;1–501;1–361;1–362 |
| 17900 | 1–288;1–288;1–288 |
| 17901 | 1–402;56–198 |
| 17902 | 1–143;1–380 |
| 17903 | 1–360;1–483;1–417;1–342 |
| 17904 | 1–258;1–248 |
| 17905 | 1–237;10–268;25–259;25–296;25–348;25–453;25–131;25–117 |
| 17911 | 1–93;1–93;1–93;1–93 |
| 17912 | 1–461;1–487;1–500;1–369 |
| 17913 | 1–69;1–102;1–113;1–114;1–113;1–93;1–114;1–114;1–113;1–117;1–113;1–114;1–113;1–112;1–117;1–113;1–113;1–114;1–114;1–113;1–113;1–114;1–114;1–113;1–113;1–113;1–114;1–106;1–113;1–114;1–114;1–114;1–113;1–113;1–100;1–114;1–114;1–114;1–106;1–100;1–114;1–113;1–113;1–113;1–113;1–114;1–114;1–114;1–114;1–113;1–114;1–113;1–95;1–113;1–113;1–114;1–114;1–114;1–113;1–114;1–113;1–113;1–114;1–114;1–114;1–100;1–114;1–113;1–103;1–114;1–114;1–113;1–94;1–114;1–100;1–112;1–114;1–114;1–105;1–113;1–100;1–114;1–114;1–114;1–114;1–113;1–114;1–113;1–114;1–94;1–113;1–113;1–114;1–100;1–114;1–114;1–114;1–114;1–113;1–114;1–114;1–114;1–114;1–79;1–114;1–114;1–101;1–113;1–113;1–114;1–113;1–113;1–114;1–114;1–100;1–108;1–113;1–117;1–113;1–104;1–114;1–113;1–113;1–114;1–113;1–114;1–114;1–113;1–113;1– |

TABLE II-continued (Tiling path)

| Seq Id No. | Positions of biological 5'ESTs |
|---|---|
|  | 113;1–114;1–114;1–113;1–114;1–114;1–114;1–113;1–114;1–114;1–114;1–114;1–114;1–114;1–114;1–113;1–113;1–100;1–113;1–113;1–117;1–113;1–102;1–114;1–114;1–113;1–114;1–113;1–114;1–104;1–112;1–96;1–114 |
| 17915 | 1–353;4–481 |
| 17916 | 1–252;1–476;1–486;1–546 |
| 17917 | 1–252;57–512 |
| 17919 | 1–146;1–105;1–201;1–176;1–207;1–206;1–197 |
| 17950 | 1–441;1–460;1–465;1–520;1–385;1–371;1–461 |
| 17951 | 1–411;1–444 |
| 17952 | 1–446;1–445;1–415;1–459;1–479;1–473;1–447;1–489 |
| 17953 | 1–495;1–383 |
| 17954 | 1–437;1–258 |
| 17955 | 1–538;1–490 |
| 17956 | 1–215;1–214;1–214;1–219;1–213;1–214 |
| 17957 | 1–487;1–392;1–338 |
| 17958 | 1–395;1–298;1–400 |
| 17959 | 1–440;1–409 |
| 17960 | 1–478;1–401;1–459;1–445;1–360;1–457;1–410 |
| 17961 | 1–427;1–59 |
| 17962 | 1–385;1–376 |
| 17967 | 1–437;1–429;1–416;1–431;1–414;1–429;1–468;1–226 |
| 17968 | 1–483;1–519 |
| 17969 | 1–358;1–74;1–412 |
| 17970 | 1–226;1–232;1–226;1–225;1–226;1–226;1–232;1–226;1–226;1–226;1–226;1–226;1–226;1–226;1–232;1–227;1–226;1–181;1–205;1–226;1–226;1–226;1–220;1–226;1–226;1–226;1–226;1–204;1–226;1–227;1–226;1–214;1–226;1–226;1–226;1–226;1–226;1–226;1–226;1–226;1–226;1–226;1–226;1–232;1–226;1–226;1–228;1–226;1–226;1–226;1–226;1–226;1–226;1–226;1–205;1–226;1–226;1–226;1–226;1–226;1–226;1–223;1–226;1–218;1–226;1–226;1–226;1–226;1–214;1–226;1–226;1–226;1–213;1–226;1–226;1–226;1–226;1–226;1–226;1–226;1–226;1–226;1–155;1–232;1–226;1–232;1–215;1–226;1–232;1–226;1–226;1–226;1–226;1–226;1–232;1–225;1–226;1–226;1–225;1–226;1–226;1–204;1–213;1–226;1–226;1–226;1–192;1–226;1–167;1–226;1–232;1–226;1–226;1–227;1–227;1–226;1–226;1–226;1–226;1–226;1–226;1–186;1–226;1–226;1–226;1–226;1–226;1–226;1–213;1–226;1–207;1–226;1–213;1–184;1–196;1–226;1–226;1–226;1–232;1–226;1–223;1–226;1–226;1–226;1–226;1–213;1–221;1–226;1–226;1–226;1–226;1–226;1–226;1–195;1–223;1–226;1–226;1–156;1–227;1–226;1–226;1–226;1–226;1–225;1–215;1–226;1–22 |
| 17971 | 1–68;1–68;1–68;1–68 |
| 17972 | 1–336;1–326;3–138;3–137 |
| 17973 | 1–140;1–450;1–456;1–441;1–480;1–419;1–440;1–459;1–224;2–385;2–141;2–294;2–503;2–495;17–233;17–472;17–316;17–429 |
| 17974 | 1–221;1–137;2–382;2–138;2–291;2–472;17–230;17–313 |
| 17975 | 1–478;1–468 |
| 17976 | 1–445;1–437;1–420;1–446;1–480;1–381 |
| 17977 | 1–224;1–140;2–435;2–387;2–141;2–296;17–229;17–318 |
| 17978 | 1–361;1–355;1–383;1–427;1–381;1–371;1–348 |
| 17979 | 1–430;1–164;1–383;1–444;1–215;1–391;1–508 |
| 17980 | 1–382;1–315;6–181;21–483;21–370;21–266;21–510;21–504;21–384 |
| 17981 | 1–382;1–315;1–464;6–181;21–370;21–266;21–383 |
| 17982 | 1–442;1–426;1–404 |
| 17983 | 1–178;1–176;1–176;1–176;1–176;1–178;1–176;1–176;1–178;1–176;1–178;1–176;1–176;1–178;1–176;1–176;1–176;1–176;1–176;1–176;1–178 |
| 17984 | 1–388;66–517;66–532 |
| 17985 | 1–436;2–456;7–294 |
| 17986 | 1–62;1–50;1–63 |
| 17987 | 1–138;1–118 |
| 17988 | 1–273;1–281;1–289;1–304;1–304;1–304;1–292;1–304;1–292;1–291;1–186;1–173;1–292 |
| 17989 | 1–368;1–379;1–368;1–366;1–368;1–357;1–368;1–335;1–380;1–365;1–57;1–368;1–366;1–368;1–379;1–334;1–366;1–367;1–366;1–364;1–366;1–378;1–256;1–368;1–381;1–181 |
| 17990 | 1–116;5–133;5–212;100–208 |
| 17991 | 1–387;1–271;35–253 |
| 17992 | 1–343;1–346;1–419 |
| 17993 | 1–439;6–293 |
| 17994 | 1–443;1–421;1–469 |
| 17995 | 1–443;1–446;1–461 |
| 17996 | 1–352;1–232 |
| 17997 | 1–261;1–276;1–284;1–284;1–287;1–271 |
| 17999 | 1–317;1–295 |
| 18000 | 1–446;31–446;54–434;54–427;54–316 |
| 18006 | 1–322;1–181;1–307 |
| 18008 | 1–426;1–484 |
| 18009 | 1–426;1–472 |
| 18010 | 1–190;1–192;1–81;1–192;1–195;1–198;1–192;1–192;1–198;1–192;1–192;1–86;1–192;1–192;1–192;1–192 |
| 18011 | 1–456;1–497 |
| 18012 | 1–170;1–189 |
| 18013 | 1–375;1–365 |
| 18014 | 1–484;1–487;40–500;40–489 |
| 18015 | 1–136;1–484;1–469;1–455;1–132 |
| 18016 | 1–440;1–442;1–436;1–429 |
| 18017 | 1–54;1–71 |
| 18023 | 1–70;1–267 |
| 18024 | 1–71;15–505;15–434 |
| 18025 | 1–333;1–341;1–339;1–331 |
| 18026 | 1–451;1–298;1–415 |
| 18029 | 1–425;1–324;1–335 |
| 18031 | 1–345;1–476;1–521;1–393;1–422;1–515 |
| 18032 | 1–424;55–396;55–416 |
| 18033 | 1–474;1–456 |
| 18034 | 1–191;1–191 |
| 18035 | 1–206;1–205;1–205 |
| 18036 | 1–381;1–380;1–380;1–380;1–381 |
| 18037 | 1–208;1–111 |
| 18038 | 1–67;3–67 |
| 18039 | 1–145;1–145 |
| 18040 | 1–389;1–386 |
| 18041 | 1–241;1–245;1–241;1–241;1–242;1–242;1–221 |
| 18044 | 1–91;35–85 |
| 18045 | 1–86;1–85;1–86 |
| 18046 | 1–231;1–433 |
| 18048 | 1–106;1–105 |
| 18049 | 1–316;1–304;1–318;1–317 |
| 18050 | 1–219;1–363;1–219;1–324;1–78;9–219;9–218;9–219;9–102;12–284;79–263 |
| 18052 | 1–58;1–334;1–82;1–454;1–416;1–447 |
| 18053 | 1–468;1–477 |
| 18055 | 1–73;1–74 |
| 18056 | 1–93;1–125 |

TABLE II-continued (Tiling path)

| Seq Id No. | Positions of biological 5'ESTs |
|---|---|
| 18057 | 1–167;1–166 |
| 18059 | 1–381;1–444;1–472;2–477;3–450;3–436 |
| 18060 | 1–453;1–488;1–487;63–552;63–537;63–529;63–525;63–515;63–528 |
| 18064 | 1–438;1–443 |
| 18067 | 1–375;1–393;1–392;1–393 |
| 18070 | 1–427;1–415 |
| 18073 | 1–482;59–257;59–145;68–373;68–518;68–386;68–441 |
| 18074 | 13–162;13–133;19–193;19–180;19–180;19–153;19–183;19–124;19–193;19–192;19–174;19–193;19–183;19–193;19–172;19–198;19–193;19–180;19–193;19–164;19–193;19–192;19–198;19–198;19–185;19–174;19–184;19–193;19–193;19–193;19–180;19–192;19–148;19–192;19–188;19–180;19–193 |
| 18077 | 1–208;1–208;1–304 |
| 18078 | 1–482;1–66 |
| 18079 | 1–83;1–83;1–83;1–88;1–83;1–88;1–57;1–83;1–88;1–83;1–83;1–88;1–83;1–88;1–88;1–88;1–88;1–88 |
| 18080 | 1–449;1–458 |
| 18081 | 1–279;1–453;1–503;1–512;1–423;1–243;1–321;1–485;1–241;1–296;1–369;1–512 |
| 18082 | 1–114;1–122;1–217 |
| 18083 | 1–425;1–475 |
| 18085 | 1–211;1–211;1–210;1–210;1–123;1–211;1–211;1–210;1–208;1–211;1–211;1–210;1–211;1–210;1–211;1–211;1–143;1–210;1–210;1–210;1–211;1–210;1–211;1–211;1–210;1–211;1–197;1–211;1–210;1–179;1–210;1–210;1–211;1–211;1–210;1–211;1–210;1–220;1–211;1–210;1–210;1–210;1–211;1–210;1–211;1–210;1–211;1–210;1–210;1–211;1–211;1–210;1–211;1–211;1–210;1–210;1–210;1–210;1–210;1–211;1–211;1–210;1–211;1–211;1–210;1–210;1–210;1–211;1–211;1–210;1–210;1–210;1–211;1–210;1–211;1–212;1–211;1–210;1–211 |
| 18086 | 1–456;11–396;11–397 |
| 18089 | 1–256;1–257;1–259;1–255;1–257;1–257;1–257 |
| 18090 | 1–86;1–87;1–87 |
| 18092 | 1–480;1–333 |
| 18093 | 1–373;1–426;1–385 |
| 18094 | 1–375;1–312;1–375;1–415;1–473;1–415;1–415 |
| 18095 | 1–367;1–345;1–448;1–327 |
| 18096 | 1–188;1–188;1–188;1–188;1–187;5–193 |
| 18097 | 1–188;1–189;1–189;1–189;1–70;1–189;1–189 |
| 18098 | 1–378;1–411 |
| 18099 | 1–78;1–103 |
| 18100 | 1–298;1–312;1–298 |
| 18102 | 1–63;1–56 |
| 18107 | 1–620;1–54 |
| 18108 | 1–505;399–824 |
| 18111 | 1–448;1–467;1–414;1–482;3–360 |
| 18112 | 1–416;1–424 |
| 18113 | 1–449;1–507 |
| 18115 | 1–497;1–395;1–495 |
| 18116 | 1–103;1–467;131–408 |
| 18119 | 1–426;1–471;1–421;1–125;4–436;4–509;4–461;4–467;4–473;4–401;4–457;4–369;4–451;10–407;10–334;10–489;10–462 |
| 18120 | 1–403;1–395 |
| 18121 | 1–364;1–376;1–423;1–234;1–422;1–368;1–493;1–442 |
| 18122 | 1–56;1–62 |
| 18123 | 1–347;1–166;1–366 |
| 18124 | 1–69;1–69;1–69;1–69;1–69;1–69;1–69;1–69 |
| 18125 | 1–372;1–368 |
| 18126 | 1–362;1–139;1–361;1–390;1–352;1–361;3–350;3–398;3–334;3–365;3–398;3–55;3–368;3–164;3–164;3–409;3–340;5–388;5–362;5–362;5–389;5–164;5–361;5–412;5–403;5–350;5–412;5–325;5–350;5–359;5–387;5–397;5–293;5–388;5–338;5–398;6–399;12–399;12–412;12–412;12–389;12–412;12–412;12–354;12–280;12–146;12–379 |
| 18127 | 1–488;1–380;1–466;1–436;1–366 |
| 18129 | 1–452;1–458;1–486 |
| 18130 | 1–190;1–190;1–190;1–190;1–190;1–190;1–190;1–190;1–190;1–190;1–190;1–190;1–190;1–192;1–192;1–190;1–190;1–190;1–190;1–190;1–190;1–66;1–190;1–190;1–190;1–190;1–190;1–190;1–190;1–190;1–190;1–190;1–190;1–190;1–190;1–190;1–190;1–190;1–190;1–192;1–190;1–190;1–190;1–190;1–190;1–190;1–190;1–192;1–190;1–190;1–190;1–190;1–190;1–190;1–190;1–190;1–190;1–190;1–190;1–190;1–190;1–190;1–190;1–190;1–190;1–190;1–190;1–190;1–190;1–190;1–190;1–190;1–190;1–190;1–190;1–192;1–190;1–190 |
| 18131 | 1–314;1–309 |
| 18132 | 1–405;1–202;1–420;1–433;1–280;1–420;1–444;1–510;1–489;1–401;2–502;18–454;18–485;18–505;18–329;18–490;18–450;18–499;19–519;19–405;19–434;46–442;58–319;91–493;111–447 |
| 18133 | 1–56;1–394;1–386;1–324 |
| 18134 | 1–65;1–68;1–65;1–68;1–68;1–65 |
| 18136 | 1–432;1–446 |
| 18138 | 1–263;1–368;1–410 |
| 18139 | 1–163;1–249;1–348;1–162;1–349;1–347;1–352;1–355;1–356;1–349 |
| 18173 | 1–331;1–326;1–328;1–329;1–327;1–330 |
| 18174 | 1–449;67–501;67–501;67–599;93–495;95–624;95–583;95–497;95–348;95–608;95–560;95–470;95–470;95–484;95–599;95–336;95–691;95–563;95–599;95–44;96–385;96–631;96–563;96–599;96–524;96–501;96–599;96–549;96–470;96–496;96–655;96–476;96–563;96–604;96–495;96–599;96–563;96–582;96–470;96–682;96–549;96–558;96–487;96–414;96–624;96–365;96–547;96–599;96–609;96–496;96–582;96–599;96–377;96–629;96–563;96–183;96–560;96–563;96–653;96–563;96–607;96–631;96–599;96–563;96–404;96–496;96–472;96–626;96–705;96–609;96–630;96–630;96–524;96–583;96–631;96–608;96–501;96–599;96–624;96–599;96–492;96–644;96–562;96–549;96–501;96–599;96–563;96–540;96–626;96–676;96–563;96–599;96–401;96–497;96–500;96–599;96–583;96–547;96–472;96–518;96–631;96–563;96–599;96–484;97–679;97–682;97–211;98–549;98–477;98–520;98–583;98–469;98–628;98–351;99–160;99–609;101–549 |
| 18177 | 1–325;17–118;30–169 |
| 18178 | 1–498;1–393;1–474;1–475;1–458;1–458;1–379;1–496;1–458 |
| 18181 | 1–439;3–494 |
| 18182 | 1–347;1–348;1–350;1–329;1–360;1–350;1–206;1–337;1–349;1–352;1–348;1–339;1–349;1–363;1–350;1–340;1–339;1–349;1–348;1–362;1–355;1–349 |
| 18186 | 1–189;1–189 |
| 18189 | 1–141;1–249;6–141 |
| 18190 | 1–472;1–414;1–432;1–492;1–467 |
| 18193 | 1–495;1–354 |
| 18195 | 1–264;1–264;1–252;1–266 |
| 18196 | 1–483;1–537;1–486;1–484;1–357;2–449 |

TABLE II-continued (Tiling path)

| Seq Id No. | Positions of biological 5'ESTs |
|---|---|
| 18199 | 1–512;1–220;1–416;368–420;368–510;368–516;369–435;369–426;369–476;369–462;369–488 |
| 18210 | 1–395;1–487;1–407;1–485 |
| 18212 | 1–429;1–364;1–442 |
| 18218 | 1–466;1–555 |
| 18219 | 1–449;1–466 |
| 18222 | 1–430;1–341 |
| 18223 | 1–408;1–470;1–479;1–347;1–459;1–482;1–503;1–385;1–377;1–443;1–353;1–505;1–489;1–479;1–356;1–452;1–417;1–476;1–347;1–463;1–466 |
| 18224 | 1–343;1–343;1–343;1–339 |
| 18225 | 1–306;50–306 |
| 18226 | 1–443;1–492;1–448;2–71;11–538 |
| 18227 | 1–457;9–474;43–602;59–492;59–641;59–462;59–525;59–411;59–569;59–448;59–534;60–545;60–550;60–581;60–624;60–512;60–542;60–458;60–570;60–288;60–488;60–387;60–449;60–431;60–519;60–503;60–129;60–562;60–445;60–624;60–528;60–538;60–526;60–535;60–625;60–587;60–540;60–560;60–563;60–639;60–550;60–536;61–549;61–497;61–510;61–282;61–561;61–561;61–497;62–462;62–531;62–571;64–624;67–406;69–562;69–571;69–543;69–516;71–550;71–519;71–624;92–601;99–624 |
| 18230 | 1–413;1–437 |
| 18231 | 1–376;1–395 |
| 18232 | 1–63;1–71 |
| 18235 | 1–418;1–345 |
| 18237 | 1–507;227–660 |
| 18238 | 1–251;1–457 |
| 18239 | 1–453;1–330;1–453 |
| 18240 | 1–247;1–163;1–293 |
| 18241 | 1–126;1–402 |
| 18242 | 1–126;1–413 |
| 18245 | 1–418;21–418 |
| 18247 | 1–131;1–103;1–94;1–150 |
| 18248 | 1–60;1–50;1–148;53–133 |
| 18249 | 1–365;1–383 |
| 18251 | 1–581;2–480;2–474;2–501;2–123;2–470;2–513;2–417;2–514;2–327;2–447;2–360 |
| 18252 | 1–359;1–122;1–414;1–326 |
| 18253 | 1–429;1–118 |
| 18254 | 1–443;1–513 |
| 18257 | 1–295;26–438 |
| 18258 | 1–341;1–294;1–334;1–339;1–335;1–340 |
| 18259 | 1–496;1–386 |
| 18260 | 1–444;1–467 |
| 18261 | 1–279;1–348;1–433;1–437;1–577;1–497;1–349;1–321;1–235;1–413;1–324 |
| 18264 | 1–492;1–551 |
| 18265 | 1–507;1–501;1–422;1–319;1–513;1–460;1–478 |
| 18266 | 1–546;1–361;1–477;2–362;8–345;8–345;22–511 |
| 18270 | 1–270;1–249 |
| 18273 | 1–387;1–192 |
| 18274 | 1–169;1–121 |
| 18275 | 1–454;1–592;1–549 |
| 18277 | 1–204;1–204 |
| 18278 | 1–371;1–366;1–363 |
| 18280 | 1–386;1–392;1–359;1–397;1–382;1–397 |
| 18281 | 1–327;1–78;5–143 |
| 18282 | 1–438;1–435 |
| 18283 | 1–490;1–476;43–559;45–509;45–493;45–527;45–509;46–510;47–215 |
| 18284 | 1–339;1–354;1–363;1–354;1–345;1–349;1–361;1–346 |
| 18287 | 1–301;1–458 |
| 18288 | 1–408;80–433 |
| 18289 | 1–402;1–370;1–414;1–415;10–384;10–399;10–391;10–417;10–400;10–405;10–404;10–400;10–386;10–402;10–416;10–417;10–395;11–412;33–399;33–416;33–399;36–313;36–415;36–416;36–277;36–366;36–410;36–398;36–412;52–368;52–400;52–416;52–416;52–401;52–416;52–416;54–406;54–416;54–413;54–418;54–409;54–417;54–413;54–362;54–405;54–401;54–418;54–417;54–416;54–412;54–410;54–417 |
| 18294 | 1–75;1–383;1–400;1–389 |
| 18296 | 1–465;1–311 |
| 18297 | 1–341;1–426;1–376 |
| 18298 | 1–122;1–128 |
| 18300 | 1–474;1–494;1–481;1–474 |
| 18301 | 1–63;1–65;1–65;1–63;1–63;1–63;1–65;1–63;1–65;1–63;1–62;1–65;1–65;1–65;1–63;1–65;1–65;1–65;1–63;1–65;1–63;1–65;1–65;1–65;1–65;1–63;1–63;1–65 |
| 18303 | 1–417;1–519 |
| 18304 | 1–305;1–458;1–408;1–452;1–512;1–482;1–535 |
| 18305 | 1–401;1–335;1–512;1–412 |
| 18307 | 1–196;1–195 |
| 18308 | 1–402;1–502 |
| 18309 | 1–426;1–277 |
| 18310 | 1–487;12–462;12–474 |
| 18315 | 1–362;1–344;1–358 |
| 18316 | 1–472;1–345;1–357 |
| 18318 | 1–189;1–301 |
| 18319 | 1–510;1–184;84–590 |
| 18320 | 1–478;1–431 |
| 18321 | 1–146;1–154 |
| 18322 | 1–430;1–414;1–417;1–425;1–334;1–416;1–424;1–413;1–190;1–421;1–432;1–436;1–417;1–417;1–434;1–425;1–429;1–421;1–420;1–433;1–413;1–430;1–436;1–397;1–421 |
| 18323 | 1–517;1–476;1–471;1–497 |
| 18324 | 1–440;1–461 |
| 18325 | 1–398;1–399;1–382;1–92;1–393;1–146;1–399;1–399;1–399;1–311;1–399;1–400;1–388;1–400;1–399;1–400;1–400;1–390;1–382;1–375;1–399;1–402;1–399;1–384;1–401;1–383;1–396;1–388;1–400;1–400 |
| 18326 | 1–109;1–109 |
| 18327 | 1–118;1–136;1–136;1–139;1–125;1–122;1–136 |
| 18331 | 1–197;1–267;1–265;1–269;1–283;1–281;1–257;1–279;1–268;1–281;1–269;1–267;1–267;1–280;1–267;1–260;1–280;1–272;1–269;1–267;1–280;1–283;1–264;1–267;1–267;1–267;1–280;1–280;1–267;1–90;1–279;1–267;1–261;1–246;1–267 |
| 18335 | 1–82;1–473 |
| 18336 | 1–468;1–467 |
| 18337 | 1–552;1–386 |
| 18338 | 1–237;1–234;1–234 |
| 18339 | 1–490;40–129 |
| 18340 | 1–493;74–592;74–549 |
| 18342 | 1–52;1–53;1–70;1–66;1–72 |
| 18344 | 1–115;1–112;1–115;1–115;1–115 |
| 18345 | 1–247;1–478;1–437;1–445;1–438;1–452;1–465 |
| 18349 | 1–58;1–71;1–64 |
| 18350 | 1–544;1–455;1–372;1–375;1–454;1–473 |
| 18351 | 1–422;1–436;1–321;1–465;1–425 |
| 18352 | 1–464;3–420 |
| 18353 | 1–415;322–403;322–417 |
| 18354 | 1–446;1–494;1–446;1–442;1–456;1–426;1–495;1–445;1–457;1–442;1–442;1–442;1–446 |

TABLE II-continued

(Tiling path)

| Seq Id No. | Positions of biological 5'ESTs |
|---|---|
| 18357 | 1–165;1–133 |
| 18358 | 1–472;1–521 |
| 18360 | 1–404;1–398;1–377 |
| 18361 | 1–224;1–150;1–138 |
| 18362 | 1–307;25–135;27–150;27–154;27–265;28–272;31–143;31–184;31–184;31–291;31–184;31–92;31–101;31–256;31–167;31–184;31–167;31–143;32–92;32–156 |
| 18364 | 1–309;1–247;2–110;3–240;3–125;3–129;5–321;6–118;6–159;6–159;6–277;6–317;6–159;6–389;6–76;6–67;6–159;6–271;6–276;6–231;6–142;6–307;6–142;6–118;7–67;7–131;7–321;219–291 |
| 18365 | 1–309;1–247;2–110;3–240;3–125;3–129;6–118;6–382;6–159;6–159;6–277;6–315;6–276;6–159;6–76;6–67;6–159;6–307;6–271;6–231;6–142;6–380;6–377;6–142;6–118;7–67;7–131;219–291 |
| 18366 | 1–358;1–342;1–319;1–63;3–72;3–63;158–230 |
| 18372 | 1–239;1–285;1–284;1–261 |
| 18373 | 1–237;1–262;15–264;15–264;15–242;15–263;15–262;15–255;15–255;15–266;15–266;15–248;15–265;15–264;15–266;15–266;15–252;15–264;5–276;15–277;15–279;15–253;15–262;15–269;15–253 |
| 18377 | 1–112;2–116;2–112 |
| 18378 | 1–307;1–460 |
| 18379 | 1–203;1–410;1–436 |
| 18380 | 1–431;1–492;1–484 |
| 18381 | 1–498;1–454 |
| 18384 | 1–89;1–159 |
| 18385 | 1–94;1–97 |
| 18386 | 1–464;1–467;1–468;1–464;1–465;1–93;1–467;1–434;1–361;1–478;1–463 |
| 18387 | 1–244;1–74 |
| 18388 | 1–497;1–459;13–398 |
| 18389 | 1–470;1–485;1–439 |
| 18392 | 1–174;1–421;1–405;1–427;1–275;1–405;1–231;1–238;1–262;1–386;1–323;1–382;1–396;1–418;1–416;1–394;1–385;1–265;1–385;1–385;1–237;1–200 |
| 18394 | 1–487;1–538;1–308;1–478;1–498 |
| 18395 | 1–392;4–224 |
| 18396 | 1–347;1–346;1–348;1–346 |
| 18399 | 1–439;1–419;1–439 |
| 18400 | 1–182;1–183;1–183;1–183;1–183;1–180;1–183;1–183 |
| 18401 | 1–96;1–95;1–95 |
| 18402 | 1–344;1–249;1–355;1–342;1–356;1–355;1–344;1–356;1–354;1–344;1–356;1–355;1–338;1–342;1–339;1–340;1–337 |
| 18403 | 1–137;1–137;1–137;1–137;1–137;1–137;1–137 |
| 18405 | 1–533;1–464;1–120 |
| 18407 | 1–187;1–86 |
| 18408 | 1–503;1–349 |
| 18411 | 1–299;1–359;3–369 |
| 18415 | 1–366;1–361;1–175;1–367;1–366 |
| 18416 | 1–377;1–335 |
| 18417 | 1–512;1–522;1–491 |
| 18419 | 1–403;1–437;1–454;1–278;1–402;1–439;1–363;1–471;1–547;1–439;1–259;1–421;1–489 |
| 18420 | 1–97;1–88 |
| 18421 | 1–226;1–226;1–226;1–228;1–228 |
| 18422 | 1–102;1–100 |
| 18424 | 1–411;1–412 |
| 18426 | 1–143;1–143;1–143 |
| 18428 | 1–110;13–186 |
| 18429 | 1–509;1–377;2–376 |
| 18431 | 1–57;1–93 |
| 18435 | 1–55;1–54 |
| 18438 | 1–61;1–61 |
| 18439 | 1–478;6–149 |
| 18440 | 1–302;1–299 |
| 18441 | 1–464;1–408;1–453 |
| 18446 | 1–253;1–276;1–262;1–278;1–224;1–274;1–275;1–278;1–273;1–278;1–273;1–263;1–265;1–275;1–268;1–278;1–277;1–274;1–277;1–275;1–274;1–267;1–278;1–278;1–267;1–278;1–266;1–275;1–274;1–259;1–262;1–274;1–275;1–85 |
| 18447 | 1–214;1–202;1–213;1–213;1–193;1–213;1–213;1–213;1–206;1–213;1–213;1–213;1–213;1–213;1–213;1–213;1–213;1–213;1–213;1–204;1–214;1–216;1–200;1–213;1–213;1–214;1–214;1–208;1–212;1–213;1–213;1–214;1–214 |
| 18448 | 1–396;1–357 |
| 18449 | 1–387;1–423;1–343;1–410;1–409;1–409;1–138;1–231;1–421;1–425;1–377;1–424;1–394;1–407;1–418;1–424;1–418;1–400;1–407;1–405;1–405;1–407;1–411;1–258 |
| 18450 | 1–379;1–439;1–372;2–325;2–474;2–479;3–515 |
| 18451 | 1–493;1–473;1–379;1–439;1–372;2–325 |
| 18452 | 1–377;1–287;2–368;2–300;2–400;3–416;3–305 |
| 18458 | 1–104;1–148 |
| 18461 | 1–107;1–79;1–107 |
| 18462 | 1–51;1–56;1–56 |
| 18463 | 1–354;1–462;1–443;1–460;1–462;1–462 |
| 18464 | 1–76;1–76;1–76 |
| 18467 | 1–427;1–366 |
| 18471 | 1–410;1–350 |
| 18474 | 1–422;1–422;1–426 |
| 18476 | 1–324;1–316;1–319 |
| 18477 | 1–237;1–223 |
| 18478 | 3–453;3–455;3–448;3–455;3–454;3–454;3–454;3–413;3–375;12–440;12–452;12–413;12–452;12–412;12–451;12–442;24–452;25–434;25–109;25–449;25–449;25–446;25–455;25–448;25–454;25–453;25–455;25–453;25–433;25–436;25–448;25–375;25–415;25–450;25–434;25–454;25–453;25–453;25–453;25–451;25–455;25–434;25–452;25–423;25–451;25–444;25–452;26–452;26–453;26–452;26–453;26–454;26–349;26–447;26–358;26–442;26–452;26–407;26–94;26–454;26–455;26–451;26–415;27–442;27–455;27–478;27–453;27–108;27–450;27–455;27–450;27–443;27–446;27–415;27–454;27–400;27–136;27–445;27–455;27–442;27–436;27–442;27–443;27–474;27–451;27–452;27–432;27–449;27–452;27–446;27–453;27–441;27–448;27–454;27–453;27–454;27–454;27–444;27–404;27–453;27–443;27–452;27–475;27–452;27–403;27–455;27–426;27–375;27–453;27–452;28–448;29–452;29–100;29–453;29–448;29–445;30–449;30–452;30–445;30–282;30–452;30–440;30–441;30–438;30–452;30–452;30–452;30–438;30–449;30–452;30–436;30–136;30–441;30–451;30–411;30–452;30–452;30–451;30–440;30–452;30–438;30–358;30–438;30–446;30–452;30–452;30–40 |
| 18484 | 1–102;1–58 |
| 18485 | 1–398;1–472 |
| 18487 | 1–467;1–157;1–469;1–493;1–493 |
| 18490 | 1–395;1–390;1–393;1–393;1–386;1–405;1–391;1–391;1–385 |
| 18491 | 1–432;1–482;1–680;1–427 |
| 18492 | 1–472;1–482;1–454;1–368;4–416;4–553;4–471;4–132;4–210;4–479;4–271;14–498 |
| 18493 | 1–430;1–460;1–429 |

TABLE II-continued
(Tiling path)

| Seq Id No. | Positions of biological 5'ESTs |
|---|---|
| 18494 | 1–159;4–221;10–338;10–171;11–365;11–407 |
| 18495 | 1–195;1–447;28–441;31–272 |
| 18496 | 1–465;1–451 |
| 18497 | 1–427;1–469;1–402;1–461;1–457;9–106;9–408 |
| 18498 | 1–403;1–422;1–407;35–395 |
| 18500 | 1–370;1–508;1–483;1–314;1–393;1–372;1–438;1–505;1–490;1–478 |
| 18501 | 1–187;1–476 |
| 18505 | 1–498;1–289;1–289;1–433;1–254;1–472;1–396;1–554;1–420;1–499;1–440;1–293 |
| 18507 | 1–490;1–449;1–337;1–495;1–509;1–487;1–516;1–498;1–517;1–429;1–489;1–491;1–479;1–464;1–489;1–358;1–445;1–504;1–363;1–362;1–380;1–430;1–268;1–127;1–516;1–504;1–414;1–269;1–514;1–435;1–477;1–358;1–490;1–563;1–439;1–489;1–359;1–516;1–491;1–502;1–531;1–494;1–491;1–473;1–505;1–493;1–514;1–421;1–463;1–464;1–382;1–377 |
| 18508 | 1–449;1–414;1–269;1–337;1–485;1–435;1–477;1–358;1–439;1–359;1–429;1–479;1–464;1–358;1–445;1–473;1–421;1–463;1–464;1–363;1–382;1–362;1–380;1–377;1–127;1–430;1–268 |
| 18512 | 1–429;1–261;1–464;1–380;1–438;1–452;1–476;1–401;1–445;1–564;1–445;1–450;1–547 |
| 18513 | 1–442;1–450 |
| 18514 | 1–489;1–471;1–488;1–486;1–523;1–493 |
| 18515 | 1–74;1–83;4–160;6–127;8–162;8–96;8–190;8–157;8–111 |
| 18516 | 1–74;1–83;4–160;6–127;8–162;8–186;8–96;8–157;8–111;8–541 |
| 18517 | 1–74;1–83;4–160;6–127;8–357;8–380;8–162;8–188;8–96;8–157;8–111;8–357;8–387 |
| 18518 | 1–74;1–83;4–160;6–127;6–235;8–255;8–513;8–162;8–186;8–96;8–157;8–111;8–246;8–263;8–245;8–267;8–272 |
| 18519 | 1–83;1–74;4–160;6–127;6–403;6–413;7–393;7–391;8–399;8–400;8–384;8–397;8–188;8–357;8–414;8–400;8–96;8–402;8–401;8–401;8–157;8–111;8–393;8–397;8–401;8–391;8–357;8–162;8–412;8–403;8–398;8–390;8–398;8–416;8–402;8–398 |
| 18547 | 1–198;1–434;1–423 |
| 18548 | 1–464;22–432;32–460;32–450;32–369;36–366;54–487;65–489;65–501;65–451;65–509;65–489;65–277;65–488;65–501;65–424;65–502;90–490 |
| 18549 | 61–474;63–408;63–520;64–484;64–328;64–562;64–253;64–534;64–486;64–329;64–330;64–309;64–537;64–262;64–404;64–212;64–402;65–442;75–543;92–532;92–546;92–516;92–528;92–528;92–562;92–186;92–555;92–325;92–499;92–545;92–305;92–336;92–561;92–520;93–563;102–329;102–546;102–528;102–549;103–318;103–547;103–410;103–521;103–429;103–182;103–521;104–182;104–494;104–406;104–386;104–533;104–536;105–430;105–548 |
| 18552 | 1–472;1–464;1–454 |
| 18555 | 1–452;1–509 |
| 18556 | 1–566;1–474 |
| 18557 | 1–462;1–162;1–443;1–368;1–452;1–467 |
| 18558 | 1–488;1–513;1–415 |
| 18559 | 1–417;1–515 |
| 18560 | 1–110;1–468;1–511;1–463;1–356;1–397 |
| 18561 | 1–363;1–363;1–363;1–376;1–366;1–376;1–377;1–375;1–361;1–363;1–360;225–329 |
| 18562 | 1–541;1–384 |
| 18565 | 1–110;1–108;1–108;1–110;1–110;1–108;1–108;1–108;1–108;1–110;1–110;1–110;1–108;1–110 |
| 18566 | 1–429;1–449;1–435 |
| 18567 | 1–479;1–469;1–495;1–427 |
| 18568 | 1–413;1–414 |
| 18574 | 1–179;1–400 |
| 18575 | 1–409;1–484;1–443;1–432;1–334;1–472;1–487;1–433 |
| 18576 | 1–472;1–448;1–499;1–475;1–485;1–461 |
| 18577 | 1–334;28–497;28–419 |
| 18578 | 1–482;1–272;1–494 |
| 18579 | 1–427;38–283 |
| 18581 | 1–410;1–507;1–172;1–499;1–387;1–437 |
| 18584 | 1–394;1–395;1–407;1–262;1–386;1–409;1–395;1–409;1–393;1–390;1–403;1–407;1–397;1–408;1–400;1–409;1–409;1–409;1–394;1–408;1–407;1–394;1–395;1–389;1–404;1–395;1–407;1–408;1–410;1–402;1–407;1–394;1–409;1–409;1–410;1–394;1–410;1–394;1–394;1–407;1–400;1–197;1–408;1–397;1–381 |
| 18590 | 1–498;1–464;1–483;1–422;1–345;1–445 |
| 18591 | 1–140;1–452 |
| 18592 | 1–437;1–449;1–413;1–494;132–584 |
| 18593 | 1–285;1–288;1–288;1–288;1–285;1–288;1–288;1–288;1–288 |
| 18594 | 1–418;1–437;1–385;1–419;1–449 |
| 18596 | 1–217;67–546;218–534;218–553 |
| 18597 | 1–411;1–426;1–437 |
| 18598 | 1–398;1–402;1–319;1–397;1–381;1–386;1–358;1–402;1–387;1–255;1–390;1–405;1–394;1–404;1–404;1–392;1–404;1–404;1–392;1–401;1–386;1–403;1–386;1–354;1–390;1–405;1–386;1–401;1–383;1–387;1–384;1–386;1–405;1–402;1–401;1–403;1–384;1–389;1–383;1–406;1–403;1–402;1–402;1–403;1–396;1–402;1–404;1–378;1–405;1–400;1–389;1–405;1–387;1–77;1–382;1–386;1–369;1–385;1–386;1–383;1–386;1–368;1–391;1–388;1–386;1–387;1–393;1–394;1–403;1–386;1–386;1–386;1–403;1–386;1–404;1–397;1–122;1–398;1–369;1–395;1–388;1–382;1–351;1–404;1–144;1–386;1–90;1–386;1–108;1–402;1–404;1–404;1–385;1–405;1–405;1–386;1–386;1–402;1–384;1–402;1–402 |
| 18599 | 1–327;1–478;1–421;1–497;1–344;1–414;1–461;1–531;1–528;1–340;1–403;1–506;1–521;1–482;1–470;1–512;1–408;1–516;1–497;2–3;62 |
| 18600 | 1–289;27–476;27–426;27–289;27–446;27–516;27–426;27–437;27–515;27–454;28–389 |
| 18601 | 1–445;1–495;1–492;1–440;1–482;1–445;1–387;1–496;1–478;1–319 |
| 18602 | 1–314;1–311 |
| 18603 | 1–433;1–411 |
| 18604 | 1–263;2–419 |
| 18608 | 1–468;1–469;1–454 |
| 18610 | 1–52;2–417 |
| 18612 | 1–333;1–346 |
| 18613 | 1–398;1–480;2–53 |
| 18616 | 1–470;1–483;1–499;1–517;1–480;1–486;1–461;1–446;1–487;1–514;1–514;1–475;1–492;1–499;1–497;1–447;1–457;1–501;1–483 |
| 18619 | 1–483;1–452 |
| 18621 | 1–267;9–471;9–428;9–171;9–472;9–450;9–430;9–492;9–477;9–452;9–440;9–465;9–401;9–477;9–477;9–477;9–490;9–477;9–492;9–468;9–464;9–358;9–419 |
| 18624 | 1–225;1–336;1–296;1–332;1–316;1–335;1–250;1–328;28–336;29–325;29–295;29–479;29–147;29–270;29–298;29–336;29– |

TABLE II-continued (Tiling path)

| Seq Id No. | Positions of biological 5'ESTs |
|---|---|
| | 328;29–314;29–333;29–336;29–322;29–322;29–325;29–295;29–302;29–331;29–328;29–336;29–298;29–322;29–453;36–295 |
| 18625 | 1–224;1–249;29–269;29–405;29–146 |
| 18628 | 1–474;1–363 |
| 18630 | 1–388;1–412;1–423;1–481;2–493 |
| 18631 | 1–471;1–328 |
| 18636 | 1–410;1–433 |
| 18637 | 1–175;1–379;1–489;1–385;1–451 |
| 18638 | 1–192;13–383 |
| 18640 | 1–474;1–474;1–423 |
| 18641 | 1–540;16–489;16–523 |
| 18642 | 1–443;30–189;30–421;30–376;30–357;30–220;30–397;31–262;31–226;31–236;31–386;31–417;31–421;31–178 |
| 18643 | 1–332;1–375;11–459 |
| 18644 | 1–197;1–424 |
| 18645 | 1432;1–330;1–359;1–472;1–162;1–318;1–365;1–384;1–335;1–295;1–415;1–477;1–470 |
| 18649 | 1–462;1–516;1–437;1–444;1–478 |
| 18650 | 1–263;1–263;1–262 |
| 18651 | 1–518;3–327 |
| 18652 | 1–483;1–451;1–452;1–507 |
| 18653 | 1–391;1–66;1–397;1–397 |
| 18654 | 1–170;20–218 |
| 18655 | 1–333;1–361;1–361 |
| 18656 | 1–446;24–507 |
| 18657 | 1–463;202–584;202–581;206–727 |
| 18658 | 1–133;1–325;1–322;1–321;1–322 |
| 18661 | 1–209;1–209;1–209 |
| 18662 | 1–501;1–461;1–501;2–475 |
| 18663 | 1–485;1–458;1–471 |
| 18664 | 1–389;1–384;69–366 |
| 18666 | 1–483;1–425;1–410 |
| 18668 | 1–492;1–495;1–512 |
| 18669 | 1–450;1–552;12–442 |
| 18670 | 1–463;1–391 |
| 18672 | 1–408;2–415;2–426;2–414;2–416;2–225;2–290;2–411;2–225;2–401;2–436 |
| 18674 | 1–265;11–270 |
| 18675 | 1–493;1–424 |
| 18676 | 1–175;1–175;1–175;1–175;1–175;1–179;1–69;1–175;1–175;1–175 |
| 18677 | 1–152;1–405;1–405;1–405;1–405;1–120;1–405;1–405;1–405;1–405;1–405;1–394;1–405;1–405;1–405;1–405;1–405;1–405;1–405;1–405;1–405;1–405;1–405;1–405;1–405;1–405;1–405 |
| 18680 | 1–464;9–498 |
| 18681 | 1–458;1–501 |
| 18682 | 1–448;1–458;1–458 |
| 18683 | 1–358;1–360;1–309;1–350;1–357;1–361;373;1–361;1–340;1–375;1–326;1–361;1–358;1–336;1–344;1–375;1–344;1–361;1–363;1–360;1–350;1–363;1–375;1–240;1–343;1–361;1–376;1–363;1–374;1–358;1–361;1–335;1–374;1–312;1–347;1–377;1–358;1–330 |
| 18685 | 1–492;1–343;1–418;1–476;1–284;1–487;1–466;1–502;1–391;1–64;1–509 |
| 18687 | 1–50;1–446;1–422;1–475;1–480 |
| 18688 | 1–503;1–459 |
| 18691 | 1–56;1–62;1–68;2–63;2–63;2–61;2–63;2–63;2–61;2–63;2–65;2–63;2–65;2–63;2–65;2–63;3–63;3–57;3–63;3–63;3–61;3–63;3–65;3–58;4–63;4–63;5–64;5–60;5–65;5–62;5–63;5–59;5–61;5–63;5–70;5–65;5–63;5–66;5–57;5–61;5–66;5–59;5–63;5–65;5–60;5–63;5–61;5–64;5–63;5–62;5–60;5–61;5–63;5–59;5–63;5–61;5–61;5–59;5–63;5–65;5–65;5–63;5–62;5–63;5–57;5–55;5–66;5–67;5–69;5–63;5–61;5–63;5–60;5–59;5–61;5–63;5–59;5–60;5–63;5–63;5–63;5–61;5–64;5–66;5–68;5–63;5–63;5–61;5–61;5–68;5–62;5–70;5–65;5–63;5–61;5–67;5–59;5–61;5–63;5–63;5–62;5–63;5–68;5–58;6–64;6–66;6–64;6–65;6–63;6–65;6–65;6–65;6–60;6–63;6–68;6–63;6–62;6–62;6–61;6–56;6–63;6–61;6–63;6–62;6–60;7–63 |
| 18706 | 1–425;1–419;1–525 |
| 18721 | 1–341;17–332 |
| 18735 | 1–352;1–328;1–339;1–372;1–323;1–359;1–364;1–372;1–355;1–372;1–371;1–372;1–372;1–372;1–373;1–371;1–374;1–372;1–372;1–359;1–371;1–372;1–372;1–359;1–371;1–360;1–356;1–282;1–100;1–363;1–372;1–354;1–373;1–358;1–360;1–110;1–370;1–360;1–290;1–365;1–74;1–349;1–359;1–371;1–174;1–371;1–93;1–353;1–365 |
| 18740 | 1–405;1–283;1–100;1–110;1–291;1–74;1–174;1–93 |
| 18752 | 1–124;1–365 |
| 18756 | 1–351;1–385;1–379;1–386 |
| 18759 | 1–195;31–272;31–208;31–84;31–208;32–269;32–85;32–266;32–112;32–252;32–268;32–426;32–233;32–112;32–225;32–191;32–233;32–192;32–234;32–218;32–254;32–273;33–223;33–226;35–277 |
| 18779 | 1–390;11–306 |
| 18791 | 1–418;53–503;53–527;53–502;53–522;53–410;53–527 |
| 18792 | 1–439;1–466;1–441 |
| 18793 | 1–462;1–399;1–487;1–452;1–510;1–396;1–420;1–481 |
| 18794 | 1–434;1–453 |
| 18795 | 1–351;1–458;1–465;1–205;1–427 |
| 18796 | 1–475;1–462;1–495;1–503;1–351;1–479;1–205;1–427;1–479;1–497 |
| 18798 | 1–475;1–482 |
| 18799 | 1–403;1–381 |
| 18800 | 1–453;1–506 |
| 18801 | 1–438;1–600;1–433 |
| 18802 | 1–399;33–499 |
| 18803 | 1–492;1–433;7–485;7–495;7–528;7–91;16–423;17–127;17–167;55–150;55–167;55–167;55–167 |
| 18804 | 1–79;1–83 |
| 18805 | 1–481;1–490 |
| 18806 | 1–447;1–402 |
| 18807 | 1–438;1–165;1–388;1–275;1–447;1–447;1–398;1–447;1–439;1–447 |
| 18808 | 1–490;1–495;1–495 |
| 18810 | 1–231;1–297 |
| 18811 | 1–61;1–87 |
| 18812 | 1–506;1–464;1–447 |
| 18813 | 1–470;3–484 |
| 18814 | 1–446;321–824;321–795;321–788;321–821;321–687;321–786;321–787;321–587;321–895;321–754;440–875;440–903;503–991 |
| 18815 | 1–494;1–509 |
| 18816 | 1–238;39–561 |
| 18817 | 1–206;1–487 |
| 18818 | 1–474;12–249;12–504 |
| 18819 | 1–237;10–533 |
| 18820 | 1–406;1–440 |
| 18821 | 1–468;1–461;1–393;1–476;135–593 |
| 18825 | 1–486;1–490 |
| 18826 | 1–340;1–402;1–389 |
| 18828 | 1–445;17–333 |
| 18829 | 1–421;1–444 |
| 18830 | 1–282;1–256 |
| 18831 | 1–516;1–522 |
| 18832 | 1–522;1–452;1–506;1–465 |
| 18834 | 1–208;1–394 |
| 18835 | 1–512;1–532 |

TABLE II-continued (Tiling path)

| Seq Id No. | Positions of biological 5'ESTs |
|---|---|
| 18838 | 1–168;1–263;1–265;25–263;25–263;25–262;25–263;25–262;25–263;25–264 |
| 18839 | 1–374;1–259 |
| 18840 | 1–438;1–423;1–438;1–317;1–421;1–425;1–439;1–434;139–226 |
| 18841 | 1–434;1–423;1–317;1–421;1–452;1–425;1–434;139–226 |
| 18842 | 1–209;1–221;1–225 |
| 18843 | 1–360;1–438 |
| 18844 | 1–412;104–359 |
| 18845 | 1–470;11–291;25–494 |
| 18846 | 1–393;1–401 |
| 18847 | 1–352;20–177 |
| 18848 | 1–116;26–416 |
| 18849 | 1–489;1–299;1–479 |
| 18851 | 1–357;1–356 |
| 18852 | 1–357;1–324;1–334;1–357;1–360;1–349;1–341;1–352;1–349;1–351;1–349;1–344;1–347;1–360;1–353;1–342;1–350;1–300;1–357;11–351;11–344;11–359;11–83;11–282;11–342;11–339;11–342 |
| 18859 | 1–389;1–485;1–341 |
| 18861 | 1–338;1–453;1–451 |
| 18862 | 1–427;1–501 |
| 18863 | 1–353;1–353 |
| 18866 | 1–176;2–177;2–176;2–165;2–176;2–166;2–177;2–176;2–177;2–175;2–177;2–175;2–176;2–162;2–176;2–176;2–177;2–177;2–177 |
| 18867 | 1–446;1–423;1–446;1–270 |
| 18868 | 1–209;1–220;1–208 |
| 18869 | 1–488;306–716 |
| 18870 | 1–181;1–250;1–174 |
| 18871 | 1–234;1–182;1–226;1–238;1–175;1–222;1–238 |
| 18872 | 1–181;1–269;1–256;1–269;1–174 |
| 18873 | 1–181;1–300;1–288;1–174;1–296 |
| 18874 | 1–490;1–487;1–476;1–457;46–226;46–219 |
| 18875 | 1–475;1–274;1–482;1–278;1–386 |
| 18876 | 1–425;1–339 |
| 18877 | 1–462;1–501;1–427;1–356 |
| 18878 | 1–462;1–476;1–427;1–356 |
| 18880 | 1–553;1–467;104–563 |
| 18882 | 1–461;1–305 |
| 18883 | 1–427;1–485 |
| 18884 | 1–496;11–495;11–429;11–432 |
| 18885 | 1–414;1–370;1–417;323–936;323–384 |
| 18886 | 1–477;1–470;1–442;1–253 |
| 18889 | 1–449;1–443 |
| 18890 | 1–464;1–467;1–456 |
| 18891 | 1–491;1–471;1–502;1–465;1–401;1–429 |
| 18892 | 1–524;4–204;62–495 |
| 18895 | 1–57;1–426;39–302 |
| 18896 | 1–284;10–59 |
| 18897 | 1–82;1–344;1–253 |
| 18898 | 1–412;1–328 |
| 18899 | 1–378;1–298;1–356;30–111 |
| 18900 | 1–240;1–351 |
| 18901 | 1–452;1–507;1–466 |
| 18902 | 1–266;1–266;1–271;4–266 |
| 18903 | 1–479;1–449 |
| 18904 | 1–258;1–304 |
| 18908 | 1–395;1–400;6–424 |
| 18911 | 1–312;1–308;1–271;1–247;2–295;2–193;2–243;2–159;2–159;2–288;2–133;2–71;2–133;2–212;2–268;2–274;2–269;2–213;2–200;4–314;4–282;4–148;4–303;5–145;5–266;5–381;5–290;5–313;5–221;5–275;5–266;5–266;5–266 |
| 18916 | 1–447;21–110;21–93 |
| 18917 | 1–484;1–506;1–338;1–151;1–499 |
| 18919 | 1–466;1–485;1–479 |
| 18921 | 1–411;72–154;72–176 |
| 18930 | 1–485;1–458;1–462 |
| 18933 | 1–412;1–237;1–440;1–347;1–413 |
| 18934 | 1–380;1–439;1–582 |
| 18935 | 1–262;1–281 |
| 18936 | 1–341;1–341;1–336;1–341 |
| 18937 | 1–166;1–231;30–171;30–426 |
| 18940 | 1–154;1–424 |
| 18941 | 1–347;1–469 |
| 18943 | 1–98;1–97;1–99;1–146;1–149;1–147;1–99;1–146;1–134;1–99;1–134;1–100;1–146;1–95;1–145;1–115;1–99;1–99 |
| 18944 | 1–95;1–98;1–97;1–115;1–99;1–99;1–99;1–99;1–99;1–100;4–438 |
| 18945 | 1–488;1–404;1–524 |
| 18946 | 1–453;1–467;1–453;1–473;1–474;1–518;1–463;1–505 |
| 18950 | 1–397;1–88;2–425;19–468;19–283;20–433;21–427;2–404;21–200;21–454;23–452 |
| 18951 | 1–88;1–397;2–425;12–469;19–488;19–283;19–498;19–519;20–478;20484;20–433;21–480;21–504;21–492;21493;21–427;21–518;21–492;21–454;21–200;21–404;21–502;21–482;23–452 |
| 18953 | 1–306;1–304 |
| 18954 | 1469;3–297 |
| 18956 | 1–439;304–658;304–731;304–790;304–790;304–691;304–665;304–721;304–658 |
| 18957 | 1–517;1–489 |
| 18958 | 1–301;1–481;1–485;1–1030;1–466;1–294;1–404;1–432;1–481 |
| 18964 | 1–442;1–502;1–471;1–500;1–471;1–527;1–500;1–486;1–499;1–435 |
| 18966 | 1–261;1–516 |
| 18967 | 1–226;1–436;1–435;1–449;1–378;1–3951–95;1–425;1–261;1–388;1–414;1–435;1–54;1–433;1–325;1–348;1–419;1–436;1–393;1–393;1–432;1–440;1–415;1–384;1–361;1–424;1–433;1–66;1–435;1–424;1–397;1–431;1–436;1–353;1–448;1–432;1–433;1–419;1–434;1–411;1–152;1–158 |
| 18968 | 1–496;1–489;1–443;1–466 |
| 18969 | 1–489;1–443;1–466;35–569 |
| 18970 | 1–403;1–477;1–429 |
| 18971 | 1–69;24–466;24–438;24–228;70–602;70–563;70–578;70–562;99–401;99–607;102–517;102–596;113–466;113–601;113–594;113–465;113–441 |
| 18974 | 1–474;1–393;1–429 |
| 18975 | 1–388;1–449;1–431 |
| 18976 | 1–482;1–476 |
| 18977 | 1–467;30–194 |
| 18978 | 1–561;1–659 |
| 18979 | 1–451;1–318 |
| 18980 | 1–416;1–485;1–100;1–445;1–446 |
| 18981 | 1–463;2–399 |
| 18982 | 1–493;1–362;1–363;1–472 |
| 18984 | 1–441;1–507;1–423;1–462;1–449;1–475;1–357;4–187;10–434;11–470 |
| 18985 | 1–509;1–487;1–343;1–505;1–58;1–470 |
| 18986 | 1–63;1–433;1–64;1–74;1–318;27–165;31–180 |
| 18987 | 1–378;1–136;1–478;1–479;1–472 |
| 18988 | 1–310;1–473;1–107;1–361;1–394;1–471;1–489;1–434;45–431;127–424 |
| 18989 | 1–477;1–478;2–473 |
| 18991 | 1–528;1–511 |
| 18992 | 1–450;1–289;2–355;2–364;2–450;2400;2–464;2–364;2–448;2–375;2–506;2497;2–223;2–316;2–358;2–450;2–8;2–307;2–438;2–375;2–387;2–239;2–449;2–224;2–378;2–355;2–388;2–455;2–450;2–453;2–432;2–449;2–449;2–428;2–364;2–239;2–459;2–344;2–469;2–458;2–469;2–407;2–459;2–453;2–453;2–466;2–459;2–262;2–399;2–449;2–255;2–331;2–449;2–497;2– |

TABLE II-continued (Tiling path)

| Seq Id No. | Positions of biological 5'ESTs |
|---|---|
|  | 390;2–460;2–468;2–453;2–450;2–449;2–474;2–472;2–375;2–219;2–269;2–407;2–473;2–464;2–389;2–80;2–151;2–370;2–240;2–450;2–374;2–459;2–347;2–355;2–448;2–456;2–492;2–325;2–446;2–450;2–375;2–96;2–314;2–348;2–375;2–392;2–250;2–378;2–450;2–455;2–459;2–456;2–491;2–364;2–448;2–450;2–207;2–355;2–445;2–447;2–374;2–178;2–241;2–354;2–455;2–469;2–145;2–353;2–355;2–344;2–392;2–427;2–453;2–465;2–358;2–458;2–450;2–449;2–148;2–337;2–355;2–398;2–390;2–339;2–57;2–449;2–225;2–451;2–464;2–483;2–466;2–459;2–462;2–449;2–455;2–293;2–147;2–462;2–468;2–486;2–96;2–399;2–449;2–254;2–492;2–494;2–410;2–162;2–438;2–471;2–224;2–459;2–481;2–456;2–497;2–239;2–454;2–350;2–234;2–450;2–449;2–358;2–449;2–473;2–369;2–430;2–262;2–4 |
| 18998 | 1–299;1–443;1–429;13–458;13–476;13–484;13–455;13–465;13–365;13–444;13–511;13–446;13–472;13–496;13–239;13–441;13–445;13–469;13–409;13–517;13–293;13–332;13–514;13–379;13–446;13–356;13–379;13–518;13–485;14–465 |
| 18999 | 1–476;1–433;1–485;1–533 |
| 19002 | 1–458;14–459;14–404;14–397;14–479;14–448;14–441;14–434;14–458;14–458;14–457;4–822;14–382;14–384;14–402;96–457;96–457;97–675;98–481;98–488;98–458;99–502;100–177;100–456;100–466;100–457;100–230;100–481;100–457;100–408;100–471;100–304;100–457;100–458;100–383;100–507;100–485;100–481;100–502;117–481;117–495;117–457;117–456;120–460;120–457;120–458;120–480;120–459;120–445;120–457;120–407;120–384;120–457;120–457;120–448;120–572;120–456;120–501;120–456;120–447;120–481;120–564;120–429;120–406;128–195;128–445;144–458;144–448;158–456;158–442;158–448;158–549;158–379;158–505;158–458;158–457;158–457;158–573;158–637;158–456;158–471;158–457;158–615;158–457;158–457;158–429;159–456;160–458;167–458;195–456;197–383;197–459;198–435;207–456;209–458;210–347;226–503;226–458;226–556;226–457;371–793 |
| 19005 | 1–407;1–402;1–407 |
| 19006 | 1–488;1–510;3–303;283–701 |
| 19007 | 1–477;1–508;1–475 |
| 19008 | 1–478;1–453;1–443;1–477;1–374;1–411;1–399;1–399;1–402 |
| 19009 | 1–482;1–476;1–483;1–508 |
| 19010 | 1–436;1–412 |
| 19011 | 1–369;1–468;1–481;1–434 |
| 19017 | 1–424;1–483;1–412;1–454;1–420;1–484 |
| 19019 | 1–349;1–420;1–428 |
| 19020 | 1–411;1–455;1–497 |
| 19021 | 1–319;1–319;1–297;1–307;1–283;1–319;1–319;1–319;1–319;1–282;1–300;1–234;1–319;1–308;1–319;1–305;1–310;1–319;1–319;1–325;1–319;1–318;1–319;1–319;1–319;1–196;1–319;1–319;1–325;1–319;1–300;1–319;1–325;1–290;1–318;1–319;1–319;1–319;1–319;1–319;1–319;1–313;1–309;1–307;1–319;1–325;1–319;1–319;1–319;1–307;1–325;1–319;1–319;1–325;1–319;1–306;1–319;1–325;1–319;1–306;1–309;1–319;1–319;1–308;1–306;1–319;1–319;1–319;1–313;1–319;1–325;1–318;1–310;1–319;1–272;1–306;1–319;1–325;1–276;1–319;1–319;1–280;1–319;1–319;1–319;1–319;1–325;1–319;1–306;1–319;1–319;1–319;1–319;1–319;1–319;1–265;1–319;1–269;1–319;1–319;1–308;1–319;1–178;1–319;1–306;1–319;1–319;1–319;1–306;1–318;1–325;1–310;1–319;1–319;1–318;1–133;1–319;1–310;1–319;1–322;1–318;1–310;1–319;1–319;1–319;1–325;1–319;1–319;1–318;1–319;1–325;1–325;1–319;1–319;2–319 |
| 19022 | 1–67;1–438;1–360;1–465;1–490;1–441 |
| 19023 | 1–424;1–466;1–463;1–499;1–305;1–295;1–509;1–448;1–472;1–407;1–399;1–499;1–403;1–470;1–407;1–475;1–356;1–374;1–477;1–484 |
| 19024 | 1–424;1–466;1–499;1–463;1–295;1–305;1–514;1–448;1–499;1–399;1–407;1–472;1–403;1–407;1–470;1–475;1–356;1–374;1–477;1–484 |
| 19025 | 1–501;1–465 |
| 19026 | 1–293;1–282 |
| 19028 | 1–440;1–422 |
| 19029 | 1–442;1–550 |
| 19030 | 1–470;1–428 |
| 19031 | 1–81;48–509;48–531;48–528;48–527 |
| 19035 | 1–447;1–447;1–441;1–442 |
| 19037 | 1–391;5–491;5–516;5–487;5–470 |
| 19038 | 1–280;1–310;1–426 |
| 19039 | 1–482;1–580;1–404;1–284;1–472 |
| 19043 | 1–449;1–280;1–309 |
| 19044 | 1–62;1–62 |
| 19045 | 1–160;12–301;12–301;12–290;12–301;12–301;12–297;12–281;12–297;12–301;12–297;12–301;12–297;12–301;12–297;12–301;12–290;12–301;12–301;12–189;12–297;12–297;12–301;12–297 |
| 19046 | 1–363;1–462;1–342 |
| 19048 | 1–306;1–396;1–417 |
| 19049 | 1–383;1–536 |
| 19050 | 1–436;1–518 |
| 19051 | 1–480;1–508;1–487 |
| 19052 | 1–425;1–497;1–437;1–467 |
| 19053 | 1–450;2–408 |
| 19054 | 1–482;1–412;1–278 |
| 19055 | 1–465;1–465;1–463 |
| 19056 | 1–372;1–320 |
| 19057 | 1–465;61–175 |
| 19058 | 1–478;1–457 |
| 19059 | 1–468;1–401 |
| 19060 | 1–380;1–381;1–384 |
| 19062 | 1–500;1–109;1–463;1–299;1–478;1–285 |
| 19063 | 1–150;1–472;1–456 |
| 19064 | 1–515;1–513;1–472;4–419 |
| 19068 | 1–366;4–462;28–449;28–449;28–483;28–499;28–458;28–458;28–557;28–437;28–557;28–458;28–458;28–579;28–451;28–463;28–557;28–411;28–449;28–557;28–463;28–557;28–466;28–463;28–417;28–466;28–458;28–488;28–449;28–466;30–498;30–518;30–506;30–493;30–397;30–427;30–455;30–509;30–520;31–466;31–232;31–459;31–402;31–473;40–417;40–555 |
| 19073 | 1–426;3–313 |
| 19074 | 171–254;214–615 |
| 19078 | 1–423;1–131 |
| 19079 | 1–387;1–277 |
| 19080 | 1–586;1–445;1–228;1–449;1–513;1–483;1–552;1–577;1–427;1–242;1–547;1–579 |
| 19081 | 1–482;1–406;1–393;1–470;1–507 |
| 19082 | 1–468;1–406;1–393 |
| 19083 | 1–471;1–404;178–481 |
| 19085 | 1–375;1–474 |
| 19086 | 1–158;1–192 |

TABLE II-continued

(Tiling path)

| Seq Id No. | Positions of biological 5'ESTs |
|---|---|
| 19087 | 1–516;7–454;11–436 |
| 19088 | 1–427;2–471 |
| 19089 | 1–183;1–458;1–550;1–491 |
| 19090 | 1–469;1–436 |
| 19091 | 1–415;1–410 |
| 19092 | 1–426;2–467;2–470;2–372;385–839 |
| 19093 | 1–456;1–463;1–424 |
| 19094 | 1–516;1–366 |
| 19095 | 1–484;1–478;1–444;1–421 |
| 19096 | 1–354;1–354;1–354;1–356;1–354;1–356;1–356;1–356;1–356;1–261;1–354;1–354;1–264;1–356;1–354;1–356;1–281;1–356;1–355;1–354;1–354;1–356;1–354;1–350;1–342;1–356;1–356 |
| 19101 | 1–492;1–445;1–528 |
| 19102 | 1–444;1–252 |
| 19103 | 1–424;1–439;1–425;1–426 |
| 19104 | 1–480;1–414;1–477;1–556;1–532 |
| 19105 | 1–422;1–407 |
| 19106 | 1–396;1–417;1–426;1–503;1–242;1–473;1–256;1–321;1–453;1–322;1–394;1–394 |
| 19107 | 1–168;1–154;37–168 |
| 19108 | 1–548;1–536;1–538;1–77;1–445;1–465;1–410;1–440;1–448;1–452;1–465;1–385;1–448 |
| 19109 | 1–493;1–464;1–496;1–515;1–479 |
| 19110 | 1–473;1–449 |
| 19111 | 1–405;1–419;1–452;1–233 |
| 19112 | 1–480;1–480 |
| 19113 | 1–394;1–314 |
| 19114 | 1–315;6–354 |
| 19115 | 1–435;1–483;1–429;1–601;122–594;122–561;122–541;122–353;122–587;122–416;122–562;122–510;122–612;122–561;122–562;122–538;122–572;122–601;122–609;122–600;122–600;122–604;127–590 |
| 19117 | 1–449;1–472;1–487;1–464;1–493;1–409;1–472;1–490;1–443;1–450 |
| 19120 | 1–456;12–340 |
| 19121 | 1–202;2–200;2–200;2–188;2–201;2–185;2–201;2–201;2–188;2–201;2–201;2–201;2–201;2–188;2–201;2–201;2–190;2–164;2–201;2–191;2–201;2–191;2–187;2–201;2–201;2–201;2–201–2–201;2–201;2–201;2–201;2–191;2–121;2–135;2–178;2–201;2–201;2–188;2–202;2–188;2–201;2–200;2–155;2–90;2–175;2–201;2–192;2–197;2–201;2–201;2–201;2–188;2–190;2–188;2–188;2–201;2–196;2–201;2–188;2–201;2–201;2–201;2–187;2–187;2–201;2–184;2–201;2–201;2–201;2–187;2–190;2–161;2–201;2–203;2–201;2–98;2–201;2–88;2–201;2–201;2–202;2–201;2–188;2–121;2–190;2–188;2–188;2–188;2–117;3–201;3–202;3–201 |
| 19122 | 2–439;2–335;2–371;5–424;22–152;25–407;25–439;25–358;25–439;27–298 |
| 19125 | 1–448;14–438 |
| 19127 | 1–514;1–503;2–468 |
| 19128 | 1–452;1–466;1–453;1–351;1–394;1–469;1–444 |
| 19129 | 1–427;1–566;1–450 |
| 19130 | 1–454;1–517;1–454 |
| 19131 | 1–117;1–458 |
| 19132 | 1–136;1–134;1–136;1–124;1–124;1–136;1–134;1–136;1–134;1–134;1–136;1–134;1–134;1–136;1–134;1–136;1–136;1–136;1–134;1–134;1–136;1–136;1–136;1–134;1–136;1–134 |
| 19133 | 1–374;1–470;1–438;1–463;1–500;1–396;1–372;1–500;1–500;1–385 |
| 19135 | 1–469;272–682 |
| 19136 | 1–479;1–484 |
| 19137 | 1–126;1–142 |
| 19138 | 1–493;1–431;63–534;63–536;63–332;63–534;63–503;63–554 |
| 19141 | 1–340;1–339;1–339;1–328;1–337;1–353;1–339;1–331;1–340;1–351;1–340;1–354;1–352;1–355;1–330;1–340 |
| 19142 | 1–400;1–333 |
| 19147 | 1–480;1–438;1–444;1–440;1–457 |
| 19148 | 1–79;1–229;1–400;1–264;1–112;1–147;1–406;1–394;3–77;3–292;3–257;4–153;4–347;4–157;22–128;22–107 |
| 19149 | 1–332;1–337 |
| 19150 | 1–210;1–515 |
| 19151 | 1–258;1–77;1–71 |
| 19159 | 1–429;1–429;1–430;1–425;1–433;1–422;1–358;1–421;1–429;1–408;1–267;1–429;1–446;1–331;1–443;1–386;1–441;1–446;1–433;1–427;1–430;1–453;1–401;1–406;1–433;1–429;1–126;1–438;1–440;1–429;1–429 |
| 19161 | 1–533;1–319;1–495;1–550;1–366 |
| 19163 | 1–500;1–258;1–468;1–453;1–241;1–504 |
| 19164 | 1–416;1–418;1–435 |
| 19165 | 1–352;1–497 |
| 19166 | 1–497;1–485;1–127 |
| 19167 | 1–341;1–369 |
| 19168 | 1–371;1–382;1–400;1–396;1–161;1–364;1–381;1–382;1–384;1–380;1–385;1–159;1–383;1–377;1–387;1–384;1–397;1–188;1–391;1–397;1–368;1–102;1–382;1–382;1–400;1–386;1–385;1–387;1–378;1–382;1–286;1–400;1–386;1–400;1–388;1–387;1–211;1–398;1–382;1–369;1–382;1–384;1–376;1–397;1–385;1–384;1–373;1–373;1–368;1–397;1–382;1–345;1–382;1–397;1–352;1–397;2–77 |
| 19169 | 1–116;1–130;1–127;1–144;1–124;1–144;1–139;1–99;1–115;2–135 |
| 19170 | 1–434;7–62;7–298 |
| 19174 | 1–474;1–532;1–527 |
| 19175 | 1–519;1–423 |
| 19176 | 1–424;200–658 |
| 19177 | 1–287;1–276;1–286;1–285;1–291;1–291;1–266;1–303;1–133;1–262;1–297;1–292;1–244;1–301;1–287;1–300;1–300;1–290;1–288;1–277;1–202;1–138;1–288;1–269;1–153;1–301;1–302;1–277;1–143;1–277;1–288;1–300;1–277;1–283;1–243 |
| 19178 | 1–369;1–361 |
| 19179 | 1–500;1–391 |
| 19180 | 1–270;1–293;1–279;1–278 |
| 19181 | 1–558;1–436 |
| 19182 | 1–411;1–471;1–412 |
| 19185 | 1–88;1–88 |
| 19186 | 1–467;1–484;1–513 |
| 19187 | 1–464;1–370;1–460 |
| 19188 | 1–461;1–472 |
| 19189 | 1–473;1–460 |
| 19190 | 1–488;1–504;1–389;1–456;1–456;1–479;1–271;1–453;1–367;1–518;1–210 |
| 19191 | 1–380;36–131;36–134;36–132;36–131;36–131;36–131;36–134;36–132;36–132;36–134;36–132;36–132;36–132 |
| 19192 | 1–421;1–449 |
| 19193 | 1–196;1–214 |
| 19194 | 1–511;1–365;1–481;1–548;1–366;1–511;1–453;1–466;1–479;1–550;1–445;1–410;1–501;1–379;1–481 |
| 19205 | 1–468;1–364 |
| 19237 | 1–304;1–308;1–308;1–282;1–308 |
| 19282 | 1–377;1–355 |
| 19292 | 1–321;1–474;1–496 |
| 19303 | 1–199;3–489 |
| 19314 | 1–385;11–206 |

TABLE II-continued (Tiling path)

| Seq Id No. | Positions of biological 5'ESTs |
|---|---|
| 19325 | 1–355;1–249;1–359;1–320;1–366;1–359;1–354;1–335;1–359;1–334;1–367;1–390;1–351;1–388;1–76;1–389;1–375;1–274;1–375;1–389;1–367;1–334;1–367;1–390;1–272;1–361;1–376;1–354;1–389;1–358;1–375;1–355;1–366;1–367;1–375;1–370;1–374;1–367;1–367;10–377 |

TABLE III (Multivariant clusters)

| Internal designation | Variants |
|---|---|
| D1 | 15657,16303,16842 |
| D2 | 3523,17893,18827 |
| D3 | 422,2393,10295,11067,15100,15152 |
| D4 | 15266.15328 |
| D5 | 15420,15466,15520,15573,15614,15658,15711,15748,15855,15956,16025,16093,16156,16194,16252,16304,16362,16413,16472,16524,16584,16636,16680,16734,16789,16843 |
| D6 | 16947.17054 |
| D7 | 17118.17165 |
| D8 | 1666.196 |
| D9 | 1913.17346 |
| D10 | 236,238,247,251,18198,18341 |
| D11 | 18388.18448 |
| D12 | 18700.18743 |
| D13 | 175,3742,3749 |
| D14 | 3867.3879 |
| D15 | 997,1096,1130,7920,8104,8192 |
| D16 | 9217.9298 |
| D17 | 1186,10834,11557 |
| D18 | 2828.12719 |
| D19 | 314.1909 |
| D20 | 153.13674 |
| D21 | 471,13878,13957 |
| D22 | 112.203 |
| D23 | 14318.14392 |
| D24 | 2319,14701,14862 |
| D25 | 563,15032,15095,15101,15109,15113,15114,15117 |
| D26 | 2367,15153,15157,15165 |
| D27 | 2390.15207 |
| D28 | 578,15227,15231 |
| D29 | 2414,15291,15296 |
| D30 | 15303.15309 |
| D31 | 15329,15335,15342 |
| D32 | 1521.15457 |
| D33 | 614.248 |
| D34 | 15481,15490,15495,15497 |
| D35 | 2493.2497 |
| D36 | 15528.15535 |
| D37 | 2545,2549,2552,15620 |
| D38 | 358,366,2560 |
| D39 | 109.15645 |
| D40 | 15659,15666,15672 |
| D41 | 43,1362,1363,2587,15700 |
| D42 | 1817,1854 1945,2051 |
| D43 | 15731,15734,15737,15741,15749,15760 |
| D44 | 2623,2624,2625,2626,2627,2628,2629,2630,2631,2632,2633,2634,2636,2639,2643,2645,2646,3213,3274,15823,15844,15977,15996 |
| D45 | 16094.16098 |
| D46 | 686.16102 |
| D47 | 1672.1618 |

TABLE III-continued (Multivariant clusters)

| Internal designation | Variants |
|---|---|
| D48 | 2725.16224 |
| D49 | 1055,2731,16258 |
| D50 | 700.16273 |
| D51 | 1347.1348 |
| D52 | 3564.16314 |
| D53 | 715.716 |
| D54 | 16348.16356 |
| D55 | 16392,16398,16405,16414,16419,16424 |
| D56 | 277.1662 |
| D57 | 1403,2829,16474 |
| D58 | 16525,16529,16533,16544 |
| D59 | 16621.16626 |
| D60 | 16644,16649,16650 |
| D61 | 16656.1666 |
| D62 | 775.17 |
| D63 | 16709.16716 |
| D64 | 783,1852,16736,16741 |
| D65 | 1936.1675 |
| D66 | 790,794,799,2931,2938,2940,2948,16790,16819 |
| D67 | 16829.16836 |
| D68 | 805.16852 |
| D69 | 16873.16879 |
| D70 | 836,17099,17109 |
| D71 | 17130,17136,17140 |
| D72 | 275,275,1596,17200 |
| D73 | 880.3117 |
| D74 | 82,886,892,1453,1455,1461 |
| D75 | 3179.3184 |
| D76 | 17432.17439 |
| D77 | 3215,3218,17491 |
| D78 | 17541,17548,17554 |
| D79 | 17574.17581 |
| D80 | 3279.1763 |
| D81 | 958.3302 |
| D82 | 17719.17732 |
| D83 | 3319,3321,17753,17756 |
| D84 | 1893.1781 |
| D85 | 1033.1034 |
| D86 | 17985,17993,17998 |
| D87 | 18002.18007 |
| D88 | 18048,18054,18058,18062,18065,18066,18068,18071,18075 |
| D89 | 18083,18086,18091,18101,18106 |
| D90 | 3452,3453,18122,18126,18140,18148,18152,18158,18167,18170,18172,18175 |
| D91 | 3460,18181,18190 |
| D92 | 1102.3467 |
| D93 | 67,68,1704,18287 |
| D94 | 3500,18310,18317 |
| D95 | 18357,18363,18367,18368,18371 |
| D96 | 18396.18403 |
| D97 | 18478,18499,18506,18535 |
| D98 | 1172.18563 |
| D99 | 3591,3596,18581 |
| D100 | 18618.18622 |
| D101 | 1210,1212,1218,1219,1220,1222,3647,3651,3658,18659,18679,18686,18690,18692 |
| D102 | 18721.18726 |
| D103 | 18735.1874 |
| D104 | 368,3664,3666,3668,3677,18752,18756,18759,18763,18766,18773,18780,18789 |
| D105 | 1241.1885 |
| D106 | 1869.18859 |
| D107 | 18888.18893 |
| D108 | 3747,18905,18909,18912,18914,18920,18922,18923,18925,18926,18928,18929 |
| D109 | 1273.1558 |

TABLE III-continued (Multivariant clusters)

| Internal designation | Variants |
| --- | --- |
| D110 | 1285,1288,3779,3780,3796,3800,18984,19004 |
| D111 | 19038.19043 |
| D112 | 19064,19070,19077 |
| D113 | 19136.19139 |
| D114 | 1318,3862,19145 |
| D115 | 3869.3872 |
| D116 | 19303.19314 |
| D117 | 1320,3842,3843 |
| D118 | 7828,7837,7845,7851 |
| D119 | 1235,3728,3736,3752,3768,3804,3823,3827,7872 |
| D120 | 8005.8015 |
| D121 | 1176,8083,8125 |
| D122 | 3705.8143 |
| D123 | 1146.3681 |
| D124 | 1144.8233 |
| D125 | 1113.8307 |
| D126 | 1109.3621 |
| D127 | 926,941,8529,8538 |
| D128 | 3518,3519,8667,8678,8690,8699,8710,8721,8732,8742,8751,8758,8768,8777,8786 |
| D129 | 8805.8813 |
| D130 | 3478,8830,8841,8862,8873 |
| D131 | 1422.8885 |
| D132 | 8976.8986 |
| D133 | 292.1468 |
| D134 | 9177.9185 |
| D135 | 9208.9218 |
| D136 | 312.924 |
| D137 | 9372.938 |
| D138 | 3214,3216,3220,9396,9403,9411,9420,9428,9435,9444,9453,9463,9474,9484,9518,9525,9532,9539 |
| D139 | 9614.9622 |
| D140 | 9769.978 |
| D141 | 3078,9836,9853 |
| D142 | 3056,9861,9871 |
| D143 | 470.473 |
| D144 | 467,3020,3025 |
| D145 | 410,2984,9988 |
| D146 | 10010.10016 |
| D147 | 2944,2951,2952 |
| D148 | 2926.10106 |
| D149 | 2907.2914 |
| D150 | 10178,10185,10193,10203,10211,10220,10229,10237,10248,10258,10269,10278,10286,10297,10306 |
| D151 | 284.1097 |
| D152 | 10339.10348 |
| D153 | 10392.10401 |
| D154 | 2689.10504 |
| D155 | 2608,2617,10523,10531,10538,10554 |
| D156 | 929,3035,10591 |
| D157 | 876,10612,10627 |
| D158 | 2535.10679 |
| D159 | 10686.10694 |
| D160 | 1233.10763 |
| D161 | 2476,2483,10798,10817 |
| D162 | 10845.10852 |
| D163 | 577,2372,10990 |
| D164 | 530,11076,11090 |
| D165 | 2209,2363,2392 |
| D166 | 11247.11258 |
| D167 | 2194.2195 |
| D168 | 11378.11387 |
| D169 | 11457.11465 |
| D170 | 1206.11537 |
| D171 | 2094,2100,11606 |
| D172 | 11674.11685 |
| D173 | 11833.11843 |
| D174 | 11906.11916 |
| D175 | 11998.12008 |
| D176 | 12039,12050,12061 |
| D177 | 1420,12145,12166 |
| D178 | 12197.12208 |
| D179 | 953,956,12279 |
| D180 | 673,709,711,759,789,822,875,905,12356 |
| D181 | 3288,12532,12538,12546 |
| D182 | 561,2856,12571 |
| D183 | 1588.12605 |
| D184 | 370.1267 |
| D185 | 762,12687,12759,12795,12809 |
| D186 | 12854.12862 |
| D187 | 12879.1289 |
| D188 | 107.1516 |
| D189 | 2416.12945 |
| D190 | 650.12977 |
| D191 | 617.12995 |
| D192 | 229.13057 |
| D193 | 426.13078 |
| D194 | 387.2082 |
| D195 | 13359,13367,13375,13384,13392,13398,13407,13412,13420,13428,13435,13443 |
| D196 | 13449,13457,13464 |
| D197 | 235.1801 |
| D198 | 2144.13557 |
| D199 | 2099.2153 |
| D200 | 13627,13636,13642,13648 |
| D201 | 2121.13712 |
| D202 | 13722.13731 |
| D203 | 439,2132,13751,13760 |
| D204 | 13779,13788,13796,13801 |
| D205 | 1950.1965 |
| D206 | 480.14104 |
| D207 | 1773,1775,1776,1779,14134,14143 |
| D208 | 14224,14232,14240 |
| D209 | 1987.1425 |
| D210 | 2238.14266 |
| D211 | 14278.14286 |
| D212 | 2256.2258 |
| D213 | 14654,14673,14691 |
| D214 | 14781,14789,14798,14807 |
| D215 | 1617.1487 |
| D216 | 2334.14933 |
| D217 | 14986.14995 |
| D218 | 2348,15013,15023 |
| D219 | 15077.15088 |
| D220 | 165,356,1498,2354,15096 |
| D221 | 2355.15099 |
| D222 | 15104,15105,15106,15107 |
| D223 | 1436.15112 |
| D224 | 1387,1388,15115 |
| D225 | 2364,15120,15121,15122 |
| D226 | 564.565 |
| D227 | 15126,15127,15128 |
| D228 | 15131.15132 |
| D229 | 15133.15134 |
| D230 | 15137.15138 |
| D231 | 2369.15142 |
| D232 | 315,568,15150 |
| D233 | 570,1399,2373,2375,15156 |
| D234 | 15159.1516 |
| D235 | 1577.15161 |
| D236 | 15162.15163 |
| D237 | 2378.15169 |
| D238 | 2379,2380,15172 |
| D239 | 2382.15175 |
| D240 | 572,2384,15176 |
| D241 | 290,1850,1853 |
| D242 | 15190.15191 |
| D243 | 15196,15197,15198,15199,15200,15201,15202,15203,15204,15205,15206,15208,15209,15210 |

TABLE III-continued (Multivariant clusters)

| Internal designation | Variants |
|---|---|
| D244 | 15212,15214,15215 |
| D245 | 15220.15221 |
| D246 | 2396,15224,15225 |
| D247 | 15229.1523 |
| D248 | 15232,15233,15234 |
| D249 | 15237.15238 |
| D250 | 15244.15246 |
| D251 | 2401.2742 |
| D252 | 2403.15249 |
| D253 | 1570.2777 |
| D254 | 585.15252 |
| D255 | 2408.1526 |
| D256 | 15261,15262,15263 |
| D257 | 15268,15269,15270,15271 |
| D258 | 2411,15272,15274,15275,15276,15277,15278 |
| D259 | 586.587 |
| D260 | 15281.15282 |
| D261 | 1874.1887 |
| D262 | 15286.15287 |
| D263 | 1984.2417 |
| D264 | 15294.15295 |
| D265 | 2420,15297,15298 |
| D266 | 15301.15302 |
| D267 | 15306.15307 |
| D268 | 2423.1531 |
| D269 | 15312,15313,15314,15316,15317,15318,15319,15320,15321,15322,15323 |
| D270 | 731,2427,2428,2429 |
| D271 | 2431.15327 |
| D272 | 254.15332 |
| D273 | 2432.15333 |
| D274 | 15341.15343 |
| D275 | 360.15344 |
| D276 | 15348.1535 |
| D277 | 15351.15352 |
| D278 | 597,2434,15355 |
| D279 | 15356,15357,15358,15359,15360,15361,15362,15364,15365,15366,15367 |
| D280 | 858.15368 |
| D281 | 599.1537 |
| D282 | 260.261 |
| D283 | 15384.15385 |
| D284 | 2443,15386,15387,15388,15389 |
| D285 | 15395,15396 |
| D286 | 287.2446 |
| D287 | 604.2447 |
| D288 | 1415,1747,15404,15405,15406,15409 |
| D289 | 15411.15412 |
| D290 | 606,607,15414 |
| D291 | 1791.15418 |
| D292 | 2452,2453,2454,2457,2458,2459,2460,2855,2882 |
| D293 | 2461.15427 |
| D294 | 608,610,810,15433,15434 |
| D295 | 2470.15436 |
| D296 | 15437,15438,15439,15440,15441 |
| D297 | 15445.15446 |
| D298 | 1593,2474,15454 |
| D299 | 15456.15458 |
| D300 | 15460.15461 |
| D301 | 618,619,620,894,15465,15467,15468,15469,15470 |
| D302 | 2482.15472 |
| D303 | 623.15483 |
| D304 | 2485.15491 |
| D305 | 2487.15496 |
| D306 | 15500.15501 |
| D307 | 626.2489 |
| D308 | 15504.15505 |
| D309 | 307,308,1902,15506,15507,15508,15509,15510,15511 |
| D310 | 1471.15512 |
| D311 | 15513.15514 |
| D312 | 1876.2494 |
| D313 | 2498,15521,15522 |
| D314 | 15524.15525 |
| D315 | 15526.15527 |
| D316 | 15529.1553 |
| D317 | 15532.15533 |
| D318 | 2502.2503 |
| D319 | 15542.15543 |
| D320 | 632.633 |
| D321 | 15548.15549 |
| D322 | 328,2505,15551 |
| D323 | 2506.2507 |
| D324 | 2508.2509 |
| D325 | 15558.15559 |
| D326 | 1956.2511 |
| D327 | 1643.15562 |
| D328 | 2516.2517 |
| D329 | 74,75,1428 |
| D330 | 2523.2524 |
| D331 | 181,1416,15579 |
| D332 | 347.3016 |
| D333 | 2532,15586,15587 |
| D334 | 1651,1743,1762,1764,1766,1767,15589 |
| D335 | 15595.15596 |
| D336 | 2543.15599 |
| D337 | 2544,15601,15602 |
| D338 | 15604.15605 |
| D339 | 125,265,1569,1663,15607 |
| D340 | 1863.15611 |
| D341 | 2554.15623 |
| D342 | 123.1555 |
| D343 | 2013,2014,2015,2016,2017,15624,15625,15626 |
| D344 | 1760.15639 |
| D345 | 657.2571 |
| D346 | 659,2572,2573,15644 |
| D347 | 661,662,2576 |
| D348 | 2577,2578,15651,15652,15653,15654,15655,15656 |
| D349 | 15662,15663,15664 |
| D350 | 2579,2580,15667,15668,15669 |
| D351 | 15670.15671 |
| D352 | 2581,2582,2583 |
| D353 | 957,2584,2585,15675,15676 |
| D354 | 15677.15678 |
| D355 | 15685.15686 |
| D356 | 1657.2589 |
| D357 | 1793,15695,15696 |
| D358 | 15699.15701 |
| D359 | 15705.15706 |
| D360 | 15707.15708 |
| D361 | 73,1427,15713 |
| D362 | 15715.15716 |
| D363 | 111,671,15717 |
| D364 | 2612,2613,2614,3874,3880,15720 |
| D365 | 15722,15723,15724 |
| D366 | 1935.15725 |
| D367 | 1649,15730,15732 |
| D368 | 2619.15735 |
| D369 | 320,672,15738 |
| D370 | 15743.15744 |
| D371 | 15747,15750,15751,15752,15753,15754,15755,15756,15757,15758,15759,15761,15762,15763,15764,15765,15766,15767,15768,15769,15770,15771,15772,15773,15774,15775,15776,15777,15778,15779,15780,15781,15782,15783,15784,15785,15786,15787,15788,15789,15790,15792,1579 |

TABLE III-continued (Multivariant clusters)

| Internal designation | Variants |
|---|---|
| | 3,15794,15795,15796,15797,15798, 15799,15800,15801,15803,15804,15805,15806,15807,15808,15809,15810,15811,15812,15813,15814,15815, 15816,15817,15818,15819,15820,15821,15822,15824,15825,15826,15827,15828,15829,15830,15831,15832, 15833,15834,15835,15836,15837,15838,15839,15840,15841,15842,15843,15845,15846,15847,15848,15849, 15850,15851,15852,15853,15854,15856,15857,15858,15859,15860,15861,15862,15863,15864,15865,15866, 15867,15868,15869,15870,15871,15872,15873,15874,15875,15876,15877,15878,15879,15880,15881,15882, 15883,15884,15885,15886,15887,15888,15889,15890,15891,15892,15893,15894,15895,15896,15897,15898, 15899,15900,15901,15902,15903,15904,15905,15906,15907,15908,15909,15910,15911,15912,15913,15914, 15915,15916,15917,15918,15919,15920,15921,15922,15923,15924,15925 |
| D372 | 2637,15990,15991 |
| D373 | 15992,15993,15994,15995,15997,15998,15999,16000,16001 |
| D374 | 2638,2640,2641 |
| D375 | 16005.16006 |
| D376 | 16007,16008,16009,16010,16011,16012,16013,16014,16015,16016,16017,16018,16019,16020,16021,16022, 16023,16024,16026,16027,16028,16029,16030,16031,16032,16033,16034,16035,16037,16038,16039,16040, 16041,16042,16043,16044,16045,16046,16048,16049,16050,16051,16052,16053,16054,16055,16056,16057, 16058,16059,16060,16061 |
| D377 | 1544,16069,16070 |
| D378 | 179,16076,16077 |
| D379 | 2651.16078 |
| D380 | 16080,16081,16082 |
| D381 | 679,2652,2653 |
| D382 | 1536.2658 |
| D383 | 683,684,16090 |
| D384 | 16091.16092 |
| D385 | 2660,2661,16095,16096,16097,16099,16100 |
| D386 | 352,2662,16101 |
| D387 | 16108,16109,16110,16111 |
| D388 | 16113,16114,16115 |
| D389 | 16116,16117,16118,16120 |
| D390 | 2668.16122 |
| D391 | 16125.16126 |
| D392 | 16127,16128,16129,16130,16131,16132,16133,16134,16135,16136,16137,16138,16139,16140,16141,16142, 16143,16144,16145 |
| D393 | 2670.16147 |
| D394 | 2671,2672,2673,16148 |
| D395 | 1980.16149 |
| D396 | 16150,16151,16152 |
| D397 | 2675,16153,16154,16155 |
| D398 | 2679,2680,2681 |
| D399 | 2682,2683,2685,2686 |
| D400 | 16160,16161,16162,16163,16164,16165,16166,16167 |
| D401 | 140,149,2694,16171,16172 |
| D402 | 1644,1647,1841,16174,16175,16177 |
| D403 | 2701.16178 |
| D404 | 2706.16185 |
| D405 | 1620.2707 |
| D406 | 16188.16189 |
| D407 | 16191,16192,16193,16195 |
| D408 | 693.2712 |
| D409 | 2713,2714,2715,16197,16198,16199,16200,16201,16202,16203,16204,16205,16206 |
| D410 | 16207.16208 |
| D411 | 2718,3437,16209,16211,16212,16213,16214,16215,16216,16217,16218,16219 |
| D412 | 2723,2724,16225 |
| D413 | 16226.16227 |
| D414 | 16228.16229 |
| D415 | 16233.16234 |
| D416 | 16237,16238,16239,16240 |
| D417 | 697,2728,2729,2730 |
| D418 | 16248,16249,16250,16251,16253,16254,16255,16256,16257,16259,16260,16261,16262 |
| D419 | 16267.16268 |
| D420 | 154.2737 |
| D421 | 16270.16271 |
| D422 | 701.274 |
| D423 | 1344.3443 |
| D424 | 702.16279 |
| D425 | 16280.16281 |
| D426 | 2745.2746 |
| D427 | 704,16285,16286 |
| D428 | 16288,16289,16290,16291,16292,16293,16294,16295 |
| D429 | 707.16298 |
| D430 | 1959.2748 |
| D431 | 2750.16301 |
| D432 | 304,1600,16305,16306 |
| D433 | 39.1356 |
| D434 | 16312.16313 |
| D435 | 16315,16316,16317,16318,16319,16320,16321,16322,16323,16324 |
| D436 | 2762,2763,16325 |
| D437 | 16327.16328 |
| D438 | 712,1079,3570,16330 |
| D439 | 714,2765,16331 |
| D440 | 2766,2767,2768,2769,2770,2771,16332 |
| D441 | 16336.16337 |
| D442 | 16338,16339,16340,16341,16342,16343,16344,16345 |
| D443 | 16346,16347,16349,16350 |
| D444 | 2772,16351,16352,16353 |
| D445 | 16354.16355 |
| D446 | 178.16357 |
| D447 | 16358.16359 |
| D448 | 2778,3489,16373 |
| D449 | 2779.16375 |
| D450 | 16380.16381 |
| D451 | 2787.3583 |
| D452 | 1882.16391 |
| D453 | 2791,16393,16394 |
| D454 | 723,724,16396 |
| D455 | 16399.164 |
| D456 | 725,726,16406 |
| D457 | 16407,16408,16409 |
| D458 | 2795,2796,2797,2798,2799,2800,2801,2802,2803,2804,2805,16410,16411,16412,16415,16416,16417,16418,16420,16421 |
| D459 | 1454.1458 |
| D460 | 16425,16426,16428,16429,16430,16431,16432,16433,16434,16435 |
| D461 | 1602.1603 |
| D462 | 16437.16438 |
| D463 | 16440.16441 |
| D464 | 2812.16442 |
| D465 | 1088,2815,16449,16450 |
| D466 | 1962.1967 |

TABLE III-continued
(Multivariant clusters)

| Internal designation | Variants |
|---|---|
| D467 | 16452,16453,16454,16455,16456,16457,16458 |
| D468 | 16459,16460,16461 |
| D469 | 78.16462 |
| D470 | 16464.16465 |
| D471 | 16468.16469 |
| D472 | 736.1518 |
| D473 | 2825,2826,16475 |
| D474 | 1287.2827 |
| D475 | 16477,16478,16479,16480,16481,16482,16483,16485,16486,16487 |
| D476 | 1124,2832,16488,16489,16490,16491,16492,16493,16494,16495,16496 |
| D477 | 16497,16498,16499,16500,16501 |
| D478 | 739.2835 |
| D479 | 740.741 |
| D480 | 2836.16504 |
| D481 | 742.16505 |
| D482 | 16509.1651 |
| D483 | 16514,16515,16516 |
| D484 | 1693,1697,16520 |
| D485 | 744,1292,2844,2845,2846,2847,2848,16521,16522 |
| D486 | 746,747,748,749,750,751,1304,16526,16527,16528,16530,16531 |
| D487 | 752.16532 |
| D488 | 16534,16535,16536,16537,16538,16539,16540,16541,16542,16543,16545,16546,16547,16548 |
| D489 | 2851.16549 |
| D490 | 16550,16551,16552,16553,16555,16556,16557,16558,16559 |
| D491 | 754.2852 |
| D492 | 342,2853,16562 |
| D493 | 16563.16564 |
| D494 | 16569.1657 |
| D495 | 108,1519,1597 |
| D496 | 1952,1955,1958 |
| D497 | 16574.16575 |
| D498 | 16576,16577,16578 |
| D499 | 1971.16581 |
| D500 | 16587.16588 |
| D501 | 16593.16594 |
| D502 | 2868.16606 |
| D503 | 16607,16608,16609 |
| D504 | 1771,16610,16611 |
| D505 | 1308,2870,2871 |
| D506 | 16614.16615 |
| D507 | 36,16619,16620 |
| D508 | 2874.2875 |
| D509 | 40.16629 |
| D510 | 16630.16631 |
| D511 | 764.765 |
| D512 | 766,3767,3818 |
| D513 | 768,2888,16647 |
| D514 | 769,2892,2893 |
| D515 | 1867,16657,16658 |
| D516 | 1440.2896 |
| D517 | 772.2898 |
| D518 | 773,2900,16662,16663,16664 |
| D519 | 774,16665,16666 |
| D520 | 16668.16669 |
| D521 | 16670,16671,16672,16673 |
| D522 | 16677.16678 |
| D523 | 16679.16681 |
| D524 | 777.2902 |
| D525 | 16683,16684,16685,16686,16687,16688,16689,16690,16691,16692,16693,16694,16695,16696 |
| D526 | 2909,16705,16706,16707,16708,16710,16711,16712,16713,16714 |
| D527 | 16719,16720,16721 |
| D528 | 779.2911 |
| D529 | 16723,16724,16725 |
| D530 | 197,1712,16729,16730,16731,16732,16733,16735 |
| D531 | 198.1711 |
| D532 | 16738,16739,16740 |
| D533 | 16746.16747 |
| D534 | 16751.16752 |
| D535 | 2921,16753,16754,16755 |
| D536 | 2925,16758,16759,16760 |
| D537 | 16762.16763 |
| D538 | 16765,16766,16767,16768 |
| D539 | 16775,16776,16777,16778,16779,16780,16781,16782,16783,16784,16785,16786 |
| D540 | 2933,2934,2935,16787,16788,16791,16792,16793 |
| D541 | 2937.16795 |
| D542 | 788,16796,16797 |
| D543 | 791,1261,1500,16798,16799,16800,16801,16802,16803,16804,16805,16806,16807 |
| D544 | 16812,16813,16814 |
| D545 | 2945.2946 |
| D546 | 797,1819,2949 |
| D547 | 1741.1814 |
| D548 | 2003.2004 |
| D549 | 16825,16826,16827 |
| D550 | 16831.16832 |
| D551 | 801,16833,16834 |
| D552 | 16835.16837 |
| D553 | 1927.193 |
| D554 | 803.804 |
| D555 | 2967,16853,16854 |
| D556 | 91.2968 |
| D557 | 809.297 |
| D558 | 62.64 |
| D559 | 16868,16869,16870,16871,16872 |
| D560 | 2975.16878 |
| D561 | 817.1969 |
| D562 | 818,819,2981,2982,16893 |
| D563 | 1931.16897 |
| D564 | 2985,16899,16900 |
| D565 | 820.16901 |
| D566 | 1687.16903 |
| D567 | 119.16907 |
| D568 | 826,2990,2991,2992 |
| D569 | 1408.2001 |
| D570 | 16912.16913 |
| D571 | 351.16918 |
| D572 | 200,354,831 |
| D573 | 16919.16921 |
| D574 | 16922.16923 |
| D575 | 2043.2053 |
| D576 | 16925,16926,16927,16928,16929,16930,16931,16932,16933,16934,16935,16936,16937,16938,16939,16940,16941,16942,16943,16944,16945,16946,16949,16950,16951,16952,16953,16954,16955,16956,16957,16958,16960,16961,16962,16963,16964,16965,16966,16967,16968,16969,16970,16971,16972,16973,16974,16975,16976,16977,16978,16979,16980,16981,16982,16983,16984,16985,16986,16987,16988,16989,16990,16991,16992,16993,16994,16995,16996,16997,16998,16999,17001,17002,17003,17004,17005,17006,17007,17008,17009,17010,17012,17013,17014,17015,17016,17017,17018,17019,17020,17021,17022,17023,17024,17025,17026,17027,17028,17029,17030,17031,17033,17034,17035,17036,17037,17038,17039,17040,17041,17042,17044,17045,17046,17047,17048,17 |

TABLE III-continued

(Multivariant clusters)

| Internal designation | Variants |
|---|---|
| | 049,17050,17051,17052,17053,1705 |
| | 5,17056,17057,17058,17059,17060, |
| | 17061,17062,17063,17064,17066,17 |
| | 067,17068,17069,17070,17071,1707 |
| | 2,17073,17074,17075,17077,17078, |
| | 17079,17080,17081,17082,17083 |
| D577 | 3007,3008,3009 |
| D578 | 833.17088 |
| D579 | 17095,17096,17097 |
| D580 | 835,2027,2052 |
| D581 | 17103.17104 |
| D582 | 17114.17115 |
| D583 | 840.3024 |
| D584 | 29.1341 |
| D585 | 3027.1712 |
| D586 | 843.844 |
| D587 | 274.17124 |
| D588 | 1795,17125,17126 |
| D589 | 847.3031 |
| D590 | 17141.17142 |
| D591 | 17143,17144,17145,17146,17147,17 |
| | 148,17149,17151 |
| D592 | 851.17154 |
| D593 | 17159.1716 |
| D594 | 3039.304 |
| D595 | 17166.17167 |
| D596 | 17168.17169 |
| D597 | 3043,17170,17171,17172,17173 |
| D598 | 1683.3047 |
| D599 | 855,3050,3051 |
| D600 | 856.3052 |
| D601 | 17182,17183,17184,17185 |
| D602 | 17186,17187,17188 |
| D603 | 279.857 |
| D604 | 121.1469 |
| D605 | 3057.17193 |
| D606 | 861,3060,3061,3062,17197 |
| D607 | 862.17199 |
| D608 | 864,3064,17202 |
| D609 | 865.866 |
| D610 | 17205.17206 |
| D611 | 3066,3067,17207,17208,17209 |
| D612 | 867,868,17210 |
| D613 | 3070.17213 |
| D614 | 1682.3071 |
| D615 | 230.1783 |
| D616 | 17221,17222,17223 |
| D617 | 1894,1895,1898 |
| D618 | 1652.17228 |
| D619 | 3085.17229 |
| D620 | 17232.17233 |
| D621 | 3087,3088,3089,3090,3091,3092,17 |
| | 234,17235 |
| D622 | 872.1724 |
| D623 | 873,874,3099,3100,3101,17252 |
| D624 | 17257.17258 |
| D625 | 17262.17263 |
| D626 | 3105.3106 |
| D627 | 17268,17269,17270,17271 |
| D628 | 17272.17273 |
| D629 | 17276.17277 |
| D630 | 1914.1728 |
| D631 | 17285.17286 |
| D632 | 879,17291,17292 |
| D633 | 1998,17294,17295 |
| D634 | 17296.17297 |
| D635 | 881,3115,17300,17301 |
| D636 | 882.3116 |
| D637 | 17302.17303 |
| D638 | 3121,3122,17309 |
| D639 | 17310,17311,17312,17313 |
| D640 | 883,3124,3125 |
| D641 | 59.6 |
| D642 | 1918,17321,17322,17323 |
| D643 | 888.889 |
| D644 | 3133,3134,3135,3136 |
| D645 | 3137.17335 |
| D646 | 3138.17336 |
| D647 | 1737,1744,3142,17339 |
| D648 | 346,17343,17344 |
| D649 | 17350.17351 |
| D650 | 899,3156,17366 |
| D651 | 3157,3159,3160,3161 |
| D652 | 900.901 |
| D653 | 17368.1737 |
| D654 | 17371.17372 |
| D655 | 3166.17374 |
| D656 | 3169,3170,17378 |
| D657 | 1996,1997,2012,3175 |
| D658 | 3178,17379,17380 |
| D659 | 3181.17381 |
| D660 | 3182.17382 |
| D661 | 17383.17384 |
| D662 | 1973,17391,17392,17393 |
| D663 | 1587,1591,1592,3188 |
| D664 | 156.17402 |
| D665 | 17405.17406 |
| D666 | 17412,17413,17414,17415,17416,17 |
| | 417,17418,17419,17420,17421,1742 |
| | 2,17423 |
| D667 | 909.91 |
| D668 | 3206.3207 |
| D669 | 913,17442,17443,17444,17446,1744 |
| | 7,17448,17449,17450,17451,17452, |
| | 17453,17454,17455,17457 |
| D670 | 17459.1746 |
| D671 | 1485.17464 |
| D672 | 914,2026,2058,3211,17465,17466,1 |
| | 7467 |
| D673 | 17469.1747 |
| D674 | 17474.17475 |
| D675 | 17477.17478 |
| D676 | 17479.1748 |
| D677 | 17481,17482,17483 |
| D678 | 17485.17486 |
| D679 | 918,919,17493 |
| D680 | 17494.17495 |
| D681 | 17497.17499 |
| D682 | 17500,17501,17502,17503 |
| D683 | 3222.17508 |
| D684 | 17509.1751 |
| D685 | 921.922 |
| D686 | 3224.17516 |
| D687 | 3225.3226 |
| D688 | 3230.3231 |
| D689 | 17521.17522 |
| D690 | 17523.17524 |
| D691 | 17525,17526,17527 |
| D692 | 3236,3237,3238 |
| D693 | 3239,3240,3241 |
| D694 | 17537.17538 |
| D695 | 80,927,17547 |
| D696 | 1379,1828,3248 |
| D697 | 17553.17555 |
| D698 | 3250,3251,3252,3253,3254,3255,32 |
| | 56,3257,17556,17557,17558,17559 |
| D699 | 1345,1346,3262,3263,17571,17572, |
| | 17573 |
| D700 | 933.3264 |
| D701 | 934,17579,17580,17582,17583,1758 |
| | 4,17585 |
| D702 | 1528.1554 |
| D703 | 17589.1759 |
| D704 | 17593.17594 |
| D705 | 1393.17596 |
| D706 | 17597.17598 |
| D707 | 937.938 |
| D708 | 17608,17609,17610 |

TABLE III-continued (Multivariant clusters)

| Internal designation | Variants |
|---|---|
| D709 | 939,940,17611,17612 |
| D710 | 17624,17625,17626 |
| D711 | 3272.17629 |
| D712 | 1414,3273 |
| D713 | 3275,3276,17631 |
| D714 | 1843.3277 |
| D715 | 946.947 |
| D716 | 948.17637 |
| D717 | 17644.17645 |
| D718 | 3284.17647 |
| D719 | 17652.17653 |
| D720 | 17654.17655 |
| D721 | 17658.17659 |
| D722 | 17663.17664 |
| D723 | 954.3289 |
| D724 | 3290,3291,3292 |
| D725 | 17666.17667 |
| D726 | 17668,17669,17670,17672 |
| D727 | 955,17673,17674,17675 |
| D728 | 302,1878,1879,1886 |
| D729 | 1599,17681,17682 |
| D730 | 17683.17684 |
| D731 | 17685,17686,17687 |
| D732 | 17690.17691 |
| D733 | 243.181 |
| D734 | 17695.17696 |
| D735 | 185.273 |
| D736 | 17697.17698 |
| D737 | 17699.17701 |
| D738 | 3305.17702 |
| D739 | 966.3307 |
| D740 | 967.3309 |
| D741 | 971,972,17708,17709 |
| D742 | 974.17713 |
| D743 | 1822,17715,17716,17717,17718 |
| D744 | 3314.17721 |
| D745 | 977.17727 |
| D746 | 17728,17729,17730 |
| D747 | 978.979 |
| D748 | 1664,1667,1671 |
| D749 | 980.17749 |
| D750 | 17754,17755,17757 |
| D751 | 17760,17761,17762,17763 |
| D752 | 17765.17766 |
| D753 | 77.79 |
| D754 | 3323.17775 |
| D755 | 262.319 |
| D756 | 988.3325 |
| D757 | 350.991 |
| D758 | 17791.17792 |
| D759 | 17796.17798 |
| D760 | 3327.178 |
| D761 | 3329.333 |
| D762 | 3331.3332 |
| D763 | 1561.1562 |
| D764 | 996,17811,17812 |
| D765 | 71,17813,17814 |
| D766 | 17815.17816 |
| D767 | 3343,3344,3346,3347,3348,17817,17818 |
| D768 | 1953,1954,17819 |
| D769 | 998.17822 |
| D770 | 3352.17823 |
| D771 | 17824.17826 |
| D772 | 3354.3355 |
| D773 | 1001.1718 |
| D774 | 1002.17841 |
| D775 | 17850.17851 |
| D776 | 17853.17854 |
| D777 | 3362,3363,3364,3365,3366,3367 |
| D778 | 1005,1006,1007,1008,1009,1010,1011,1012,1013,1014,1015,1016,1017,1018,1019,1020,1021,1022,1023,1024,1025,1026,1027,1028,1029,3368,3369,3370,3371,3372,3373,3374,3375,3376,3377,3378,17858,17860,17861,17863,17864,17866,17867 |
| D779 | 17871.17872 |
| D780 | 1384.17875 |
| D781 | 1030.1031 |
| D782 | 1032.3382 |
| D783 | 17879.1788 |
| D784 | 17881,17882,17883,17884,17885,17886 |
| D785 | 17892.17895 |
| D786 | 3384,17896,17897 |
| D787 | 1630,17901,17902 |
| D788 | 17905,17906,17907,17908,17909,17910 |
| D789 | 17913.17914 |
| D790 | 3388,17916,17917,17918 |
| D791 | 17919,17920,17921,17922,17923,17924,17925,17926,17927,17928,17929,17930,17931,17932,17933,17934,17935,17936,17937,17938,17939,17940,17941,17942,17943,17944,17945,17946,17947,17948,17949 |
| D792 | 3391.1796 |
| D793 | 17962,17963,17964,17965,17966 |
| D794 | 264,17972,17973,17974,17975,17976,17977 |
| D795 | 17980.17981 |
| D796 | 17986.17987 |
| D797 | 1045.1046 |
| D798 | 263,1050,1837,18000,18001 |
| D799 | 1529.153 |
| D800 | 18003.18004 |
| D801 | 1858.18005 |
| D802 | 18008.18009 |
| D803 | 18018.18019 |
| D804 | 18020,18021,18022 |
| D805 | 18027.18028 |
| D806 | 18042.18043 |
| D807 | 3413.18045 |
| D808 | 1537,18046,18047 |
| D809 | 18050.18051 |
| D810 | 344.1951 |
| D811 | 18059.1806 |
| D812 | 1060.18063 |
| D813 | 240,1062,1063,1064,1066,1067,1068,1069,1070,1988,3421,3422,3423,3426,3427 |
| D814 | 3428.18069 |
| D815 | 3429.18072 |
| D816 | 1071,3430,18073 |
| D817 | 3431.3432 |
| D818 | 18074.18076 |
| D819 | 3433.18081 |
| D820 | 1072.18084 |
| D821 | 3434.18085 |
| D822 | 1073,2009,3435,3436,3438,18087 |
| D823 | 1989.18088 |
| D824 | 1517.18098 |
| D825 | 18104.18105 |
| D826 | 18109.1811 |
| D827 | 1076.18112 |
| D828 | 3445.18114 |
| D829 | 3446,18116,18117 |
| D830 | 340.108 |
| D831 | 18127.18128 |
| D832 | 1081.18132 |
| D833 | 1082.345 |
| D834 | 1083,1084,1085,1086,1087,18135 |
| D835 | 18139,18141,18142,18143,18144,18145,18146,18147,18149,18150,18151,18153,18154,18155,18156,18157,18159,18160,18161,18162,18163,18 |

TABLE III-continued (Multivariant clusters)

| Internal designation | Variants |
|---|---|
| | 164,18165,18166,18168,18169,18171 |
| D836 | 1089,3455,18176 |
| D837 | 1090,1091,1092,1093,1094,1095,3456,3457,3458,3459,3461,18177,18178,18179,18180 |
| D838 | 18182.18183 |
| D839 | 18184.18185 |
| D840 | 3462,18187,18188 |
| D841 | 18191.18192 |
| D842 | 278,282,283,1866,18194 |
| D843 | 18196.18197 |
| D844 | 202,1100,1101,1103,1105,1106,3463,3468,3469,18199,18200,18201,18202,18203,18204,18205,18206,18207,18208,18209,18211,18213,18214,18215,18216,18217 |
| D845 | 3470.18221 |
| D846 | 1107.1565 |
| D847 | 3472,18226,18227,18228,18229 |
| D848 | 18233.18234 |
| D849 | 3476,3477,18236 |
| D850 | 18241,18242,18243 |
| D851 | 3479.18244 |
| D852 | 1903,18245,18246 |
| D853 | 161.1825 |
| D854 | 18251.18252 |
| D855 | 18255.18256 |
| D856 | 18257.18258 |
| D857 | 3482,3483,3484,3485,3486,3487,3488,18262,18263 |
| D858 | 18267.18268 |
| D859 | 3490,3491,3492,18269 |
| D860 | 18271.18272 |
| D861 | 18275.18276 |
| D862 | 1116,3493,3494,18279 |
| D863 | 18285.18286 |
| D864 | 18289,18290,18291 |
| D865 | 1118,3496,18292,18293 |
| D866 | 3498.18295 |
| D867 | 1120.18299 |
| D868 | 18301.18302 |
| D869 | 18305.18306 |
| D870 | 1123,3501,3502,3503,18311,18312,18313,18314 |
| D871 | 18315.18316 |
| D872 | 1127.3506 |
| D873 | 18328,18329,18330 |
| D874 | 18332,18333,18334 |
| D875 | 3509,3510,3511,18340 |
| D876 | 18342.18343 |
| D877 | 3514,3515,18347 |
| D878 | 1131.18348 |
| D879 | 1665.1668 |
| D880 | 18354,18355,18356 |
| D881 | 168.18359 |
| D882 | 18362,18364,18365,18366,18369,18370 |
| D883 | 18372,18373,18374 |
| D884 | 18375.18376 |
| D885 | 1137.3522 |
| D886 | 18390.18391 |
| D887 | 18392.18393 |
| D888 | 18397.18398 |
| D889 | 3526.18404 |
| D890 | 18409.1841 |
| D891 | 1142,18412,18413,18414 |
| D892 | 3530.18418 |
| D893 | 18423.18425 |
| D894 | 1501.18427 |
| D895 | 1472.1478 |
| D896 | 1143.1843 |
| D897 | 173,1677,1680 |
| D898 | 18432,18433,18434 |
| D899 | 18436.18437 |
| D900 | 18442,18443,18444,18445 |
| D901 | 1541,1542,1545,1546,18450,18451,18452,18453,18454,18455,18456,18457 |
| D902 | 18459.1846 |
| D903 | 1149,3546,3547 |
| D904 | 18465.18466 |
| D905 | 3552,18467,18468 |
| D906 | 18469.1847 |
| D907 | 1350.18472 |
| D908 | 3555.3556 |
| D909 | 18479,18480,18481 |
| D910 | 222.1884 |
| D911 | 1154.2045 |
| D912 | 18482.18483 |
| D913 | 3560.18486 |
| D914 | 18488.18489 |
| D915 | 1156.18492 |
| D916 | 18494,18495,18496 |
| D917 | 18501.18502 |
| D918 | 18503.18504 |
| D919 | 1157.3562 |
| D920 | 1158,18507,18508,18509,18510,18511 |
| D921 | 3565.3566 |
| D922 | 1161,1162,1163,1164,1165,1166,1167,1963,3568,3569,3571,3572,18515,18516,18517,18518,18519,18520,18521,18522,18523,18524,18525,18526,18527,18528,18529,18530,18531,18532,18533,18534,18536,18537,18538,18539,18540,18541,18542,18543,18544,18545,18546 |
| D923 | 1168,18548,18549,18550 |
| D924 | 92.1658 |
| D925 | 1170,3578,18551 |
| D926 | 1552,1856,1871,1974,3581,3582,3584,3586,18553,18554 |
| D927 | 1171.3587 |
| D928 | 18562.18564 |
| D929 | 18569,18570,18571,18572,18573 |
| D930 | 1177.18575 |
| D931 | 1178.18577 |
| D932 | 1180,3593,18580 |
| D933 | 1181.18583 |
| D934 | 1659,18584,18585 |
| D935 | 18586,18587,18588 |
| D936 | 1182.3597 |
| D937 | 3598.18589 |
| D938 | 18594.18595 |
| D939 | 3600.3601 |
| D940 | 1184,3602,3603 |
| D941 | 1185,3604,3605,3606 |
| D942 | 1187.3607 |
| D943 | 1188.18598 |
| D944 | 1194.18604 |
| D945 | 3612,3613,18606,18607 |
| D946 | 3614.18609 |
| D947 | 18610.18611 |
| D948 | 1195.18614 |
| D949 | 1196.18615 |
| D950 | 18616.18617 |
| D951 | 1808,3618,3620,18620 |
| D952 | 1493.18621 |
| D953 | 1199.18623 |
| D954 | 18624,18625,18626,18627,18629 |
| D955 | 1606,1607,18631,18632,18633,18634,18635 |
| D956 | 3627,18638,18639 |
| D957 | 1203,1204,1205,1923,18642 |
| D958 | 293.3631 |
| D959 | 1487.18645 |
| D960 | 1377,18646,18647,18648 |

TABLE III-continued

(Multivariant clusters)

| Internal designation | Variants |
|---|---|
| D961 | 1355.18649 |
| D962 | 1208.1209 |
| D963 | 221,18654,18655,18656 |
| D964 | 3640,3641,3642,18660 |
| D965 | 3644.18662 |
| D966 | 3645.18663 |
| D967 | 18664.18665 |
| D968 | 18666.18667 |
| D969 | 35,1343,18671 |
| D970 | 18672.18673 |
| D971 | 18680.18681 |
| D972 | 18683.18684 |
| D973 | 1732,3653,3655 |
| D974 | 1216.18689 |
| D975 | 1217,3656,3657 |
| D976 | 1223,1224,1225,1227,3659,3660,3661,3665,3667,3669,18691,18693,18694,18695,18696,18697,18698,18699,18701,18702,18703,18704,18705,18707,18708,18709,18710,18711,18712,18713,18714,18715,18716,18717,18718,18719,18720,18722,18723,18724,18725,18727,18728,18729,18730,18731,18732,18733,18734,18736,18737,18738,18739,18741,18742,18744,18745,18746,18747,18748,18749,18750,18751,18753,18754,18755,18757,18758,18760,18761,18762,18764,18765,18767,18768,18769,18770,18771,18772,18774,18775,18776,18777,18778,18781,18782,18783,18784,18785,18786,18787,18788,18790 |
| D977 | 3670,3671,3672,3673,3674,3675 |
| D978 | 18795.18796 |
| D979 | 3676.18797 |
| D980 | 3678.18799 |
| D981 | 1375,18816,18818,18819,18820 |
| D982 | 1522.1526 |
| D983 | 18822,18823,18824 |
| D984 | 1231.369 |
| D985 | 1232,1604,1698,3693,3694,3696 |
| D986 | 18835.18836 |
| D987 | 1921.18837 |
| D988 | 18840.18841 |
| D989 | 3701.3702 |
| D990 | 3703.3704 |
| D991 | 1236.1237 |
| D992 | 1238,1891,18847 |
| D993 | 1239,1240,3708,3709,18848 |
| D994 | 3712,3713,3714,18852,18853,18854,18855,18856,18857,18858 |
| D995 | 3715,3716,3717,3718,18860 |
| D996 | 3719.372 |
| D997 | 18864.18865 |
| D998 | 18866.18867 |
| D999 | 18870,18871,18872,18873,18874 |
| D1000 | 18877,18878,18879 |
| D1001 | 18880.18881 |
| D1002 | 3730.18894 |
| D1003 | 3731,3732,18895 |
| D1004 | 3734,18897,18898,18899 |
| D1005 | 1563,1564,1566 |
| D1006 | 3738.3739 |
| D1007 | 1251,1252,1253,1254,1255,1256,1257,2044,3743,18906,18907 |
| D1008 | 1258.1259 |
| D1009 | 311,3744,3745,18911,18913,18915 |
| D1010 | 1262,1263,18916 |
| D1011 | 3748.18918 |
| D1012 | 18921,18924,18927 |
| D1013 | 3750.3751 |
| D1014 | 45,1366,18930 |
| D1015 | 18931.18932 |
| D1016 | 3754,3755,18934,18936,18937,18938,18939 |
| D1017 | 18941.18942 |
| D1018 | 3756,18943,18944 |
| D1019 | 1267.1268 |
| D1020 | 3758,18946,18947 |
| D1021 | 18948.18949 |
| D1022 | 1270,1271,1272,18950,18951,18952 |
| D1023 | 3762,18954,18955 |
| D1024 | 215,3763,3764,18957,18958,18959,18960 |
| D1025 | 18961,18962,18963 |
| D1026 | 18964.18965 |
| D1027 | 1275.377 |
| D1028 | 18968.18969 |
| D1029 | 3771,18971,18972,18973 |
| D1030 | 3775.18983 |
| D1031 | 1276,1277,1278 |
| D1032 | 1279.3776 |
| D1033 | 3778.18986 |
| D1034 | 18987.18988 |
| D1035 | 18989.1899 |
| D1036 | 18992,18993,18994,18995,18996,18997 |
| D1037 | 3782.3783 |
| D1038 | 19000.19001 |
| D1039 | 19002.19003 |
| D1040 | 196.272 |
| D1041 | 3792,3793,3794,3795,3797,3798,3799,19012,19013,19014,19015,19016,19018 |
| D1042 | 3801.3802 |
| D1043 | 19023.19024 |
| D1044 | 1290.19027 |
| D1045 | 167,365,1421,19031,19032,19033,19034 |
| D1046 | 19035.19036 |
| D1047 | 19037,19039,19040,19041 |
| D1048 | 1293.19042 |
| D1049 | 1296,1632,1635 |
| D1050 | 19045,19046,19047 |
| D1051 | 1300.381 |
| D1052 | 19059,19060,19061 |
| D1053 | 3813,3814,3815 |
| D1054 | 19065,19066,19067 |
| D1055 | 19068,19069,19071,19072 |
| D1056 | 3816.19073 |
| D1057 | 3817,19074,19075,19076 |
| D1058 | 3819.382 |
| D1059 | 3822.19079 |
| D1060 | 19081.19082 |
| D1061 | 19083.19084 |
| D1062 | 1305,1970,19093 |
| D1063 | 19095,19096,19097,19098,19099,19100 |
| D1064 | 1734.3828 |
| D1065 | 1309,1310,3832 |
| D1066 | 19115.19116 |
| D1067 | 19117.19118,19119 |
| D1068 | 19122,19123,19124 |
| D1069 | 1314,19125,19126 |
| D1070 | 1315,3837,19134 |
| D1071 | 3839.384 |
| D1072 | 1705.1748 |
| D1073 | 1317,1750,2006,3846,3847,19140 |
| D1074 | 3848,3849,3850,3851,3852,3853,3854,3855,3856,3857,3858,3859 |
| D1075 | 19143.19144 |
| D1076 | 19151,19152,19153,19154,19155,19156,19157,19158,19160 |
| D1077 | 19161.19162 |
| D1078 | 1322,1323,1324,1325,19169,19171,19172,19173 |
| D1079 | 1326,19175,19176 |

TABLE III-continued (Multivariant clusters)

| Internal designation | Variants |
|---|---|
| D1080 | 19182,19183 |
| D1081 | 3870,3871,19191 |

TABLE IVa (Novelty:95%)

| Seq Id No. | Positions of preferred fragments | Seq Id No. | Positions of preferred fragments |
|---|---|---|---|
| 24 | [1–342] | 91 | [1–97] |
| 25 | [1–47] | 92 | [1–586] |
| 30 | [1–54] | 93 | [1–311] |
| 31 | [1–506] | 94 | [1–26],[86–452] |
| 32 | [1–44] | 95 | [1–326] |
| 33 | [1–479] | 96 | [1–383] |
| 35 | [361–386] | 97 | [1–672] |
| 36 | [1–245] | 98 | [1–130],[384–451] |
| 38 | [1–491] | 100 | [1–498] |
| 39 | [1–678] | 102 | [1–248] |
| 41 | [279–353],[415–442] | 103 | [1–351] |
| 43 | [1–512] | 104 | [1–356] |
| 44 | [1–339] | 105 | [1–278] |
| 45 | [1–67],[516–544] | 106 | [1–104],[288–345] |
| 46 | [1–484] | 107 | [1–492] |
| 47 | [1–495] | 108 | [1–38],[235–301] |
| 48 | [1–308],[397–535] | 109 | [1–500] |
| 49 | [1–432] | 110 | [542–570] |
| 50 | [1–410] | 111 | [1–584] |
| 51 | [46–465] | 112 | [1–79] |
| 54 | [1–505] | 113 | [1–402] |
| 55 | [1–546] | 114 | [368–525] |
| 56 | [1–507] | 115 | [1–480] |
| 57 | [1–480] | 116 | [1–496] |
| 58 | [1–392] | 117 | [1–36] |
| 59 | [1–273] | 118 | [1–497] |
| 60 | [1–273] | 119 | [1–542] |
| 63 | [1–343] | 121 | [1–466] |
| 65 | [1–174] | 123 | [289–465] |
| 66 | [390–481] | 124 | [1–488] |
| 67 | [1–478] | 125 | [1–493] |
| 68 | [1–323] | 126 | [1–297] |
| 69 | [1–443] | 127 | [1–463] |
| 71 | [1–329] | 128 | [1–554] |
| 72 | [1–488] | 129 | [1–180],[421–467] |
| 73 | [169–268] | 130 | [1–457] |
| 74 | [1–417] | 131 | [1–392] |
| 75 | [1–420] | 132 | [1–477] |
| 76 | [1–486] | 134 | [1–422] |
| 78 | [1–793] | 135 | [85–286],[327–462],[498–570] |
| 80 | [1–308] | 136 | [1–44] |
| 82 | [1–570] | 137 | [1–502] |
| 86 | [1–516] | 138 | [1–495] |
| 87 | [1–674] | 139 | [1–646] |
| 88 | [1–402] | 140 | [1–36] |
| 89 | [1–473] | 141 | [1–456] |
| 90 | [1–474] | 142 | [1–488] |
| 143 | [1–219] | 198 | [1–178],[293–471] |
| 144 | [1–524] | 200 | [1–391],[523–829] |
| 145 | [1–39],[73–514] | 201 | [247–477] |
| 146 | [1–525] | 203 | [1–451] |
| 147 | [1–438] | 204 | [1–505] |
| 148 | [1–265] | 205 | [1–277] |
| 149 | [1–256] | 206 | [1–701] |
| 150 | [1–320] | 207 | [450–499] |
| 151 | [1–512] | 208 | [1–485] |
| 153 | [1–501] | 209 | [1–458] |
| 154 | [1–225] | 210 | [1–173] |
| 156 | [1–156] | 211 | [1–481] |
| 158 | [1–198] | 212 | [1–452] |

TABLE IVa-continued (Novelty:95%)

| Seq Id No. | Positions of preferred fragments | Seq Id No. | Positions of preferred fragments |
|---|---|---|---|
| 159 | [1–72],[406–533] | 213 | [1–472] |
| 161 | [1–307] | 214 | [1–191] |
| 162 | [1–721] | 215 | [1–321] |
| 163 | [1–495] | 216 | [1–472] |
| 165 | [1–594] | 217 | [1–461] |
| 166 | [1–501] | 220 | [93–480] |
| 168 | [141–195] | 222 | [1–46],[383–483] |
| 169 | [66–148] | 223 | [451–490] |
| 170 | [1–542] | 224 | [1–492] |
| 171 | [1–528] | 225 | [1–37] |
| 172 | [1–450] | 227 | [1–524] |
| 173 | [147–305] | 229 | [1–55] |
| 174 | [1–514] | 230 | [1–306] |
| 175 | [161–286] | 231 | [1–35],[238–308] |
| 176 | [1–501] | 233 | [80–253] |
| 177 | [1–31] | 234 | [1–405] |
| 178 | [1–542] | 235 | [1–594] |
| 179 | [1–194],[278–303] | 236 | [1–400] |
| 180 | [1–504] | 237 | [1–481] |
| 181 | [1–35] | 238 | [1–663] |
| 182 | [1–509] | 239 | [1–540] |
| 183 | [1–501] | 240 | [1–559] |
| 184 | [1–466] | 241 | [1–479] |
| 186 | [1–485] | 242 | [1–516] |
| 187 | [1–197],[486–521] | 243 | [1–558] |
| 188 | [1–332] | 244 | [1–478] |
| 189 | [1–262] | 245 | [1–438] |
| 190 | [1–79],[258–552] | 246 | [1–451] |
| 191 | [121–164] | 247 | [1–458] |
| 192 | [1–249] | 248 | [1–473] |
| 193 | [1–324] | 249 | [1–322] |
| 194 | [1–334] | 250 | [1–548] |
| 195 | [1–337] | 251 | [1–453] |
| 197 | [1–49] | 252 | [541–578] |
| 253 | [1–672] | 322 | [251–462] |
| 254 | [1–368] | 323 | [50–235] |
| 256 | [158–476] | 324 | [1–496] |
| 257 | [1–506] | 325 | [1–520] |
| 258 | [1–447] | 326 | [251–417] |
| 260 | [1–467] | 327 | [1–292] |
| 261 | [1–508] | 328 | [1–179],[435–515] |
| 262 | [1–477] | 330 | [1–26] |
| 263 | [1–238] | 333 | [1–496] |
| 264 | [1–571] | 334 | [1–461] |
| 265 | [1–155],[271–497] | 335 | [251–475] |
| 267 | [69–483] | 337 | [1–638] |
| 274 | [1–473] | 340 | [1–286],[346–511] |
| 275 | [1–27],[65–212] | 341 | [1–487] |
| 276 | [364–469] | 342 | [1–79],[138–460] |
| 278 | [1–472] | 343 | [1–452] |
| 282 | [1–490] | 344 | [1–478] |
| 283 | [1–479] | 345 | [40–142] |
| 284 | [1–489] | 346 | [1–537] |
| 285 | [1–466] | 347 | [1–488] |
| 286 | [1–451] | 348 | [1–470] |
| 287 | [1–609] | 349 | [1–564] |
| 288 | [1–296] | 350 | [1–494] |
| 289 | [1–503] | 351 | [1–520] |
| 290 | [1–386] | 352 | [1–490] |
| 291 | [1–499] | 353 | [1–491] |
| 293 | [1–112],[384–432] | 354 | [1–59],[286–363] |
| 295 | [1–322] | 356 | [1–522] |
| 296 | [1–40] | 357 | [1–485] |
| 297 | [1–496] | 358 | [1–470] |
| 298 | [1–451] | 359 | [1–332] |
| 300 | [1–53],[138–248] | 361 | [1–737] |
| 301 | [1–92],[319–378] | 362 | [410–470] |
| 302 | [1–483] | 363 | [1–451] |
| 303 | [1–496] | 364 | [1–488] |
| 305 | [1–522] | 366 | [1–455] |
| 306 | [1–140] | 367 | [1–494] |
| 307 | [1–25] | 369 | [1–482] |
| 309 | [1–483] | 370 | [1–513] |
| 310 | [1–467] | 371 | [1–437] |

TABLE IVa-continued (Novelty:95%)

| Seq Id No. | Positions of preferred fragments | Seq Id No. | Positions of preferred fragments |
|---|---|---|---|
| 312 | [1–88],[334–493] | 372 | [1–394] |
| 313 | [1–163],[442–570] | 373 | [1–474] |
| 314 | [1–386] | 374 | [1–319] |
| 315 | [32–128],[160–482] | 375 | [1–429] |
| 317 | [1–92],[371–460] | 376 | [1–524] |
| 318 | [1–557] | 377 | [1–459] |
| 319 | [1–587] | 378 | [1–284] |
| 379 | [1–496] | 436 | [1–64],[352–493] |
| 380 | [1–54],[422–495] | 437 | [1–457] |
| 382 | [1–300] | 438 | [1–343] |
| 383 | [1–569] | 439 | [1–428] |
| 384 | [1–480] | 440 | [1–537] |
| 385 | [1–421] | 441 | [1–28],[113–197] |
| 386 | [1–498] | 442 | [1–502] |
| 387 | [1–497] | 443 | [1–467] |
| 388 | [1–474] | 444 | [1–464] |
| 389 | [127–320] | 445 | [1–382] |
| 390 | [1–42] | 446 | [1–476] |
| 391 | [1–457] | 447 | [1–505] |
| 392 | [1–309] | 448 | [1–495] |
| 393 | [1–349] | 449 | [1–503] |
| 395 | [1–409] | 450 | [1–461] |
| 397 | [1–443] | 451 | [1–507] |
| 398 | [1–574] | 452 | [1–480] |
| 399 | [1–114] | 453 | [1–511] |
| 400 | [75–456] | 454 | [150–493] |
| 401 | [1–482] | 455 | [1–46] |
| 402 | [200–227] | 456 | [1–483] |
| 404 | [1–417] | 457 | [1–100] |
| 406 | [1–207],[330–450] | 458 | [1–378] |
| 407 | [1–510] | 459 | [1–517] |
| 408 | [1–435] | 461 | [1–528] |
| 409 | [1–485] | 463 | [1–323] |
| 410 | [1–37] | 465 | [227–303] |
| 411 | [1–482] | 466 | [1–497] |
| 412 | [1–482] | 467 | [439–480] |
| 413 | [1–419] | 469 | [1–388] |
| 414 | [1–463] | 470 | [1–478] |
| 415 | [1–219] | 471 | [1–467] |
| 416 | [1–460] | 472 | [1–33] |
| 417 | [1–474] | 473 | [1–550] |
| 419 | [1–172] | 474 | [1–303] |
| 420 | [1–505] | 475 | [1–169] |
| 421 | [1–504] | 476 | [1–471] |
| 425 | [1–407] | 477 | [1–252] |
| 426 | [282–324] | 478 | [1–472] |
| 427 | [1–322] | 479 | [1–510] |
| 428 | [1–498] | 480 | [1–505] |
| 430 | [1–83],[411–469] | 482 | [1–286] |
| 431 | [1–464] | 483 | [1–451] |
| 432 | [1–494] | 484 | [161–244] |
| 433 | [1–413] | 485 | [1–482] |
| 434 | [1–323] | 486 | [1–81],[156–383] |
| 435 | [1–548] | 487 | [1–370] |
| 489 | [1–234] | 542 | [1–455] |
| 490 | [1–458] | 543 | [1–469] |
| 491 | [1–457] | 544 | [77–490] |
| 492 | [1–486] | 545 | [1–467] |
| 493 | [1–452] | 546 | [1–454] |
| 494 | [1–295] | 547 | [1–485] |
| 495 | [1–63] | 548 | [1–526] |
| 496 | [1–83],[252–468] | 549 | [1–484] |
| 497 | [1–481] | 550 | [1–457] |
| 498 | [1–296] | 551 | [1–527] |
| 499 | [1–422] | 552 | [1–27] |
| 500 | [1–461] | 553 | [1–513] |
| 501 | [1–506] | 554 | [1–463] |
| 502 | [34–427] | 555 | [1–232] |
| 504 | [1–489] | 556 | [1–491] |
| 505 | [1–237],[287–374] | 557 | [1–474] |
| 506 | [207–458] | 558 | [1–471] |
| 508 | [1–473] | 559 | [1–384] |
| 509 | [1–469] | 560 | [1–470] |
| 510 | [1–486] | 561 | [137–504] |
| 512 | [1–270] | 563 | [1–373] |
| 513 | [1–470] | 564 | [1–481] |
| 514 | [1–383],[425–453] | 565 | [1–492] |
| 515 | [1–480] | 566 | [1–509] |
| 516 | [1–496] | 567 | [1–479] |
| 517 | [1–478] | 568 | [33–110],[139–361],[431–468] |
| 518 | [1–458] | 569 | [1–375] |
| 519 | [1–560] | 570 | [1–486] |
| 520 | [1–465] | 571 | [49–601] |
| 521 | [1–181] | 572 | [1–253] |
| 522 | [1–278] | 573 | [1–496] |
| 523 | [1–417] | 574 | [277–317] |
| 524 | [1–466] | 575 | [1–161] |
| 525 | [1–469] | 576 | [1–134] |
| 526 | [1–240] | 577 | [1–507] |
| 528 | [1–457] | 578 | [1–223] |
| 529 | [1–495] | 579 | [1–510] |
| 531 | [1–467] | 580 | [263–412] |
| 532 | [1–487] | 581 | [1–480] |
| 533 | [1–491] | 582 | [1–509] |
| 534 | [1–193] | 583 | [1–458] |
| 535 | [1–395] | 584 | [1–538] |
| 536 | [1–248] | 585 | [1–42],[145–513] |
| 537 | [1–501] | 586 | [1–531] |
| 538 | [1–225] | 587 | [1–329] |
| 539 | [1–401] | 588 | [1–491] |
| 540 | [285–472] | 589 | [1–525] |
| 590 | [1–452] | 645 | [1–322] |
| 591 | [1–523] | 646 | [1–336] |
| 592 | [1–470] | 647 | [1–368] |
| 593 | [1–95] | 648 | [1–483] |
| 594 | [169–238] | 649 | [1–511] |
| 595 | [1–374] | 650 | [1–138],[175–489] |
| 596 | [1–460] | 651 | [1–295] |
| 597 | [1–461] | 653 | [1–519] |
| 598 | [188–263] | 654 | [1–294] |
| 600 | [1–505] | 656 | [1–486] |
| 601 | [1–169] | 657 | [1–510] |
| 602 | [1–247] | 658 | [1–553] |
| 604 | [184–416] | 660 | [1–460] |
| 605 | [1–92] | 661 | [1–451] |
| 607 | [1–448] | 662 | [1–487] |
| 608 | [1–208] | 663 | [1–458] |
| 609 | [35–246] | 664 | [1–535] |
| 610 | [62–159] | 665 | [1–488] |
| 611 | [1–459] | 666 | [1–539] |
| 612 | [1–148] | 667 | [54–490] |
| 613 | [1–26] | 668 | [1–152],[289–498] |
| 614 | [1–506] | 669 | [1–540] |
| 615 | [1–488] | 670 | [1–497] |
| 616 | [1–481] | 671 | [1–506] |
| 617 | [1–494] | 673 | [1–35],[64–192] |
| 618 | [1–358] | 674 | [1–469] |
| 619 | [1–208] | 675 | [1–491] |
| 620 | [1–208] | 676 | [1–429] |
| 621 | [1–278] | 677 | [1–497] |
| 622 | [1–476] | 678 | [1–473] |
| 623 | [1–83] | 679 | [1–39] |
| 624 | [1–448] | 681 | [1–399] |
| 626 | [1–463] | 682 | [1–508] |
| 627 | [1–487] | 683 | [1–535] |
| 628 | [1–31] | 684 | [1–308] |
| 629 | [1–478] | 685 | [1–452] |
| 631 | [1–458] | 686 | [1–120] |
| 632 | [1–502] | 687 | [1–497] |
| 633 | [1–485] | 688 | [1–499] |
| 634 | [1–464] | 689 | [1–467] |
| 635 | [1–494] | 690 | [179–523] |
| 636 | [1–480] | 691 | [1–473] |
| 639 | [1–469] | 692 | [1–503] |
| 640 | [1–217] | 693 | [1–457] |
| 641 | [1–458] | 694 | [1–114],[276–541] |
| 642 | [321–497] | 695 | [1–339] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 643 | [1–272] | 696 | [1–172] | 843 | [1–536] | 894 | [1–257],[477–548] |
| 697 | [1–95] | 757 | [1–90],[462–494] | 844 | [1–526] | 895 | [1–499] |
| 698 | [1–435] | 758 | [1–392] | 845 | [1–58] | 896 | [1–323] |
| 699 | [1–518] | 759 | [1–169] | 846 | [1–170] | 898 | [1–453] |
| 700 | [1–387] | 760 | [1–467] | 847 | [1–471] | 900 | [1–422] |
| 701 | [94–332],[442–487] | 761 | [1–91] | 848 | [1–269] | 901 | [1–359] |
| 702 | [1–480] | 762 | [1–28] | 849 | [1–518] | 902 | [1–498] |
| 703 | [1–496] | 763 | [223–345] | 850 | [1–475] | 903 | [1–363] |
| 704 | [1–35],[462–492] | 764 | [1–472] | 851 | [1–492] | 904 | [1–539] |
| 705 | [1–479] | 765 | [1–457] | 852 | [1–474] | 905 | [1–170] |
| 706 | [1–369] | 766 | [460–492] | 853 | [1–290],[471–546] | 906 | [1–485] |
| 707 | [1–401] | 769 | [65–132],[286–327] | 854 | [1–241] | 907 | [1–464] |
| 708 | [1–501] | 770 | [1–477] | 855 | [1–484] | 908 | [1–469] |
| 709 | [1–170],[359–400] | 771 | [1–60],[92–506] | 858 | [1–514] | 909 | [1–707] |
| 710 | [1–318],[427–472] | 772 | [1–376] | 859 | [1–481] | 910 | [1–604] |
| 711 | [1–169] | 773 | [1–224],[392–440] | 860 | [1–508] | 911 | [260–286],[345–452] |
| 712 | [455–484] | 774 | [1–498] | 861 | [1–535] | 912 | [1–173] |
| 713 | [1–490] | 775 | [1–498] | 862 | [1–504] | 913 | [1–413] |
| 714 | [1–28] | 776 | [1–487] | 863 | [1–403] | 914 | [226–347] |
| 715 | [1–525] | 777 | [1–452],[629–748] | 864 | [1–56] | 916 | [1–492] |
| 716 | [1–454] | 778 | [1–250],[473–589] | 865 | [1–557] | 918 | [332–462] |
| 717 | [1–452] | 779 | [1–471] | 866 | [1–537] | 919 | [332–517] |
| 720 | [94–469] | 780 | [1–80],[223–264],[530–704] | 867 | [1–496] | 920 | [1–356] |
| 721 | [1–191] | 781 | [1–133] | 921 | [1–526] | 974 | [1–282] |
| 722 | [1–560] | 782 | [1–487] | 922 | [1–478] | 975 | [1–229] |
| 725 | [97–148] | 783 | [134–516] | 923 | [1–474] | 976 | [1–479] |
| 727 | [1–145] | 784 | [1–468] | 924 | [1–434] | 977 | [1–514] |
| 728 | [249–478] | 785 | [1–515] | 925 | [1–523] | 978 | [39–266] |
| 729 | [1–289] | 786 | [1–516] | 926 | [1–522] | 980 | [1–85] |
| 731 | [1–329] | 787 | [1–476] | 927 | [1–358] | 981 | [1–503] |
| 732 | [1–380] | 788 | [410–618] | 929 | [1–247] | 982 | [1–31] |
| 733 | [1–381] | 789 | [1–169] | 930 | [60–196] | 983 | [1–414] |
| 734 | [1–280] | 790 | [439–494] | 931 | [1–458] | 984 | [1–540] |
| 737 | [1–474] | 791 | [1–464] | 932 | [1–529] | 985 | [1–482] |
| 738 | [1–378] | 792 | [1–484] | 935 | [1–404] | 986 | [1–488] |
| 740 | [1–95],[363–454] | 793 | [1–130],[169–492] | 936 | [1–504] | 987 | [1–429] |
| 741 | [1–103],[371–463] | 794 | [410–453] | 937 | [1–602] | 988 | [1–492] |
| 742 | [1–503] | 796 | [1–489] | 938 | [1–495] | 989 | [1–509] |
| 743 | [1–327] | 798 | [1–478] | 939 | [1–521] | 990 | [283–383] |
| 745 | [1–473] | 800 | [1–198],[263–577] | 940 | [1–539] | 991 | [1–551] |
| 746 | [1–519] | 801 | [1–194] | 941 | [1–557] | 992 | [268–549] |
| 747 | [63–442] | 803 | [1–466] | 942 | [1–479] | 993 | [1–508] |
| 748 | [63–442] | 804 | [1–448] | 943 | [1–476] | 995 | [1–229] |
| 749 | [63–454] | 805 | [1–484] | 944 | [1–529] | 996 | [1–229] |
| 750 | [63–459] | 806 | [1–47],[132–510] | 945 | [1–605] | 1000 | [1–319] |
| 751 | [63–442] | 807 | [1–474] | 946 | [1–488] | 1001 | [1–490] |
| 754 | [1–487] | 809 | [1–96] | 947 | [1–285] | 1002 | [1–584] |
| 755 | [138–499] | 810 | [1–207] | 948 | [1–345] | 1003 | [1–520] |
| 811 | [1–38],[179–323],[410–451] | 868 | [1–491] | 949 | [1–557] | 1004 | [1–490] |
| 812 | [1–258] | 869 | [131–353] | 951 | [94–515] | 1005 | [1–452] |
| 814 | [1–484] | 870 | [1–209],[261–516] | 952 | [1–131] | 1006 | [1–348] |
| 815 | [1–543] | 871 | [1–183] | 953 | [1–260] | 1007 | [1–460] |
| 816 | [1–480] | 872 | [1–348] | 954 | [105–148] | 1008 | [1–443] |
| 817 | [1–507] | 873 | [331–365],[510–542] | 955 | [1–506] | 1009 | [1–425] |
| 818 | [1–69] | 874 | [304–339] | 956 | [1–267] | 1010 | [1–508] |
| 820 | [1–332] | 875 | [1–169] | 957 | [435–628] | 1011 | [1–468] |
| 821 | [1–409] | 877 | [1–246] | 958 | [1–525] | 1012 | [1–429] |
| 822 | [1–169] | 878 | [1–473] | 960 | [1–502] | 1013 | [1–494] |
| 826 | [1–331] | 879 | [1–486] | 961 | [1–525] | 1014 | [1–252] |
| 828 | [1–316] | 880 | [1–464] | 962 | [1–444] | 1015 | [1–429] |
| 829 | [1–482] | 882 | [1–489] | 964 | [1–384],[413–457] | 1016 | [63–413] |
| 831 | [1–58] | 883 | [1–504] | 965 | [1–498] | 1017 | [63–430] |
| 832 | [1–494] | 884 | [1–348] | 966 | [1–119],[162–311] | 1018 | [1–509] |
| 833 | [1–497] | 885 | [1–484] | 967 | [1–43] | 1019 | [1–516] |
| 834 | [1–650] | 886 | [1–499] | 968 | [1–549] | 1020 | [1–507] |
| 835 | [1–259] | 887 | [1–455] | 969 | [1–120] | 1021 | [1–411] |
| 836 | [1–486] | 888 | [1–452] | 970 | [1–459] | 1022 | [1–487] |
| 837 | [1–221] | 889 | [1–94],[124–489] | 971 | [1–492] | 1023 | [1–480] |
| 838 | [1–225] | 890 | [1–493] | 972 | [1–471] | 1024 | [1–443] |
| 840 | [1–510] | 891 | [1–408] | 973 | [35–181] | 1025 | [1–440] |
| 841 | [1–344] | 892 | [1–517] | 1026 | [1–464] | 1083 | [1–184] |
| 842 | [1–513] | 893 | [1–479] | 1027 | [63–524] | 1084 | [56–91],[166–418] |
|  |  |  |  | 1028 | [1—381] | 1086 | [165–415] |
|  |  |  |  | 1029 | [1–418] | 1088 | [1–33],[150–188] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 1030 | [1–474] | 1089 | [1–52] | 1184 | [1–486] | 1245 | [1–241] |
| 1031 | [1–556] | 1091 | [1–625] | 1186 | [75–189],[301–338], [483–548] | 1246 | [1–194] |
| 1032 | [1–537] | 1092 | [1–484] | | | | |
| 1033 | [1–425] | 1093 | [1–495] | 1187 | [1–510] | 1247 | [1–504] |
| 1034 | [1–462] | 1094 | [1–513] | 1188 | [1–472] | 1248 | [1–365] |
| 1035 | [1–455] | 1096 | [204–353],[386–439] | 1190 | [1–536] | 1249 | [1–468] |
| 1036 | [1–447] | 1097 | [1–550] | 1191 | [1–476] | 1250 | [1–537] |
| 1038 | [1–56] | 1098 | [1–517] | 1192 | [1–553] | 1251 | [1–568] |
| 1040 | [1–357] | 1099 | [1–485] | 1193 | [1–574] | 1252 | [1–492] |
| 1041 | [1–454] | 1102 | [1–88] | 1194 | [1–469] | 1253 | [1–528] |
| 1042 | [1–479] | 1104 | [1–487] | 1195 | [1–479] | 1254 | [1–515] |
| 1043 | [1–45] | 1107 | [1–361] | 1198 | [1–461] | 1255 | [1–512] |
| 1044 | [41–516] | 1108 | [1–526] | 1199 | [1–62] | 1256 | [1–481] |
| 1045 | [1–231] | 1109 | [1–194] | 1200 | [1–486] | 1257 | [1–484] |
| 1046 | [1–236] | 1110 | [1–523] | 1201 | [1–208] | 1258 | [1–170] |
| 1047 | [1–177] | 1113 | [179–484] | 1202 | [1–512] | 1259 | [342–386] |
| 1049 | [1–470] | 1114 | [1–220] | 1203 | [1–42],[123–148], [255–285] | 1260 | [67–371],[450–554] |
| 1050 | [1–238],[474—531] | 1115 | [222–261] | | | | |
| 1051 | [46–516] | 1116 | [1–367] | 1204 | [138–163],[270–300] | 1261 | [1–651] |
| 1056 | [1–486] | 1117 | [1–523] | 1262 | [1–97],[168–491] | 1323 | [1–204] |
| 1057 | [1–422] | 1118 | [1–135],[176–406] | 1264 | [1–490] | 1324 | [1–240] |
| 1058 | [1–450] | 1120 | [1–51] | 1265 | [1–540] | 1325 | [1–212] |
| 1059 | [1–567] | 1121 | [1–284] | 1266 | [1–308] | 1326 | [448–511] |
| 1060 | [1–452] | 1122 | [1–559] | 1267 | [1–516] | 1327 | [451–480] |
| 1061 | [1–92] | 1123 | [1–399] | 1268 | [1–612] | 1328 | [1–472] |
| 1062 | [1–402] | 1124 | [1–551] | 1270 | [1–210] | 1329 | [1–453] |
| 1063 | [1–468] | 1125 | [1–484] | 1271 | [1–311] | 1330 | [1–498] |
| 1064 | [1–557] | 1126 | [1–533] | 1272 | [1–249] | 1331 | [1–86] |
| 1066 | [1–315] | 1128 | [1–502] | 1273 | [1–435] | 1332 | [1–477] |
| 1067 | [1–483] | 1129 | [1–427] | 1274 | [1–227] | 1333 | [1–349] |
| 1068 | [1–379] | 1131 | [1–93],[439–471] | 1275 | [123–519] | 1334 | [1–394] |
| 1069 | [1–506] | 1132 | [1–528] | 1276 | [1–540] | 1335 | [1–341] |
| 1070 | [1–493] | 1133 | [1–349] | 1277 | [1–496] | 1336 | [1–318] |
| 1071 | [1–52],[413–529] | 1135 | [1–564] | 1278 | [1–487] | 1337 | [1–480] |
| 1072 | [1–396] | 1136 | [1–522] | 1279 | [1–315],[420–482] | 1338 | [30–212] |
| 1073 | [1–327] | 1137 | [1–524] | 1281 | [1–75] | 1342 | [1–464] |
| 1074 | [1–564] | 1138 | [1–356] | 1282 | [1–512] | 1345 | [121–225],[255–645] |
| 1075 | [1–492] | 1139 | [1–165] | 1283 | [1–519] | 1346 | [121–225],[255–422] |
| 1076 | [1–74] | 1140 | [1–479] | 1284 | [1–476] | 1347 | [1–169] |
| 1077 | [1–521] | 1141 | [1–494] | 1285 | [1–77] | 1348 | [1–86] |
| 1080 | [1–287],[347–509] | 1142 | [1–29],[149–219], [360–393] | 1287 | [1–490] | 1351 | [1–262] |
| | | | | 1288 | [1–74] | 1352 | [1–452] |
| 1081 | [1–190],[292–444] | 1143 | [1–510] | 1289 | [1–420] | 1354 | [1–511] |
| 1082 | [1–480] | 1144 | [1–468] | 1290 | [1–512] | 1355 | [1–619] |
| 1145 | [1–239] | 1205 | [1–42],[256–286] | 1291 | [1–527] | 1356 | [1–1108] |
| 1147 | [1–100] | 1206 | [1–153] | 1293 | [1–308],[390–484] | 1357 | [1–380] |
| 1149 | [1–505] | 1208 | [1–457] | 1294 | [1–366] | 1358 | [1–523] |
| 1151 | [1–529] | 1209 | [1–487] | 1295 | [1–467] | 1360 | [1–486] |
| 1152 | [1–371] | 1210 | [1–601] | 1296 | [1–263] | 1362 | [1–642] |
| 1153 | [1–452] | 1211 | [1–561] | 1297 | [1–27] | 1363 | [1–469] |
| 1154 | [1–223],[429–455] | 1212 | [1–454] | 1300 | [45–562] | 1364 | [1–489] |
| 1155 | [1–459] | 1213 | [1–243] | 1305 | [1–375] | 1365 | [1–567] |
| 1156 | [1–494] | 1214 | [48–268] | 1307 | [1–485] | 1366 | [1–67] |
| 1157 | [1–557] | 1215 | [1–357] | 1308 | [267–339] | 1368 | [1–498] |
| 1158 | [349–458] | 1216 | [1–505] | 1309 | [1–450] | 1369 | [1–232] |
| 1159 | [1–482] | 1218 | [1–455] | 1310 | [1–459] | 1372 | [1–514] |
| 1160 | [233–536] | 1219 | [1–453] | 1311 | [1–487] | 1374 | [1–514] |
| 1161 | [1–402],[464–507] | 1220 | [1–453] | 1312 | [1–516] | 1375 | [1–490] |
| 1162 | [1–401] | 1222 | [1–460] | 1313 | [1–471] | 1378 | [433–462] |
| 1163 | [1–401],[456–488] | 1226 | [1–202] | 1314 | [221–504] | 1379 | [1–34],[443–503] |
| 1164 | [1–405],[467–491] | 1228 | [1–594] | 1315 | [1–492] | 1380 | [1–475] |
| 1165 | [1–362] | 1229 | [1–579] | 1316 | [1–333] | 1381 | [271–470] |
| 1166 | [1–402],[464–488] | 1231 | [1–517] | 1317 | [446–471] | 1382 | [1–579] |
| 1167 | [1–400] | 1232 | [1–318] | 1318 | [44–144],[331–505] | 1383 | [1–362] |
| 1168 | [257–322] | 1233 | [1–42],[137–248] | 1319 | [1–562] | 1384 | [1–902] |
| 1169 | [1–388] | 1234 | [1–127],[183–489] | 1322 | [1–221] | 1385 | [1–471] |
| 1172 | [1–564] | 1235 | [1–317] | 1388 | [451–492] | 1448 | [1–461] |
| 1173 | [1–469] | 1236 | [1–485] | 1389 | [1–40] | 1449 | [1–240] |
| 1174 | [1–498] | 1237 | [1–455] | 1391 | [1–803] | 1450 | [1–239] |
| 1177 | [1–364] | 1238 | [376–536] | 1392 | [1–540] | 1451 | [1–240] |
| 1179 | [1–915] | 1239 | [1–468] | 1393 | [1–137] | 1452 | [1–239] |
| 1180 | [58–557] | 1240 | [1–567] | 1395 | [306–340] | 1453 | [1–686] |
| 1181 | [1–235] | 1242 | [1–409] | 1396 | [1–510] | 1455 | [1–506] |
| 1183 | [1–436] | 1244 | [1–563] | 1398 | [1–490] | 1456 | [1–491] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 1399 | [1–227],[311–477] | 1457 | [1–487] | 1549 | [1–425] | 1606 | [1–141] |
| 1400 | [1–428] | 1458 | [318–437] | 1550 | [1–544] | 1607 | [482–506] |
| 1401 | [293–426] | 1459 | [1–522] | 1551 | [1–508] | 1608 | [1–355] |
| 1402 | [1–496] | 1460 | [1–379] | 1552 | [1–44] | 1609 | [1–453] |
| 1403 | [474–524] | 1461 | [1–474] | 1553 | [1–679] | 1610 | [1–491] |
| 1404 | [1–484] | 1463 | [1–830] | 1554 | [1–225],[315–357] | 1611 | [252–354] |
| 1405 | [1–481] | 1465 | [573–623] | 1555 | [417–546] | 1612 | [1–311] |
| 1406 | [1–769] | 1466 | [211–411] | 1556 | [1–430] | 1615 | [1–513] |
| 1407 | [1–568] | 1469 | [1–481] | 1557 | [1–492] | 1616 | [1–954] |
| 1410 | [1–552] | 1470 | [1–505] | 1558 | [1–540] | 1617 | [1–441] |
| 1411 | [1–470] | 1472 | [1–72] | 1559 | [1–490] | 1618 | [1–461] |
| 1413 | [1–273] | 1473 | [1–76] | 1561 | [1–466] | 1619 | [1–468] |
| 1414 | [1–504] | 1475 | [1–472] | 1562 | [1–525] | 1620 | [82–113] |
| 1415 | [1–80],[114–583] | 1476 | [1–486] | 1563 | [1–515] | 1622 | [1–526] |
| 1417 | [1–420] | 1477 | [1–1111] | 1623 | [1–513] | 1679 | [1–459] |
| 1418 | [1–30],[417–498] | 1478 | [1–72],[450–516] | 1624 | [1–477] | 1680 | [147–305] |
| 1419 | [1–173],[479–525] | 1479 | [1–532] | 1625 | [1–396] | 1681 | [1–412] |
| 1420 | [1–490] | 1482 | [1–415] | 1626 | [1–463] | 1682 | [1–517] |
| 1422 | [1–520] | 1485 | [1–190],[440–512] | 1627 | [1–508] | 1683 | [1–36],[455–486] |
| 1423 | [1–476] | 1486 | [1–480] | 1628 | [1–321] | 1684 | [1–328],[405–523] |
| 1425 | [180–544] | 1489 | [1–436] | 1629 | [1–348] | 1685 | [1–691] |
| 1426 | [1–386],[469–554] | 1490 | [1–678] | 1630 | [1–486] | 1686 | [1–448] |
| 1428 | [1–325] | 1491 | [1–278],[308–453] | 1631 | [1–472] | 1687 | [1–517] |
| 1429 | [1–540] | 1492 | [1–483] | 1632 | [1–259] | 1688 | [1–456] |
| 1430 | [1–495] | 1493 | [1–496] | 1633 | [1–25],[198–453] | 1689 | [330–506] |
| 1431 | [144–494] | 1495 | [1–427] | 1634 | [1–485] | 1690 | [1–464] |
| 1434 | [1–500] | 1496 | [1–266],[306–510] | 1635 | [1–283],[413–457] | 1692 | [1–472] |
| 1435 | [1–216],[284–325],[379–510] | 1497 | [494–540] | 1636 | [1–476] | 1693 | [1–454] |
| 1436 | [123–255] | 1498 | [1–776] | 1637 | [1–183] | 1694 | [1–469] |
| 1437 | [107–497] | 1499 | [1–334] | 1638 | [1–437] | 1695 | [1–293] |
| 1438 | [1–336] | 1500 | [1–454] | 1639 | [1–478] | 1696 | [1–577] |
| 1440 | [293–339] | 1501 | [1–435] | 1640 | [1–182],[214–484] | 1697 | [1–465] |
| 1441 | [1–343] | 1502 | [1–270] | 1641 | [1–379] | 1698 | [1–433] |
| 1442 | [1–523] | 1503 | [1–372] | 1642 | [1–456] | 1700 | [1–782] |
| 1443 | [1–466] | 1504 | [1–374] | 1643 | [1–600] | 1701 | [1–85] |
| 1444 | [1–54],[240–401],[436–510] | 1505 | [1–517] | 1645 | [1–468] | 1702 | [1–172] |
| 1445 | [1–239] | 1506 | [1–524] | 1646 | [1–488] | 1703 | [1–42],[127–457] |
| 1446 | [1–484] | 1509 | [1–459] | 1647 | [1–248] | 1704 | [1–130],[583–621] |
| 1447 | [1–26],[318–364] | 1510 | [1–433] | 1648 | [1–414] | 1705 | [1–544] |
| 1511 | [1–537] | 1564 | [1–522] | 1650 | [1–413] | 1706 | [1–489] |
| 1514 | [1–509] | 1565 | [1–335] | 1651 | [1–437] | 1707 | [1–505] |
| 1516 | [1–543] | 1566 | [1–474] | 1652 | [1–107],[136–473] | 1708 | [1–457] |
| 1517 | [1–362],[623–752] | 1567 | [443–521] | 1653 | [1–517] | 1709 | [1–509] |
| 1519 | [1–63] | 1568 | [1–42],[303–386] | 1654 | [1–108],[325–505] | 1710 | [1–494] |
| 1520 | [1–426] | 1569 | [1–673] | 1655 | [1–474] | 1711 | [1–37],[192–511] |
| 1521 | [1–324] | 1571 | [1–482] | 1656 | [1–459] | 1712 | [1–50] |
| 1522 | [1–501] | 1572 | [1–322] | 1657 | [1–482] | 1713 | [1–356] |
| 1523 | [1–498] | 1573 | [1–502] | 1658 | [1–637] | 1714 | [1–481] |
| 1524 | [1–444] | 1574 | [1–566] | 1662 | [368–396] | 1715 | [1–475] |
| 1525 | [1–512] | 1576 | [1–529] | 1663 | [1–581] | 1716 | [73–497] |
| 1526 | [1–589] | 1577 | [1–62] | 1664 | [1–737] | 1717 | [1–496] |
| 1527 | [1–566] | 1579 | [1–494] | 1666 | [1–259] | 1718 | [1–476] |
| 1528 | [1–225] | 1580 | [1–510] | 1667 | [1–474] | 1719 | [1–506] |
| 1529 | [1–511] | 1582 | [1–487] | 1669 | [1–585] | 1720 | [1–511] |
| 1530 | [1–547] | 1583 | [1–455] | 1671 | [1–531] | 1721 | [1–1062] |
| 1532 | [331–372] | 1584 | [1–501] | 1673 | [190–416] | 1722 | [1–497] |
| 1533 | [279–327],[436–509] | 1585 | [1–492] | 1674 | [1–476] | 1723 | [301–498] |
| 1534 | [1–502] | 1587 | [159–237] | 1675 | [1–357] | 1724 | [1–444] |
| 1535 | [1–597] | 1588 | [1–484] | 1676 | [1–41],[112–406] | 1725 | [1–527] |
| 1536 | [156–492] | 1590 | [1–360] | 1677 | [148–306],[473–602] | 1726 | [1–494] |
| 1537 | [1–452] | 1591 | [1–36] | 1678 | [1–418] | 1727 | [98–202],[299–567] |
| 1538 | [1–496] | 1592 | [1–36],[471–518] | 1729 | [1–482] | 1783 | [1–714] |
| 1539 | [1–501] | 1593 | [1–611] | 1730 | [1–470] | 1785 | [1–477] |
| 1540 | [1–524] | 1595 | [95–467] | 1731 | [1–83],[115–483] | 1786 | [1–622] |
| 1541 | [1–268] | 1596 | [1–28],[70–112],[164–254],[305–391],[423–541] | 1732 | [1–491] | 1787 | [1–308] |
| 1542 | [1–215] | | | 1733 | [114–568] | 1789 | [1–172],[212–462] |
| 1543 | [1–923] | 1597 | [1–27] | 1734 | [1–357] | 1790 | [1–480] |
| 1544 | [1–463] | 1598 | [1–502] | 1735 | [59–440] | 1791 | [1–549] |
| 1545 | [1–218] | 1601 | [1–465] | 1736 | [1–505] | 1792 | [1–558] |
| 1546 | [1–213] | 1603 | [1–88] | 1737 | [1–712] | 1793 | [1–498] |
| 1547 | [1–465] | 1604 | [1–206],[289–678] | 1738 | [1–649] | 1794 | [125–192] |
| 1548 | [1–496] | 1605 | [164–200] | 1741 | [1–478] | 1795 | [115–513] |
| | | | | 1742 | [1–454] | 1796 | [1–41] |
| | | | | 1743 | [1–630] | 1797 | [1–497] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 1744 | [1–512] | 1798 | [1–513] | 1882 | [1–61],[92–501] | 1942 | [1–302] |
| 1745 | [1–767] | 1799 | [1–139] | 1883 | [1–515] | 1943 | [1–310] |
| 1746 | [1–363] | 1800 | [1–489] | 1884 | [1–46],[385–491] | 1944 | [1–281] |
| 1748 | [1–404] | 1801 | [1–428] | 1885 | [287–392] | 1945 | [1–168],[461–654] |
| 1749 | [1–394] | 1802 | [1–509] | 1886 | [1–646] | 1946 | [1–521] |
| 1750 | [368–587] | 1804 | [1–463] | 1887 | [1–515] | 1947 | [1–1013] |
| 1751 | [1–137],[262–380],[491–582] | 1805 | [1–477] | 1888 | [1–455] | 1948 | [1–510] |
| 1752 | [1–475] | 1807 | [1–485] | 1890 | [1–465] | 1949 | [1–472] |
| 1753 | [334–513] | 1808 | [1–230],[447–526] | 1892 | [136–443] | 1950 | [1–533] |
| 1754 | [1–475] | 1809 | [1–483] | 1893 | [1–66] | 1951 | [1–427] |
| 1755 | [1–487] | 1810 | [1–519] | 1894 | [1–613],[663–741] | 1952 | [1–204] |
| 1756 | [1–450] | 1811 | [1–544] | 1953 | [1–515] | 2009 | [1–34] |
| 1757 | [1–700] | 1813 | [172–412] | 1954 | [1–509] | 2011 | [1–514] |
| 1758 | [1–517] | 1814 | [1–712] | 1955 | [1–204] | 2012 | [1–461] |
| 1761 | [1–475] | 1816 | [1–475] | 1956 | [1–482] | 2018 | [1–502] |
| 1762 | [1–458] | 1817 | [1–94],[372–534] | 1957 | [44–486] | 2019 | [1–603] |
| 1763 | [1–420] | 1818 | [1–93],[171–196] | 1958 | [1–204] | 2020 | [1–473] |
| 1764 | [1–493] | 1820 | [1–580] | 1959 | [1–450] | 2021 | [161–246],[327–515] |
| 1765 | [1–544] | 1821 | [1–493] | 1960 | [1–239] | 2022 | [1–436] |
| 1766 | [1–468] | 1822 | [1–31],[533–579] | 1962 | [59–282],[407–508] | 2024 | [1–201],[458–594] |
| 1767 | [1–495] | 1823 | [1–170],[458–494] | 1963 | [1–482] | 2025 | [1–465] |
| 1768 | [1–492] | 1824 | [1–482] | 1964 | [1–534] | 2026 | [144–466] |
| 1769 | [1–216] | 1825 | [1–292] | 1965 | [1–491] | 2027 | [1–525] |
| 1770 | [1–460] | 1826 | [1–551] | 1966 | [1–497] | 2029 | [1–470] |
| 1771 | [1–664] | 1827 | [428–547] | 1967 | [101–325],[450–549] | 2031 | [1–291] |
| 1772 | [1–293],[324–581] | 1828 | [1–50],[373–433],[493–642] | 1968 | [1–145],[561–609] | 2032 | [1–450] |
| 1773 | [51–133] | 1829 | [1–352] | 1969 | [1–708] | 2033 | [1–558] |
| 1774 | [195–451] | 1830 | [1–462] | 1970 | [1–458] | 2034 | [1–506] |
| 1775 | [437–498] | 1831 | [1–476] | 1971 | [1–426] | 2035 | [1–492] |
| 1776 | [446–513] | 1832 | [1–465] | 1972 | [543–570] | 2036 | [1–27],[61–587] |
| 1778 | [1–460] | 1834 | [1–454] | 1974 | [1–116] | 2037 | [1–507] |
| 1780 | [372–424] | 1835 | [1–615] | 1977 | [1–478] | 2039 | [1–480] |
| 1781 | [1–525] | 1836 | [209–271] | 1978 | [1–491] | 2040 | [1–501] |
| 1782 | [444–512] | 1837 | [1–214],[374–486] | 1980 | [1–370] | 2041 | [1–395] |
| 1838 | [1–432] | 1895 | [1–542] | 1982 | [1–471] | 2042 | [1–365] |
| 1839 | [1–564] | 1896 | [1–482] | 1983 | [1–142] | 2044 | [1–481] |
| 1840 | [1–218],[420–473] | 1897 | [1–467] | 1984 | [1–834] | 2045 | [1–471] |
| 1843 | [1–29],[119–173] | 1898 | [1–480] | 1985 | [32–507] | 2046 | [1–462] |
| 1844 | [1–466] | 1899 | [1–484] | 1986 | [1–461] | 2047 | [1–457],[496–594] |
| 1847 | [1–462] | 1903 | [1–481] | 1988 | [1–350] | 2048 | [1–526] |
| 1848 | [1–462] | 1904 | [1–501] | 1989 | [1–458] | 2049 | [1–421] |
| 1849 | [1–459] | 1905 | [1–540] | 1990 | [1–487] | 2050 | [1–483] |
| 1850 | [1–526] | 1906 | [120–144],[452–486] | 1991 | [1–314],[374–538] | 2051 | [1–102],[337–539] |
| 1851 | [1–480] | 1907 | [1–474] | 1992 | [1–453] | 2052 | [1–399] |
| 1853 | [1–500] | 1908 | [1–485] | 1993 | [1–486] | 2053 | [414–532],[731–820] |
| 1854 | [1–181],[404–671] | 1909 | [1–499] | 1994 | [1–482] | 2054 | [1–402] |
| 1855 | [1–402] | 1910 | [1–460] | 1995 | [1–621] | 2055 | [1–662] |
| 1856 | [1–510] | 1911 | [1–462] | 1996 | [1–511] | 2057 | [1–262] |
| 1857 | [1–465] | 1912 | [1–503] | 1997 | [1–477] | 2058 | [144–226] |
| 1858 | [1–755] | 1914 | [1–456] | 1998 | [1–543] | 2059 | [1–483] |
| 1859 | [1–465] | 1915 | [1–506] | 2000 | [1–497] | 2060 | [1–483] |
| 1860 | [463–487] | 1916 | [1–127],[372–399],[440–469] | 2002 | [1–453] | 2061 | [1–43],[220–466] |
| | | | | 2003 | [162–567] | 2062 | [1–422] |
| 1861 | [1–270] | 1918 | [97–453] | 2004 | [172–490] | 2063 | [1–490] |
| 1862 | [1–613] | 1919 | [1–328] | 2005 | [473–626] | 2064 | [1–341] |
| 1863 | [175–216],[546–596] | 1920 | [1–663] | 2006 | [372–470] | 2065 | [1–448] |
| 1864 | [1–468] | 1921 | [1–181],[233–488] | 2007 | [1–432] | 2066 | [1–222] |
| 1865 | [1–492] | 1923 | [1–42],[123–148],[255–285] | 2008 | [1–495] | 2067 | [1–461] |
| | | | | 2068 | [1–49],[299–617] | 2124 | [1–448] |
| | | | | 2069 | [1–503] | 2125 | [1–437] |
| | | | | 2070 | [1–499] | 2126 | [1–455] |
| 1866 | [1–503] | 1924 | [1–79],[271–473] | 2071 | [1–343] | 2127 | [1–428] |
| 1867 | [1–405],[761–807] | 1926 | [1–464] | 2072 | [1–132],[341–461] | 2128 | [1–359] |
| 1869 | [1–476] | 1927 | [1–196] | 2073 | [1–92] | 2129 | [1–546] |
| 1870 | [1–440] | 1928 | [47–496] | 2074 | [1–460] | 2130 | [1–45],[96–354] |
| 1871 | [1–448] | 1929 | [1–471] | 2076 | [1–384] | 2131 | [1–513] |
| 1872 | [1–505] | 1930 | [1–202] | 2077 | [1–456] | 2132 | [1–388] |
| 1873 | [1–51],[218–935] | 1932 | [1–130],[272–469] | 2078 | [1–453] | 2133 | [1–432] |
| 1874 | [1–514] | 1934 | [1–530] | 2079 | [1–527] | 2134 | [1–277] |
| 1876 | [1–436] | 1936 | [1–650] | 2080 | [1–469] | 2135 | [1–503] |
| 1877 | [1–667] | 1937 | [1–302] | 2081 | [1–506] | 2137 | [1–508] |
| 1878 | [1–787] | 1938 | [1–471] | 2082 | [1–685] | 2138 | [1–158],[417–476] |
| 1879 | [1–493] | 1939 | [1–294] | 2083 | [1–504] | 2139 | [1–479] |
| 1880 | [1–466] | 1940 | [1–294] | 2084 | [1–463] | 2140 | [1–428] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 2085 | [1–54],[244–340] | 2141 | [1–463] | 2224 | [1–29],[185–383] | 2276 | [1–467] |
| 2087 | [1–496] | 2142 | [1–497] | 2225 | [1–422] | 2277 | [1–141],[188–451] |
| 2089 | [1–40],[70–483] | 2143 | [236–459] | 2226 | [1–93] | 2278 | [1–462] |
| 2090 | [1–480] | 2144 | [1–533] | 2227 | [437–464] | 2279 | [1–372] |
| 2091 | [1–488] | 2147 | [1–408] | 2280 | [1–457] | 2338 | [1–450] |
| 2092 | [1–483] | 2148 | [1–564] | 2281 | [1–484] | 2339 | [45–378] |
| 2093 | [1–311] | 2149 | [1–295] | 2282 | [1–172],[414–537] | 2340 | [1–445] |
| 2094 | [1–159],[284–408] | 2150 | [1–336] | 2283 | [1–199] | 2341 | [1–339] |
| 2095 | [1–446] | 2151 | [1–449] | 2284 | [1–559] | 2342 | [1–295] |
| 2096 | [1–495] | 2152 | [1–572] | 2285 | [1–464] | 2344 | [1–516] |
| 2098 | [1–460] | 2153 | [1–223] | 2286 | [1–460] | 2345 | [432–498] |
| 2099 | [1–223],[437–477] | 2154 | [1–523] | 2287 | [1–511] | 2346 | [1–466] |
| 2100 | [1–160],[285–408] | 2155 | [1–499] | 2289 | [34–75],[226–478] | 2347 | [1–480] |
| 2101 | [1–459] | 2156 | [1–600] | 2290 | [1–505] | 2348 | [1–32] |
| 2102 | [1–374] | 2157 | [451–510] | 2292 | [1–478] | 2349 | [1–317] |
| 2103 | [1–384] | 2158 | [1–486] | 2294 | [1–461] | 2350 | [1–278],[418–503] |
| 2104 | [1–554] | 2159 | [1–488] | 2295 | [1–267] | 2351 | [1–616] |
| 2105 | [32–476] | 2160 | [1–503] | 2296 | [1–346] | 2354 | [1–494] |
| 2106 | [1–71] | 2161 | [1–470] | 2297 | [1–476] | 2355 | [1–479] |
| 2107 | [1–461] | 2163 | [1–458] | 2298 | [1–43] | 2357 | [1–456] |
| 2108 | [1–544] | 2164 | [1–495] | 2300 | [1–433] | 2358 | [1–473] |
| 2109 | [1–515] | 2165 | [1–107] | 2301 | [1–369] | 2359 | [1–473] |
| 2110 | [1–352] | 2166 | [1–390],[419–520] | 2303 | [1–507] | 2360 | [1–540] |
| 2112 | [1–443] | 2167 | [274–512] | 2305 | [1–374] | 2361 | [1–470] |
| 2113 | [1–342] | 2168 | [1–398] | 2306 | [1–457] | 2362 | [1–485] |
| 2115 | [1–470] | 2169 | [1–493] | 2308 | [1–499] | 2363 | [1–495] |
| 2117 | [1–478] | 2170 | [1–532] | 2309 | [1–507] | 2364 | [1–358] |
| 2118 | [1–485] | 2171 | [1–419] | 2310 | [1–472] | 2365 | [377–482] |
| 2120 | [1–375] | 2172 | [1–506] | 2311 | [1–478] | 2366 | [1–143] |
| 2122 | [1–288] | 2173 | [1–491] | 2312 | [1–468] | 2367 | [1–32],[152–403] |
| 2123 | [1–533] | 2174 | [1–564] | 2313 | [45–329] | 2371 | [1–388] |
| 2175 | [1–474] | 2228 | [1–489] | 2315 | [1–46],[207–372] | 2372 | [1–556] |
| 2176 | [1–469] | 2229 | [1–55] | 2316 | [1–366] | 2373 | [1–175],[252–523] |
| 2177 | [1–56],[338–452] | 2230 | [1–440] | 2317 | [1–476] | 2374 | [1–446] |
| 2178 | [1–456] | 2233 | [1–475] | 2318 | [1–238] | 2375 | [1–175],[252–585] |
| 2179 | [164–482] | 2234 | [1–459] | 2319 | [1–499] | 2376 | [1–520] |
| 2181 | [1–467] | 2235 | [1–481] | 2320 | [1–473] | 2377 | [1–487] |
| 2182 | [1–474] | 2236 | [1–452] | 2323 | [1–489] | 2378 | [427–459] |
| 2183 | [1–469] | 2237 | [1–415] | 2324 | [1–182] | 2379 | [1–65],[471–535] |
| 2184 | [1–379] | 2238 | [1–456] | 2325 | [1–460] | 2380 | [1–65],[441–485] |
| 2185 | [1–413] | 2239 | [1–508] | 2327 | [1–493] | 2383 | [1–489] |
| 2186 | [1–483] | 2240 | [44–471] | 2328 | [1–496] | 2384 | [1–660] |
| 2187 | [173–451] | 2241 | [1–213],[409–467] | 2329 | [1–493] | 2385 | [1–491] |
| 2188 | [1–476] | 2242 | [1–220],[405–473] | 2330 | [1–413] | 2386 | [1–459] |
| 2189 | [1–43] | 2243 | [1–333] | 2331 | [1–492] | 2387 | [1–517] |
| 2190 | [1–379],[419–453] | 2244 | [1–511] | 2332 | [1–452] | 2388 | [1–516] |
| 2192 | [1–482] | 2245 | [1–472] | 2333 | [1–456] | 2389 | [1–499] |
| 2193 | [34–462] | 2246 | [1–463] | 2334 | [1–443] | 2390 | [220–277],[318–386],[423–523] |
| 2194 | [1–487] | 2247 | [1–342] | | | | |
| 2195 | [1–568] | 2248 | [1–467] | 2335 | [1–413] | 2391 | [1–45],[294–458] |
| 2196 | [1–306] | 2249 | [1–419] | 2336 | [1–479] | 2392 | [1–856] |
| 2197 | [1–462] | 2250 | [1–474] | 2337 | [1–311] | 2394 | [1–468] |
| 2198 | [1–439] | 2251 | [1–42] | 2396 | [1–58],[103–497] | 2451 | [1–349] |
| 2199 | [1–489] | 2252 | [1–529] | 2397 | [1–584] | 2452 | [1–467] |
| 2200 | [195–289] | 2253 | [1–381] | 2398 | [1–270],[311–479] | 2453 | [1–571] |
| 2201 | [1–485] | 2254 | [1–468] | 2399 | [1–559] | 2454 | [1–551] |
| 2203 | [1–474] | 2255 | [1–535] | 2400 | [1–459] | 2455 | [1–461] |
| 2204 | [1–361] | 2256 | [1–41],[470–553] | 2402 | [1–306] | 2456 | [1–481] |
| 2205 | [1–513] | 2257 | [1–469] | 2403 | [1–468] | 2457 | [1–468] |
| 2206 | [1–481] | 2258 | [1–41],[470–508] | 2404 | [1–341] | 2458 | [1–492] |
| 2209 | [1–892] | 2260 | [1–472] | 2405 | [1–467] | 2459 | [1–492] |
| 2210 | [1–54],[180–247] | 2261 | [1–460] | 2407 | [188–332] | 2460 | [1–511] |
| 2211 | [1–455] | 2262 | [1–599] | 2408 | [1–144] | 2461 | [1–675] |
| 2212 | [1–226],[442–474] | 2263 | [337–489] | 2409 | [1–516] | 2463 | [1–482] |
| 2213 | [1–499] | 2264 | [1–460] | 2410 | [1–468] | 2464 | [1–499] |
| 2214 | [1–457] | 2266 | [1–386] | 2412 | [1–506] | 2467 | [1–511] |
| 2215 | [1–479] | 2267 | [1–472] | 2414 | [469–548] | 2469 | [1–452] |
| 2216 | [1–481] | 2268 | [1–484] | 2415 | [1–268] | 2470 | [1–556] |
| 2217 | [1–239] | 2269 | [1–502] | 2416 | [1–490] | 2471 | [1–188] |
| 2218 | [1–131] | 2270 | [1–503] | 2417 | [1–930] | 2472 | [1–295] |
| 2219 | [1–471] | 2271 | [1–563] | 2418 | [1–489] | 2473 | [1–465] |
| 2220 | [1–473] | 2272 | [1–486] | 2420 | [156–531] | 2474 | [1–451] |
| 2221 | [1–55] | 2273 | [1–459] | 2421 | [1–476] | 2475 | [1–527] |
| 2223 | [302–459] | 2274 | [1–330] | 2422 | [254–312] | 2476 | [91–189] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 2423 | [1–501] | 2477 | [1–364] | 2614 | [1–189],[424–803] | 2669 | [1–485] |
| 2425 | [1–488] | 2478 | [1–467] | 2615 | [1–491] | 2670 | [1–455] |
| 2426 | [1–506] | 2479 | [1–360] | 2616 | [1–478] | 2674 | [1–330] |
| 2427 | [1–348] | 2480 | [1–502] | 2617 | [1–273] | 2675 | [1–748] |
| 2428 | [1–327] | 2481 | [1–537] | 2619 | [1–56] | 2676 | [1–502] |
| 2429 | [1–326] | 2482 | [1–479] | 2620 | [1–488] | 2677 | [1–497] |
| 2430 | [269–510] | 2483 | [91–189] | 2621 | [1–547] | 2678 | [1–468] |
| 2431 | [1–542] | 2484 | [1–514] | 2622 | [1–131],[401–429] | 2680 | [1–305] |
| 2432 | [204–255] | 2485 | [1–391] | 2623 | [1–437] | 2681 | [1–305] |
| 2433 | [1–223],[423–537] | 2486 | [1–210] | 2624 | [1–452] | 2682 | [1–217] |
| 2434 | [1–458] | 2487 | [1–198],[317–554] | 2625 | [1–445] | 2683 | [1–69] |
| 2435 | [1–557] | 2488 | [1–465] | 2626 | [1–442] | 2684 | [1–470] |
| 2436 | [67–166] | 2489 | [1–410] | 2627 | [1–446] | 2685 | [1–51] |
| 2437 | [1–363] | 2490 | [1–493] | 2628 | [1–448] | 2687 | [1–451] |
| 2438 | [1–433] | 2491 | [1–461] | 2629 | [1–441] | 2688 | [1–488] |
| 2439 | [1–480] | 2492 | [93–533] | 2630 | [1–475] | 2689 | [166–505] |
| 2441 | [1–319],[352–398] | 2493 | [168–714] | 2631 | [1–443] | 2690 | [1–491] |
| 2442 | [1–444] | 2494 | [1–561] | 2632 | [1–469] | 2691 | [1–507] |
| 2444 | [1–451] | 2495 | [1–451] | 2633 | [1–452] | 2692 | [1–526] |
| 2445 | [1–504] | 2497 | [1–612] | 2634 | [1–439] | 2693 | [1–523] |
| 2446 | [1–430] | 2498 | [1–491] | 2635 | [1–488] | 2694 | [1–50],[412–572] |
| 2447 | [1–86],[288–485] | 2499 | [1–780] | 2636 | [1–447] | 2695 | [1–544] |
| 2448 | [1–546] | 2500 | [1–242],[276–300] | 2638 | [265–388] | 2696 | [1–494] |
| 2449 | [349–517] | 2501 | [1–466] | 2639 | [1–444] | 2697 | [59–100] |
| 2450 | [1–463] | 2502 | [1–405] | 2641 | [251–394] | 2698 | [328–406] |
| 2503 | [1–476] | 2559 | [1–346] | 2642 | [1–444] | 2700 | [1–84],[395–452] |
| 2505 | [1–180],[509–543] | 2560 | [1–505] | 2643 | [1–439] | 2701 | [1–466] |
| 2506 | [1–507] | 2561 | [1–473] | 2644 | [1–493] | 2703 | [1–470] |
| 2507 | [124–311] | 2562 | [1–406] | 2645 | [1–444] | 2704 | [1–464] |
| 2508 | [1–488] | 2564 | [1–513] | 2646 | [1–448] | 2705 | [1–590] |
| 2509 | [1–482] | 2567 | [1–361] | 2647 | [1–522] | 2707 | [64–96],[298–483] |
| 2510 | [1–489] | 2568 | [1–70] | 2648 | [1–481] | 2708 | [1–517] |
| 2511 | [1–508] | 2570 | [1–624] | 2649 | [1–600] | 2709 | [1–474] |
| 2512 | [1–305],[416–471] | 2571 | [1–483] | 2650 | [1–492] | 2710 | [1–473] |
| 2513 | [331–478] | 2572 | [1–64] | 2651 | [1–357] | 2711 | [174–513] |
| 2514 | [1–498] | 2574 | [1–192],[361–589],[692–834] | 2652 | [1–59] | 2712 | [1–513] |
| 2515 | [276–321] | 2575 | [1–530] | 2653 | [1–34] | 2713 | [1–501] |
| 2516 | [1–553] | 2576 | [1–456] | 2655 | [1–512] | 2714 | [1–506] |
| 2517 | [1–468] | 2577 | [1–43],[98–215] | 2657 | [1–461] | 2715 | [1–471] |
| 2518 | [1–112],[321–484] | 2578 | [1–43],[98–215] | 2658 | [153–206],[334–414] | 2716 | [1–525] |
| 2519 | [1–459] | 2579 | [1–556] | 2659 | [1–336] | 2717 | [1–515] |
| 2522 | [1–49] | 2580 | [1–622] | 2662 | [1–402] | 2718 | [1–521] |
| 2523 | [1–538] | 2581 | [180–231] | 2663 | [1–489] | 2719 | [1–399] |
| 2524 | [1–600] | 2582 | [160–211] | 2664 | [1–490] | 2720 | [1–37],[251–481] |
| 2525 | [1–390] | 2583 | [180–231] | 2665 | [1–470] | 2721 | [1–497] |
| 2526 | [1–469] | 2584 | [479–647] | 2666 | [1–396] | 2723 | [1–156] |
| 2527 | [1–521] | 2585 | [290–476] | 2724 | [1–156] | 2776 | [1–504] |
| 2528 | [1–513] | 2586 | [1–482] | 2725 | [1–890] | 2778 | [1–490] |
| 2532 | [392–481] | 2587 | [1–560] | 2726 | [1–517] | 2779 | [1–471] |
| 2533 | [1–429],[461–487] | 2588 | [1–541] | 2727 | [1–583] | 2780 | [1–502] |
| 2534 | [1–465] | 2589 | [1–492] | 2728 | [1–79],[534–569] | 2781 | [1–630] |
| 2535 | [1–463] | 2591 | [1–541] | 2729 | [1–105] | 2784 | [457–555] |
| 2536 | [1–484] | 2592 | [1–575] | 2730 | [1–27] | 2785 | [1–527] |
| 2537 | [1–125],[292–533] | 2593 | [179–490] | 2732 | [1–477] | 2786 | [1–430] |
| 2538 | [1–516] | 2594 | [1–522] | 2733 | [1–606] | 2787 | [36–527] |
| 2539 | [317–362] | 2595 | [1–627] | 2734 | [303–554] | 2788 | [1–504] |
| 2540 | [1–985] | 2596 | [1–125],[207–506] | 2736 | [1–485] | 2789 | [1–485] |
| 2541 | [1–324],[418–508] | 2597 | [1–588] | 2737 | [1–552] | 2790 | [1–487] |
| 2542 | [1–484] | 2598 | [1–504] | 2738 | [1–451] | 2791 | [1–483] |
| 2543 | [1–544] | 2599 | [1–97],[169–465] | 2739 | [1–492] | 2792 | [1–903] |
| 2544 | [1–25] | 2600 | [1–627] | 2740 | [1–281],[391–549] | 2793 | [1–472] |
| 2545 | [1–233] | 2601 | [1–542] | 2741 | [1–493] | 2794 | [1–501] |
| 2547 | [1–50],[384–578] | 2602 | [1–451] | 2742 | [1–35] | 2795 | [1–455] |
| 2549 | [1–144] | 2603 | [1–453] | 2744 | [1–484] | 2796 | [1–460] |
| 2550 | [1–478] | 2605 | [1–538] | 2745 | [1–534] | 2797 | [1–459] |
| 2551 | [1–424] | 2606 | [1–270] | 2746 | [1–491] | 2798 | [1–457] |
| 2552 | [44–78],[126–170] | 2607 | [1–235] | 2747 | [145–330] | 2799 | [1–462] |
| 2554 | [1–165] | 2608 | [1–127] | 2748 | [1–472] | 2800 | [1–455] |
| 2555 | [1–28] | 2609 | [1–197] | 2749 | [1–407] | 2801 | [1–457] |
| 2556 | [1–502] | 2610 | [1–489] | 2750 | [1–41],[351–607] | 2802 | [1–457] |
| 2557 | [1–528] | 2611 | [1–468] | 2751 | [1–548] | 2803 | [1–456] |
| 2558 | [1–513] | 2612 | [1–173],[341–720] | 2752 | [1–496] | 2804 | [1–458] |
| 2613 | [1–251],[315–556] | 2668 | [1–42] | 2753 | [1–352] | 2805 | [1–472] |
| | | | | 2754 | [1–447] | 2806 | [1–388] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 2757 | [1–551] | 2807 | [1–474] | 2945 | [1–164] | 3000 | [1–482] |
| 2758 | [1–30] | 2808 | [1–464] | 2946 | [1–87],[303–402] | 3001 | [1–26] |
| 2759 | [135–563] | 2809 | [1–262] | 2948 | [406–498] | 3002 | [1–483] |
| 2760 | [1–670] | 2810 | [1–510] | 2950 | [1–540] | 3003 | [1–518] |
| 2761 | [159–183] | 2811 | [165–499] | 2951 | [1–506] | 3004 | [1–393] |
| 2762 | [1–48] | 2812 | [378–515] | 2952 | [1–525] | 3006 | [1–42] |
| 2763 | [1–48] | 2813 | [1–832] | 2953 | [1–272] | 3007 | [1–548] |
| 2764 | [1–481] | 2814 | [1–41],[98–552] | 2955 | [1–395] | 3008 | [1–513] |
| 2765 | [1–27],[368–509] | 2815 | [1–33] | 2956 | [1–251] | 3009 | [1–491] |
| 2766 | [1–436] | 2817 | [1–494] | 2957 | [1–257] | 3010 | [416–507] |
| 2767 | [1–86],[232–424] | 2818 | [1–253] | 2958 | [1–462] | 3011 | [1–674] |
| 2768 | [1–423] | 2819 | [1–428],[461–529] | 2959 | [1–590] | 3012 | [1–505] |
| 2769 | [1–416] | 2820 | [1–1035] | 2960 | [1–271] | 3013 | [1–557] |
| 2770 | [1–333] | 2821 | [1–492] | 2961 | [1–371] | 3014 | [1–467] |
| 2771 | [1–320] | 2822 | [1–509] | 2962 | [1–499] | 3015 | [1–338] |
| 2772 | [1–101],[158–203] | 2823 | [1–515] | 2963 | [1–539] | 3016 | [1–513] |
| 2773 | [1–517] | 2824 | [1–524] | 2964 | [1–499] | 3017 | [1–469] |
| 2774 | [1–572] | 2825 | [227–524] | 2966 | [1–452] | 3018 | [1–531] |
| 2775 | [1–647] | 2827 | [1–476] | 2968 | [1–97],[531–575] | 3019 | [1–390],[461–610] |
| 2828 | [1–516] | 2883 | [1–456] | 2969 | [1–520] | 3021 | [1–530] |
| 2829 | [1–69],[102–152] | 2884 | [1–560] | 2970 | [1–125] | 3022 | [1–128],[194–220], [261–436] |
| 2830 | [1–535] | 2885 | [1–478] | | | | |
| 2831 | [1–421] | 2886 | [1–31] | 2971 | [1–491] | 3023 | [1–494] |
| 2832 | [1–625] | 2887 | [1–503] | 2972 | [1–477] | 3024 | [1–488] |
| 2833 | [1–306],[347–461] | 2889 | [1–467] | 2975 | [1–611] | 3026 | [1–355] |
| 2834 | [1–63],[401–444] | 2890 | [289–331] | 2976 | [1–470] | 3027 | [1–807] |
| 2835 | [254–400] | 2891 | [444–489] | 2977 | [1–398] | 3028 | [1–254] |
| 2838 | [1–517] | 2892 | [65–132] | 2978 | [1–517] | 3029 | [1–533] |
| 2839 | [1–469] | 2893 | [1–459] | 2979 | [76–491] | 3030 | [1–505] |
| 2840 | [1–414] | 2894 | [1–547] | 2980 | [1–484] | 3031 | [1–520] |
| 2841 | [1–284] | 2895 | [272–459] | 2982 | [415–555] | 3032 | [1–585] |
| 2842 | [1–453] | 2896 | [349–395] | 2983 | [1–507] | 3033 | [76–420] |
| 2843 | [50–473] | 2897 | [1–463] | 2984 | [1–97] | 3034 | [1–407] |
| 2849 | [1–521] | 2898 | [1–527] | 2985 | [33–783] | 3035 | [1–156] |
| 2850 | [1–453] | 2899 | [1–511] | 2986 | [128–171] | 3036 | [1–136],[340–375] |
| 2851 | [1–470] | 2900 | [1–64],[451–486] | 2987 | [1–342] | 3037 | [1–462] |
| 2852 | [1–512] | 2901 | [1–284] | 2988 | [1–272] | 3038 | [269–356],[433–510] |
| 2853 | [1–81],[140–483] | 2902 | [1–479],[641–721] | 2989 | [1–478] | 3039 | [1–94],[361–483] |
| 2854 | [1–79],[370–522] | 2903 | [1–269] | 2990 | [1–482] | 3040 | [1–93] |
| 2855 | [1–527] | 2904 | [1–506] | 2991 | [1–417] | 3041 | [1–524] |
| 2856 | [134–528] | 2905 | [1–474] | 2992 | [1–431] | 3042 | [1–186] |
| 2857 | [1–444] | 2906 | [1–387] | 3043 | [1–486] | 3106 | [1–557] |
| 2858 | [1–496] | 2907 | [468–523] | 3044 | [1–491] | 3110 | [1–428] |
| 2859 | [1–488] | 2908 | [1–539] | 3045 | [1–328] | 3111 | [1–491] |
| 2860 | [1–510] | 2910 | [1–471] | 3046 | [1–477] | 3112 | [1–480] |
| 2861 | [1–486] | 2911 | [1–531] | 3047 | [1–240],[661–691] | 3113 | [1–236] |
| 2862 | [1–490] | 2912 | [1–475] | 3048 | [1–465] | 3114 | [1–525] |
| 2863 | [42–113] | 2913 | [1–483] | 3050 | [1–515] | 3115 | [1–30],[113–150] |
| 2864 | [1–29] | 2914 | [320–395] | 3051 | [1–642] | 3116 | [1–445] |
| 2866 | [1–494] | 2915 | [1–495] | 3052 | [712–751] | 3117 | [1–498] |
| 2867 | [1–539] | 2916 | [1–453] | 3055 | [136–561] | 3118 | [1–509] |
| 2868 | [1–713] | 2918 | [1–236] | 3057 | [1–468] | 3119 | [1–284] |
| 2869 | [1–476] | 2919 | [1–411],[476–519] | 3058 | [1–558] | 3120 | [1–494] |
| 2870 | [267–531] | 2920 | [1–454] | 3059 | [1–481] | 3121 | [604–632] |
| 2871 | [267–468] | 2921 | [1–243],[465–492] | 3060 | [1–494] | 3123 | [1–483] |
| 2872 | [278–496] | 2922 | [1–455] | 3061 | [1–523] | 3124 | [1–479] |
| 2873 | [1–524] | 2923 | [1–504] | 3062 | [1–537] | 3125 | [1–492] |
| 2874 | [1–486] | 2924 | [1–615] | 3063 | [1–470] | 3126 | [1–707] |
| 2875 | [1–494] | 2925 | [82–117],[169–237], [283–348] | 3064 | [1–112] | 3129 | [1–464] |
| | | | | 3065 | [1–494] | 3130 | [1–497] |
| 2876 | [1–486] | 2926 | [1–483] | 3066 | [1–456] | 3131 | [1–316] |
| 2877 | [1–706] | 2927 | [1–577] | 3067 | [1–561] | 3132 | [1–464] |
| 2878 | [1–531] | 2928 | [1–489] | 3068 | [184–233] | 3133 | [1–58],[463–487] |
| 2879 | [1–385] | 2929 | [1–474] | 3069 | [1–513] | 3134 | [1–52],[521–556] |
| 2880 | [1–482] | 2930 | [1–466] | 3070 | [1–484] | 3136 | [1–52] |
| 2881 | [1–575] | 2932 | [1–581] | 3071 | [1–473] | 3137 | [1–341] |
| 2882 | [1–543] | 2933 | [1–43] | 3073 | [466–506] | 3138 | [1–489] |
| 2934 | [1–146] | 2993 | [1–476] | 3074 | [1–484] | 3139 | [1–370] |
| 2936 | [1–206] | 2994 | [1–499] | 3075 | [125–459] | 3140 | [1–457] |
| 2937 | [1–515] | 2995 | [1–509] | 3076 | [1–500] | 3141 | [1–549] |
| 2941 | [1–61],[309–342] | 2996 | [49–466] | 3078 | [1–419] | 3142 | [1–438] |
| 2942 | [1–179],[215–518] | 2997 | [1–35],[94–284] | 3079 | [1–456] | 3143 | [1–513] |
| 2943 | [1–509] | 2998 | [1–546] | 3080 | [1–500] | 3144 | [1–167],[505–548] |
| 2944 | [1–465] | 2999 | [1–345] | 3081 | [1–566] | 3145 | [141–183],[286–410] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3082 | [1–529] | 3146 | [1–476] | 3283 | [1–555] | 3342 | [1–464] |
| 3083 | [1–463] | 3147 | [1–500] | 3284 | [1–471] | 3343 | [1–165],[199–232], [262–404],[480–548] |
| 3084 | [1–32],[71–528] | 3148 | [1–462] | 3286 | [1–526] | 3344 | [1–45] |
| 3086 | [127–513] | 3149 | [1–46] | 3288 | [1–482] | 3345 | [1–184],[2261–550] |
| 3093 | [224–490] | 3150 | [1–864] | 3289 | [40–83] | 3346 | [93–123] |
| 3094 | [1–505] | 3151 | [1–655] | 3290 | [1–115],[355–489] | 3347 | [93–123] |
| 3095 | [1–552] | 3152 | [1–484] | 3291 | [1–270] | 3349 | [1–527] |
| 3096 | [136–185],[417–508] | 3153 | [1–459] | 3292 | [1–115],[355–435] | 3351 | [1–506] |
| 3100 | [306–340] | 3154 | [1–526] | 3293 | [1–460] | 3353 | [1–461] |
| 3101 | [152–187],[332–404] | 3155 | [1–505] | 3294 | [1–450] | 3354 | [1–263] |
| 3102 | [1–450] | 3157 | [172–238],[368–409] | 3296 | [1–461] | 3355 | [1–263] |
| 3103 | [1–490] | 3158 | [1–156],[251–482] | 3298 | [1–32],[293–360] | 3356 | [1–408] |
| 3104 | [1–501] | 3159 | [172–238],[368–471] | 3299 | [1–459] | 3357 | [1–532] |
| 3105 | [1–482] | 3160 | [1–109],[175–236] | 3300 | [1–450] | 3358 | [1–145],[387–475] |
| 3161 | [172–238],[368–451] | 3216 | [1–458] | 3301 | [1–542] | 3359 | [1–413] |
| 3162 | [1–494] | 3217 | [1–526] | 3302 | [1–418] | 3360 | [1–249],[302–593] |
| 3163 | [1–478] | 3218 | [1–517] | 3303 | [1–462] | 3361 | [1–509] |
| 3164 | [1–94],[275–508] | 3219 | [1–509] | 3306 | [1–478] | 3362 | [1–82],[296–699] |
| 3165 | [1–498] | 3220 | [1–461] | 3307 | [1–94],[134–471] | 3363 | [1–82],[296–579] |
| 3167 | [1–350] | 3221 | [1–381] | 3308 | [1–524] | 3364 | [1–82],[296–612] |
| 3168 | [68–471] | 3222 | [1–347] | 3309 | [1–43] | 3365 | [224–385] |
| 3169 | [1–490] | 3223 | [1–130],[482–517] | 3310 | [1–358] | 3366 | [1–51],[265–516] |
| 3170 | [1–563] | 3224 | [1–473] | 3311 | [207–444] | 3367 | [231–447] |
| 3171 | [1–31] | 3225 | [1–497] | 3312 | [1–932] | 3370 | [1–393] |
| 3173 | [1–92],[220–455] | 3226 | [1–601] | 3313 | [1–549] | 3371 | [1–508] |
| 3174 | [1–465] | 3227 | [1–516] | 3315 | [1–497] | 3372 | [1–384] |
| 3175 | [1–484] | 3228 | [1–513] | 3316 | [1–511] | 3373 | [1–366] |
| 3177 | [1–482] | 3229 | [1–525] | 3317 | [189–414] | 3375 | [1–482] |
| 3179 | [1–485] | 3230 | [500–548] | 3319 | [1–217],[334–476] | 3376 | [1–560] |
| 3180 | [1–240],[271–401] | 3232 | [1–210],[251–523] | 3321 | [1–212],[329–471] | 3377 | [1–364] |
| 3181 | [401–442],[488–517] | 3233 | [1–399] | 3322 | [1–125] | 3378 | [1–173] |
| 3182 | [1–144],[436–577] | 3234 | [284–532] | 3323 | [1–25] | 3380 | [1–490] |
| 3183 | [1–84],[149–207], [320–381] | 3237 | [350–499] | 3324 | [1–294] | 3381 | [1–487] |
| 3184 | [1–394] | 3238 | [342–587] | 3325 | [1–485] | 3382 | [1–738] |
| 3185 | [1–556] | 3239 | [1–748] | 3326 | [1–451] | 3383 | [43–486] |
| 3186 | [1–539] | 3240 | [1–468] | 3327 | [1–515] | 3384 | [520–560] |
| 3188 | [325–444] | 3241 | [1–690] | 3385 | [1–421] | 3436 | [1–475] |
| 3190 | [1–530] | 3243 | [1–104],[148–466] | 3386 | [1–456] | 3437 | [1–462] |
| 3191 | [1–452] | 3244 | [1–504] | 3387 | [1–480] | 3438 | [1–556] |
| 3192 | [1–527] | 3245 | [1–597] | 3388 | [1–579] | 3439 | [1–449] |
| 3193 | [1–757] | 3246 | [1–460] | 3389 | [1–162],[201–337], [534–566] | 3441 | [1–453] |
| 3194 | [240–503] | 3247 | [1–565] | 3390 | [1–452] | 3442 | [1–450] |
| 3195 | [1–486] | 3248 | [1–50],[372–432] | 3391 | [436–526] | 3443 | [285–515] |
| 3197 | [1–494] | 3249 | [1–314] | 3392 | [1–478] | 3444 | [1–439] |
| 3198 | [1–336] | 3250 | [268–409] | 3393 | [1–341] | 3445 | [1–168] |
| 3199 | [1–328] | 3251 | [273–456] | 3394 | [1–465] | 3446 | [1–298] |
| 3200 | [1–60],[155–484] | 3252 | [269–344] | 3395 | [1–469] | 3447 | [1–495] |
| 3201 | [1–463] | 3253 | [268–474] | 3396 | [2271–316] | 3448 | [1–518] |
| 3202 | [1–473] | 3257 | [1–151] | 3397 | [1–477] | 3449 | [1–508] |
| 3203 | [1–85] | 3258 | [1–533] | 3398 | [1–451] | 3450 | [1–503] |
| 3204 | [1–50],[90–443] | 3259 | [1–112] | 3399 | [1–468] | 3451 | [1–452] |
| 3205 | [1–533] | 3260 | [1–429] | 3400 | [1–431] | 3452 | [1–413] |
| 3206 | [1–191],[306–464] | 3261 | [1–462] | 3401 | [1–461] | 3453 | [1–325] |
| 3207 | [1–166],[281–521] | 3262 | [1–134],[180–235], [298–330] | 3402 | [1–109] | 3455 | [1–90] |
| 3209 | [1–505] | 3263 | [1–69],[139–321] | 3403 | [1–471] | 3456 | [1–450] |
| 3210 | [58–380] | 3264 | [401–469] | 3404 | [1–482] | 3457 | [1–571] |
| 3211 | [1–28] | 3265 | [1–239],[411–460] | 3406 | [1–726] | 3458 | [1–478] |
| 3212 | [1–157],[190–461] | 3266 | [1–511] | 3407 | [209–459] | 3459 | [1–565] |
| 3213 | [1–444] | 3267 | [287–425] | 3408 | [1–268] | 3460 | [1–375],[434–543] |
| 3214 | [1–457] | 3268 | [1–453] | 3409 | [1–31] | 3463 | [1–577] |
| 3215 | [1–474] | 3269 | [1–503] | 3410 | [1–451] | 3464 | [1–481] |
| 3270 | [1–415] | 3328 | [1–527] | 3412 | [1–484] | 3466 | [1–70],[168–586], [729–778] |
| 3272 | [1–353] | 3331 | [1–528] | 3413 | [1–390] | 3469 | [322–495] |
| 3273 | [1–401] | 3332 | [1–465] | 3414 | [1–473] | 3470 | [1–484] |
| 3274 | [1–447] | 3333 | [1–389] | 3415 | [1–278],[317–585] | 3471 | [1–512] |
| 3275 | [1–461] | 3334 | [1–65] | 3416 | [1–100],[133–519] | 3472 | [1–492] |
| 3276 | [1–628] | 3336 | [1–452] | 3417 | [1–547] | 3473 | [1–278] |
| 3277 | [1–29] | 3337 | [1–846] | 3418 | [482–509] | 3474 | [1–132],[250–512] |
| 3278 | [1–476] | 3338 | [1–386] | 3419 | [1–519] | 3475 | [1–497] |
| 3279 | [1–527] | 3339 | [1–474] | 3420 | [1–436] | 3476 | [1–270],[314–511] |
| 3281 | [1–513] | 3340 | [1–431] | 3421 | [1–472] | 3477 | [1–528] |
| 3282 | [1–486] | 3341 | [1–207] | | | | |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3422 | [1–594] | 3478 | [1–498] | 3611 | [1–453] | 3673 | [84–110],[359–400] |
| 3423 | [1–429] | 3479 | [1–399] | 3613 | [1–84] | 3674 | [276–331] |
| 3424 | [1–386] | 3480 | [1–531] | 3614 | [271–493] | 3675 | [84–110],[359–400] |
| 3425 | [1–442] | 3481 | [1–539] | 3615 | [1–194],[312–491] | 3676 | [40–586] |
| 3426 | [1–431] | 3482 | [1–661] | 3616 | [1–311],[410–549] | 3677 | [433–465] |
| 3427 | [1–484] | 3483 | [1–556] | 3617 | [1–489] | 3678 | [1–471] |
| 3429 | [243–363] | 3484 | [1–518] | 3618 | [1–254],[445–753] | 3679 | [1–524] |
| 3430 | [1–52],[341–592],[669–804] | 3485 | [1–546] | 3619 | [1–393] | 3680 | [1–941] |
| 3432 | [1–25] | 3486 | [1–478] | 3620 | [1–179],[370–482] | 3684 | [1–303],[482–508] |
| 3433 | [1–473] | 3487 | [1–561] | 3621 | [1–42] | 3686 | [1–392] |
| 3434 | [1–107],[149–489] | 3488 | [1–478] | 3622 | [1–479] | 3687 | [1–532] |
| 3435 | [1–588] | 3489 | [1–527] | 3623 | [1–505] | 3688 | [1–471] |
| 3490 | [99–192],[414–482] | 3544 | [1–406] | 3624 | [1–479] | 3689 | [1–525] |
| 3491 | [112–205],[517–561] | 3545 | [1–281] | 3625 | [1–422] | 3690 | [1–513] |
| 3492 | [111–204] | 3546 | [1–466] | 3626 | [1–407] | 3691 | [1–564] |
| 3493 | [1–477] | 3547 | [1–470] | 3627 | [1–32],[289–553] | 3693 | [1–206],[289–473] |
| 3494 | [1–494] | 3548 | [1–496] | 3628 | [1–522] | 3694 | [1–96],[205–461] |
| 3495 | [183–533] | 3549 | [1–475] | 3629 | [1–466],[727–821] | 3695 | [1–422] |
| 3496 | [1–186],[229–419] | 3550 | [1–401] | 3631 | [476–500] | 3696 | [1–38],[153–365] |
| 3498 | [188–684] | 3551 | [1–494] | 3633 | [1–464] | 3697 | [1–469] |
| 3499 | [1–465] | 3552 | [1–43],[345–490] | 3634 | [1–408] | 3698 | [1–485] |
| 3501 | [1–511] | 3553 | [490–523] | 3635 | [1–483] | 3699 | [1–245] |
| 3502 | [1–490] | 3554 | [1–234] | 3637 | [1–488] | 3700 | [1–349] |
| 3503 | [1–513] | 3555 | [312–664] | 3638 | [1–474] | 3701 | [1–572] |
| 3504 | [1–394] | 3556 | [312–581] | 3639 | [1–486] | 3702 | [1–543] |
| 3506 | [268–394],[425–478] | 3557 | [1–244] | 3643 | [135–295] | 3703 | [1–503] |
| 3507 | [1–497] | 3558 | [1–462] | 3644 | [1–485] | 3704 | [1–485] |
| 3508 | [1–470] | 3559 | [1–548] | 3645 | [1–168],[449–474] | 3705 | [42–100] |
| 3509 | [1–27],[493–557] | 3560 | [1–461] | 3646 | [59–234],[416–473] | 3706 | [1–499] |
| 3510 | [1–25],[186–402],[460–495] | 3561 | [1–540] | 3647 | [1–527] | 3707 | [1–400] |
|  |  |  |  | 3648 | [1–490] | 3708 | [1–633] |
|  |  |  |  | 3649 | [1–32],[140–536] | 3709 | [1–504] |
| 3511 | [408–477] | 3562 | [1–453] | 3650 | [1–484] | 3710 | [1–560] |
| 3512 | [1–492] | 3563 | [1–465] | 3651 | [1–494] | 3711 | [1–261],[291–378] |
| 3513 | [1–461] | 3564 | [1–553] | 3652 | [1–31] | 3712 | [1–479] |
| 3514 | [421–469] | 3565 | [1–93],[350–491] | 3713 | [1–499] | 3773 | [1–505] |
| 3515 | [299–325] | 3566 | [1–93],[350–494] | 3714 | [1–480] | 3775 | [1–473] |
| 3516 | [1–255] | 3567 | [1–459] | 3715 | [1–507] | 3776 | [1–421],[537–1100] |
| 3517 | [1–297] | 3568 | [1–379],[491–538] | 3716 | [1–771] | 3777 | [1–516] |
| 3518 | [1–754] | 3569 | [1–441],[553–595] | 3717 | [1–599] | 3778 | [1–687] |
| 3519 | [1–657] | 3570 | [126–265] | 3718 | [1–475] | 3779 | [1–79] |
| 3520 | [1–490] | 3571 | [1–404] | 3719 | [162–511] | 3780 | [1–79],[524–555] |
| 3521 | [1–141] | 3572 | [1–401],[513–555] | 3720 | [162–816] | 3781 | [1–534] |
| 3522 | [1–530] | 3573 | [1–315],[345–504] | 3722 | [1–496] | 3782 | [1–467] |
| 3523 | [1–503] | 3575 | [1–494] | 3723 | [1–477] | 3784 | [1–484] |
| 3524 | [1–198] | 3576 | [1–282] | 3724 | [1–469] | 3785 | [1–153],[407–442] |
| 3525 | [1–572] | 3577 | [1–313] | 3725 | [208–373] | 3786 | [1–420] |
| 3526 | [1–343],[372–457] | 3579 | [1–308] | 3726 | [1–523] | 3787 | [1–505] |
| 3527 | [1–614] | 3580 | [1–407] | 3727 | [173–316],[270–462],[504–579] | 3788 | [384–453] |
| 3528 | [1–35],[473–502] | 3582 | [1–69] |  |  |  |  |
| 3530 | [1–454] | 3583 | [36–516] | 3728 | [1–455] | 3789 | [1–488] |
| 3531 | [1–385] | 3584 | [1–44] | 3729 | [1–450] | 3791 | [1–398] |
| 3532 | [1–511] | 3585 | [1–396] | 3730 | [1–394] | 3792 | [1–28] |
| 3535 | [1–482] | 3586 | [333–472] | 3731 | [1–494] | 3794 | [160–240],[292–321],[358–573] |
| 3536 | [1–428] | 3588 | [1–558] |  |  |  |  |
| 3537 | [1–424] | 3589 | [1–637] | 3732 | [1–524] | 3796 | [30–85] |
| 3538 | [1–96],[194–495] | 3590 | [1–79],[154–477] | 3733 | [1–479] | 3800 | [1–79] |
| 3539 | [1–498] | 3591 | [1–77],[121–162],[248–459] | 3735 | [1–377] | 3801 | [1–462] |
|  |  |  |  | 3736 | [1–496] | 3802 | [1–468] |
| 3540 | [1–500] | 3592 | [265–376] | 3738 | [1–73] | 3803 | [1–985] |
| 3542 | [1–526] | 3593 | [56–492] | 3739 | [1–26],[129–327] | 3804 | [1–509] |
| 3543 | [1–520] | 3594 | [1–512] | 3741 | [1–387] | 3805 | [1–400] |
| 3595 | [1–82],[117–571] | 3653 | [1–501] | 3742 | [1–36],[160–222],[264–316],[459–523] | 3806 | [1–450] |
| 3596 | [1–482] | 3654 | [1–595] |  |  |  |  |
| 3598 | [92–292] | 3655 | [1–490] | 3743 | [1–613] | 3809 | [1–590] |
| 3599 | [1–372] | 3658 | [1–456] | 3746 | [37–418] | 3810 | [43–503] |
| 3600 | [1–157],[210–236] | 3662 | [1–362] | 3747 | [1–27],[192–487] | 3811 | [1–528] |
| 3601 | [1–150],[203–394] | 3663 | [1–1043] | 3748 | [1–534] | 3812 | [1–519] |
| 3602 | [1–480] | 3665 | [324–385] | 3749 | [167–194],[337–378] | 3813 | [1–518] |
| 3603 | [1–460] | 3666 | [1–47] | 3752 | [1–468] | 3814 | [1–515] |
| 3606 | [443–469] | 3668 | [432–467] | 3753 | [1–238],[272–557] | 3815 | [1–480] |
| 3607 | [1–50],[114–488] | 3669 | [324–385] | 3754 | [383–429] | 3816 | [1–458] |
| 3608 | [1–501] | 3670 | [1–71],[322–363] | 3756 | [1–462] | 3821 | [384–449] |
| 3609 | [1–638] | 3671 | [84–110],[359–400] | 3757 | [1–473] | 3822 | [1–569] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3758 | [171–483] | 3823 | [1–453] | 7821 | [1–361] | 7879 | [1–83] |
| 3759 | [1–518] | 3824 | [1–491] | 7822 | [1–317] | 7880 | [124–265] |
| 3763 | [1–82] | 3825 | [1–487] | 7823 | [1–343] | 7881 | [1–508] |
| 3764 | [1–96] | 3826 | [1–603] | 7824 | [1–343] | 7883 | [1–314] |
| 3765 | [1–504] | 3827 | [1–465] | 7825 | [1–208] | 7884 | [1–501] |
| 3766 | [1–620] | 3828 | [1–544] | 7826 | [76–293] | 7885 | [1–344] |
| 3767 | [414–478] | 3829 | [1–48],[90–294],[503–589] | 7827 | [1–242] | 7886 | [1–455] |
| 3768 | [1–480] | 3830 | [1–561] | 7828 | [1–384],[424–533] | 7887 | [1–401] |
| 3769 | [102–461] | 3831 | [1–542] | 7830 | [1–310] | 7888 | [1–171] |
| 3770 | [128–460] | 3832 | [41–456] | 7831 | [1–548] | 7889 | [1–77] |
| 3771 | [1–618] | 3833 | [1–463] | 7832 | [1–328] | 7890 | [1–328] |
| 3834 | [1–592] | 7749 | [1–108] | 7833 | [1–505] | 7891 | [1–395] |
| 3835 | [1–452] | 7750 | [1–96] | 7834 | [1–117] | 7892 | [1–501] |
| 3836 | [1–50],[248–298] | 7751 | [1–153] | 7836 | [1–307] | 7893 | [1–94],[125–329] |
| 3837 | [1–550] | 7752 | [1–108] | 7837 | [1–547] | 7895 | [1–170] |
| 3839 | [321–536] | 7753 | [1–101] | 7838 | [1–263] | 7896 | [1–170] |
| 3840 | [321–508] | 7754 | [1–108] | 7839 | [1–465] | 7898 | [1–475] |
| 3841 | [1–421] | 7755 | [1–113] | 7840 | [1–370] | 7899 | [1–314] |
| 3844 | [1–252] | 7756 | [1–108] | 7841 | [1–307] | 7900 | [1–476] |
| 3845 | [1–352] | 7757 | [1–108] | 7842 | [1–515] | 7901 | [1–440] |
| 3847 | [397–453] | 7758 | [1–108] | 7843 | [1–365] | 7902 | [1–357] |
| 3848 | [1–106],[140–674] | 7759 | [1–406] | 7844 | [1–308] | 7903 | [1–334] |
| 3849 | [1–515] | 7760 | [1–108] | 7845 | [1–532] | 7904 | [1–164] |
| 3850 | [1–514] | 7761 | [1–88] | 7846 | [1–488] | 7906 | [1–170] |
| 3851 | [1–514] | 7762 | [1–169] | 7847 | [1–467] | 7907 | [1–170] |
| 3852 | [1–104],[138–515] | 7763 | [1–108] | 7848 | [240–329] | 7909 | [1–445] |
| 3853 | [1–516] | 7764 | [1–108] | 7850 | [1–100] | 7910 | [1–51] |
| 3854 | [1–519] | 7765 | [1–108] | 7851 | [1–381] | 7911 | [1–350],[454–479] |
| 3855 | [1–104],[138–516] | 7766 | [1–169] | 7853 | [1–58] | 7912 | [1–84] |
| 3856 | [1–105],[139–428] | 7767 | [1–108] | 7855 | [1–90] | 7913 | [1–168] |
| 3857 | [1–105],[139–428] | 7768 | [1–134] | 7856 | [1–118] | 7914 | [1–52] |
| 3858 | [1–105],[139–516] | 7769 | [1–108] | 7858 | [1–73] | 7915 | [1–123] |
| 3859 | [1–515] | 7770 | [1–108] | 7916 | [1–31] | 7970 | [1–67] |
| 3860 | [1–468] | 7771 | [1–108] | 7917 | [1–321] | 7971 | [1–206] |
| 3861 | [1–31] | 7772 | [1–266] | 7919 | [1–271] | 7972 | [1–73] |
| 3863 | [1–201] | 7773 | [1–108] | 7920 | [40–171] | 7973 | [1–332] |
| 3864 | [1–513] | 7774 | [1–63] | 7921 | [1–356] | 7976 | [1–270] |
| 3865 | [264–495] | 7775 | [1–299] | 7922 | [1–299] | 7977 | [1–172] |
| 3866 | [1–470] | 7776 | [1–108] | 7923 | [1–354] | 7978 | [1–321] |
| 3868 | [1–500] | 7778 | [1–101] | 7924 | [1–455] | 7979 | [1–170] |
| 3869 | [1–489] | 7779 | [1–63] | 7925 | [1–425] | 7982 | [1–328] |
| 3870 | [1–503] | 7781 | [1–108] | 7926 | [1–83] | 7983 | [1–58] |
| 3871 | [252–298] | 7782 | [1–154] | 7927 | [1–313] | 7984 | [1–422] |
| 3872 | [1–480] | 7783 | [1–169] | 7928 | [1–314] | 7985 | [1–113] |
| 3873 | [1–523] | 7784 | [1–108] | 7929 | [1–313] | 7986 | [1–163] |
| 3874 | [1–173],[338–613] | 7785 | [1–108] | 7930 | [1–328] | 7987 | [76–100] |
| 3875 | [1–501] | 7786 | [1–366] | 7931 | [1–178],[211–409],[448–483] | 7988 | [1–171] |
| 3876 | [1–497] | 7787 | [1–101] | 7932 | [1–125] | 7989 | [1–104] |
| 3877 | [244–453] | 7788 | [1–444] | 7933 | [1–314] | 7990 | [1–171] |
| 3879 | [465–489] | 7789 | [1–108] | 7934 | [1–294] | 7991 | [1–519] |
| 3880 | [1–189],[457–707] | 7790 | [1–108] | 7935 | [1–408] | 7992 | [1–67] |
| 3881 | [1–459] | 7791 | [1–108] | 7936 | [1–279] | 7993 | [1–185] |
| 3883 | [1–231] | 7792 | [1–339] | 7937 | [1–65] | 7994 | [1–171] |
| 7744 | [1–108] | 7795 | [1–169] | 7940 | [1–263] | 7995 | [1–436] |
| 7745 | [1–89] | 7796 | [1–108] | 7942 | [1–315] | 7996 | [1–171] |
| 7746 | [1–108] | 7798 | [1–108] | 7943 | [1–458] | 7997 | [1–31] |
| 7747 | [1–108] | 7799 | [1–89] | 7944 | [1–309] | 7999 | [1–68] |
| 7748 | [1–154] | 7800 | [1–63] | 7945 | [1–238] | 8000 | [1–145],[343–385] |
| 7801 | [1–150] | 7860 | [1–112] | 7946 | [1–336] | 8001 | [1–324] |
| 7802 | [1–500] | 7861 | [1–100] | 7947 | [1–166] | 8002 | [1–481] |
| 7803 | [1–108] | 7862 | [1–27],[140–184] | 7948 | [1–140] | 8003 | [1–481] |
| 7804 | [1–108] | 7864 | [1–426] | 7949 | [1–316] | 8004 | [1–421] |
| 7805 | [1–108] | 7865 | [1–367] | 7950 | [33–412] | 8005 | [309–333] |
| 7806 | [1–297] | 7866 | [1–256] | 7951 | [1–431] | 8006 | [1–58] |
| 7807 | [1–357] | 7867 | [1–452] | 7952 | [1–83] | 8007 | [1–475] |
| 7809 | [1–25],[282–385] | 7870 | [1–349] | 7953 | [1–280] | 8008 | [373–435] |
| 7810 | [1–53] | 7871 | [1–177] | 7954 | [1–171] | 8009 | [1–314] |
| 7811 | [1–381] | 7872 | [1–494] | 7955 | [1–459] | 8010 | [1–337] |
| 7812 | [1–177] | 7874 | [1–216] | 7956 | [1–391] | 8011 | [1–310] |
| 7813 | [1–162] | 7875 | [1–106] | 7957 | [100–142] | 8013 | [1–376] |
| 7814 | [1–35] | 7876 | [1–172] | 7958 | [1–171] | 8014 | [1–463] |
| 7818 | [1–158] | 7877 | [1–233] | 7960 | [1–244] | 8016 | [1–60] |
| 7819 | [1–205] | 7878 | [1–155] | 7961 | [1–95] | 8017 | [1–408] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 7962 | [1–429] | 8018 | [1–103] | 8159 | [1–170],[217–291],[344–396] | 8217 | [1–368] |
| 7963 | [1–334] | 8019 | [1–73] | 8160 | [144–377] | 8218 | [1–180] |
| 7964 | [1–293] | 8020 | [1–96] | 8161 | [1–385] | 8219 | [1–377] |
| 7966 | [1–152] | 8021 | [1–121] | 8162 | [1–367] | 8222 | [1–359] |
| 7967 | [1–86] | 8022 | [1–67] | 8163 | [1–153] | 8223 | [1–468] |
| 7968 | [1–330] | 8023 | [1–58] | 8164 | [1–385] | 8224 | [1–407] |
| 8024 | [1–164] | 8073 | [1–177] | 8166 | [1–325] | 8226 | [1–473] |
| 8025 | [1–104] | 8074 | [1–165] | 8167 | [218–433] | 8227 | [1–535] |
| 8027 | [1–163] | 8075 | [1–104] | 8168 | [1–423] | 8228 | [1–378] |
| 8028 | [1–103] | 8076 | [1–58] | 8170 | [1–399] | 8229 | [1–432] |
| 8030 | [1–104] | 8077 | [1–454] | 8172 | [1–72] | 8230 | [1–404] |
| 8031 | [1–104] | 8078 | [1–103] | 8173 | [315–425] | 8231 | [1–72] |
| 8032 | [1–104] | 8080 | [1–103] | 8174 | [1–444] | 8233 | [1–356] |
| 8033 | [1–77] | 8081 | [1–127] | 8175 | [1–403] | 8235 | [1–452] |
| 8034 | [1–74] | 8082 | [1–102] | 8177 | [1–438] | 8236 | [1–155] |
| 8035 | [1–104] | 8084 | [1–103] | 8178 | [1–298] | 8237 | [1–432] |
| 8036 | [1–58] | 8085 | [1–146] | 8179 | [1–292] | 8238 | [1–444] |
| 8037 | [1–104] | 8086 | [1–164] | 8180 | [1–153] | 8240 | [1–116],[145–455] |
| 8038 | [1–90] | 8087 | [1–103] | 8181 | [1–352] | 8241 | [1–189] |
| 8039 | [1–65] | 8088 | [1–103] | 8182 | [1–70] | 8242 | [1–65],[180–221],[388–450] |
| 8040 | [1–166] | 8089 | [1–58] | | | | |
| 8041 | [1–103] | 8090 | [1–97] | | | | |
| 8042 | [1–79] | 8092 | [1–103] | 8183 | [1–347] | 8243 | [1–243] |
| 8043 | [1–103] | 8093 | [1–67] | 8184 | [1–382] | 8244 | [1–463] |
| 8044 | [1–150] | 8094 | [1–114] | 8185 | [1–318] | 8245 | [1–446] |
| 8045 | [1–360] | 8095 | [1–67] | 8186 | [1–383] | 8246 | [1–473] |
| 8046 | [1–104] | 8096 | [1–58] | 8187 | [1–430] | 8247 | [1–549] |
| 8047 | [1–71] | 8097 | [1–61] | 8188 | [1–370] | 8248 | [1–506] |
| 8048 | [1–92] | 8099 | [1–377] | 8249 | [1–525] | 8310 | [1–333] |
| 8049 | [1–103] | 8100 | [1–148] | 8250 | [1–435] | 8311 | [1–414] |
| 8050 | [1–103] | 8102 | [1–58] | 8251 | [1–413] | 8312 | [1–228] |
| 8051 | [1–132] | 8103 | [1–58] | 8252 | [1–299] | 8313 | [1–432] |
| 8052 | [1–92] | 8105 | [1–234] | 8253 | [1–350] | 8315 | [1–361] |
| 8053 | [1–103] | 8106 | [1–102] | 8254 | [1–430] | 8316 | [1–41] |
| 8054 | [1–103] | 8107 | [1–95] | 8257 | [1–63] | 8317 | [1–416] |
| 8055 | [1–88] | 8108 | [1–72] | 8259 | [1–420] | 8319 | [1–433] |
| 8056 | [1–103] | 8109 | [1–147] | 8261 | [1–419] | 8320 | [1–337] |
| 8057 | [1–57] | 8110 | [1–103] | 8262 | [1–39] | 8321 | [1–398] |
| 8058 | [1–191] | 8111 | [1–104] | 8263 | [1–33] | 8322 | [1–396] |
| 8059 | [1–75] | 8112 | [1–138] | 8264 | [1–139] | 8323 | [1–353] |
| 8060 | [1–365] | 8113 | [1–103] | 8265 | [1–188] | 8324 | [1–459] |
| 8061 | [1–65] | 8114 | [1–103] | 8267 | [1–447] | 8325 | [1–307] |
| 8062 | [1–58] | 8115 | [1–104] | 8269 | [1–256],[298–467] | 8327 | [1–277] |
| 8063 | [1–335] | 8116 | [1–103] | 8271 | [1–374] | 8328 | [1–141] |
| 8064 | [1–198] | 8117 | [1–58] | 8272 | [1–196] | 8329 | [1–360] |
| 8065 | [1–165] | 8118 | [1–164] | 8273 | [1–468] | 8330 | [1–349] |
| 8066 | [1–104] | 8119 | [1–58] | 8274 | [1–374] | 8331 | [1–457] |
| 8067 | [1–165] | 8120 | [1–75] | 8275 | [1–395] | 8333 | [1–167] |
| 8068 | [1–104] | 8121 | [1–76] | 8276 | [1–498] | 8334 | [1–386] |
| 8069 | [1–84] | 8123 | [1–104] | 8277 | [1–240] | 8335 | [1–242] |
| 8070 | [1–164] | 8124 | [1–58] | 8278 | [315–479] | 8336 | [1–356] |
| 8071 | [1–235] | 8125 | [1–205] | 8279 | [51–75],[124–160],[230–277],[348–413] | 8337 | [1–56] |
| 8072 | [1–104] | 8127 | [1–165] | | | | |
| 8128 | [1–104] | 8191 | [1–63] | 8281 | [1–180] | 8338 | [1–311] |
| 8130 | [1–317] | 8193 | [1–55] | 8282 | [1–62] | 8340 | [1–131] |
| 8133 | [1–352] | 8194 | [1–157] | 8283 | [1–442] | 8341 | [1–440] |
| 8134 | [1–390] | 8195 | [1–183] | 8284 | [1–480] | 8342 | [48–391] |
| 8135 | [1–441] | 8196 | [1–408] | 8286 | [1–202] | 8343 | [1–422] |
| 8136 | [291–316] | 8197 | [1–460] | 8289 | [1–316] | 8345 | [1–359] |
| 8137 | [1–243] | 8198 | [1–250],[355–459] | 8290 | [1–290] | 8346 | [1–387] |
| 8138 | [1–368] | 8199 | [1–447] | 8291 | [1–58] | 8348 | [1–365] |
| 8140 | [1–407] | 8200 | [1–62] | 8292 | [1–326],[394–457] | 8349 | [1–327] |
| 8141 | [1–390] | 8201 | [1–398] | 8294 | [1–287] | 8351 | [1–477] |
| 8143 | [474–499] | 8202 | [1–448] | 8295 | [1–218] | 8353 | [1–272] |
| 8144 | [1–537] | 8203 | [1–429] | 8296 | [50–222] | 8355 | [1–83] |
| 8145 | [1–266] | 8205 | [1–29],[59–85] | 8297 | [1–280] | 8356 | [1–534] |
| 8147 | [1–414] | 8206 | [1–321] | 8299 | [1–127],[203–244],[283–339] | 8358 | [1–472] |
| 8149 | [135–428] | 8207 | [1–452] | | | | |
| 8151 | [1–160] | 8208 | [1–183] | 8300 | [1–369] | 8359 | [1–416] |
| 8152 | [1–165] | 8210 | [1–297] | 8302 | [1–168] | 8360 | [1–424] |
| 8153 | [1–111] | 8211 | [1–167] | 8303 | [1–66] | 8361 | [1–349] |
| 8154 | [1–395] | 8212 | [1–403] | 8304 | [1–106] | 8363 | [1–361] |
| 8155 | [1–445] | 8213 | [1–172],[406–466] | 8305 | [1–358] | 8364 | [1–344] |
| 8156 | [1–407] | 8215 | [1–428] | 8306 | [1–425] | 8366 | [1–268] |

TABLE IVa-continued (Novelty:95%)

| Seq Id No. | Positions of preferred fragments | Seq Id No. | Positions of preferred fragments |
|---|---|---|---|
| 8307 | [1–38],[212–393] | 8367 | [1–370] |
| 8308 | [1–153],[296–338] | 8368 | [1–327] |
| 8309 | [1–216] | 8369 | [1–360] |
| 8370 | [1–498] | 8428 | [1–395] |
| 8371 | [1–77] | 8429 | [1–438] |
| 8372 | [1–389] | 8430 | [1–73] |
| 8374 | [1–398] | 8431 | [1–79] |
| 8375 | [1–405] | 8432 | [1–232] |
| 8376 | [1–143],[257–383] | 8434 | [1–427] |
| 8377 | [1–150] | 8435 | [1–309] |
| 8378 | [1–412] | 8436 | [1–586] |
| 8379 | [1–378] | 8437 | [1–423] |
| 8380 | [1–464] | 8438 | [1–465] |
| 8381 | [1–351] | 8439 | [1–304] |
| 8382 | [1–51] | 8440 | [1–68] |
| 8383 | [1–159] | 8441 | [1–125] |
| 8384 | [1–440] | 8443 | [1–330] |
| 8385 | [1–438] | 8444 | [1–403] |
| 8386 | [104–421] | 8445 | [1–419] |
| 8389 | [1–445] | 8446 | [158–265] |
| 8390 | [1–442] | 8447 | [1–67] |
| 8391 | [1–419] | 8448 | [1–238] |
| 8393 | [1–463] | 8449 | [1–449] |
| 8394 | [77–237] | 8451 | [1–349] |
| 8395 | [1–360] | 8452 | [1–547] |
| 8396 | [1–314] | 8453 | [1–75] |
| 8397 | [1–439] | 8455 | [1–349] |
| 8398 | [1–328] | 8456 | [1–350] |
| 8399 | [1–398] | 8458 | [1–378] |
| 8400 | [1–96] | 8460 | [1–77] |
| 8401 | [1–557] | 8461 | [1–494] |
| 8402 | [1–446] | 8462 | [1–421] |
| 8404 | [1–155] | 8464 | [1–369] |
| 8406 | [1–221] | 8465 | [1–480] |
| 8408 | [1–41] | 8466 | [1–508] |
| 8409 | [138–229] | 8467 | [1–460] |
| 8410 | [1–108] | 8468 | [1–466] |
| 8411 | [1–329] | 8470 | [1–430] |
| 8412 | [1–271] | 8471 | [1–332] |
| 8413 | [1–492] | 8472 | [1–445] |
| 8417 | [1–340] | 8473 | [1–375] |
| 8418 | [1–226] | 8474 | [1–256] |
| 8420 | [1–67] | 8475 | [1–355] |
| 8421 | [1–484] | 8476 | [1–342] |
| 8422 | [1–52] | 8477 | [1–38] |
| 8423 | [1–50] | 8478 | [1–445] |
| 8424 | [1–312] | 8479 | [1–206] |
| 8425 | [1–157] | 8480 | [1–138] |
| 8426 | [30–83] | 8481 | [1–67] |
| 8427 | [1–504] | 8482 | [1–29] |
| 8483 | [1–270] | 8539 | [1–351] |
| 8484 | [1–317] | 8540 | [1–423] |
| 8485 | [1–312] | 8541 | [1–394] |
| 8486 | [1–324] | 8543 | [1–480] |
| 8487 | [1–203] | 8544 | [1–408] |
| 8488 | [1–355] | 8545 | [1–302] |
| 8489 | [1–328] | 8546 | [1–348] |
| 8490 | [1–58] | 8547 | [1–84] |
| 8491 | [1–361] | 8548 | [1–88] |
| 8493 | [97–127] | 8549 | [1–183] |
| 8495 | [1–395] | 8550 | [1–146] |
| 8497 | [1–403] | 8551 | [1–147] |
| 8499 | [1–226],[391–416] | 8552 | [1–149] |
| 8500 | [1–432] | 8553 | [1–167] |
| 8501 | [1–462] | 8554 | [1–474] |
| 8502 | [1–451] | 8555 | [1–426] |
| 8503 | [1–365] | 8556 | [1–404] |
| 8504 | [1–359] | 8557 | [1–318] |
| 8505 | [1–375] | 8560 | [1–442] |
| 8506 | [1–364] | 8561 | [1–318] |
| 8507 | [1–401] | 8562 | [1–317] |
| 8508 | [395–421] | 8563 | [1–184] |
| 8509 | [1–429] | 8564 | [1–136] |
| 8510 | [1–406] | 8565 | [1–307] |
| 8511 | [1–394] | 8566 | [1–207] |
| 8512 | [1–427] | 8567 | [1–136] |
| 8514 | [1–396] | 8568 | [1–395] |
| 8515 | [1–494] | 8570 | [1–184] |
| 8516 | [1–350] | 8571 | [1–67] |
| 8517 | [1–388] | 8572 | [1–387] |
| 8518 | [1–322] | 8574 | [1–416] |
| 8519 | [1–286] | 8575 | [1–331] |
| 8520 | [1–150] | 8576 | [1–68] |
| 8521 | [1–303] | 8577 | [1–483] |
| 8522 | [1–157] | 8578 | [1–386] |
| 8523 | [1–354] | 8579 | [1–363] |
| 8524 | [1–398] | 8580 | [1–385] |
| 8525 | [1–83] | 8581 | [30–202] |
| 8526 | [1–326] | 8584 | [1–144] |
| 8527 | [1–315] | 8585 | [1–361] |
| 8528 | [41–374] | 8586 | [1–439] |
| 8529 | [1–460] | 8587 | [1–166] |
| 8534 | [1–369] | 8588 | [1–103] |
| 8535 | [1–154] | 8589 | [1–151] |
| 8536 | [1–433] | 8591 | [1–362] |
| 8537 | [1–391] | 8593 | [1–80] |
| 8538 | [1–459] | 8594 | [1–84] |
| 8597 | [1–144] | 8666 | [1–84] |
| 8598 | [1–348] | 8667 | [1–288],[405–468] |
| 8599 | [1–363] | 8668 | [1–58] |
| 8600 | [1–126] | 8671 | [1–116] |
| 8603 | [1–132] | 8672 | [1–97] |
| 8605 | [1–114] | 8673 | [1–82] |
| 8606 | [1–84] | 8675 | [1–222] |
| 8609 | [1–73] | 8677 | [1–164] |
| 8611 | [1–103] | 8678 | [1–291],[408–449] |
| 8613 | [1–89] | 8679 | [1–56] |
| 8614 | [1–361] | 8680 | [1–73] |
| 8616 | [1–361] | 8681 | [1–73] |
| 8617 | [1–164] | 8682 | [1–186] |
| 8620 | [1–345] | 8684 | [1–164] |
| 8621 | [1–361] | 8685 | [1–103] |
| 8622 | [1–58] | 8687 | [1–83] |
| 8623 | [1–159] | 8689 | [1–366] |
| 8625 | [1–97] | 8690 | [1–116] |
| 8626 | [1–103] | 8691 | [1–79] |
| 8628 | [1–58] | 8692 | [1–82] |
| 8630 | [1–164] | 8693 | [1–84] |
| 8632 | [1–139] | 8694 | [1–90] |
| 8633 | [1–103] | 8696 | [1–513] |
| 8635 | [1–103] | 8697 | [1–500] |
| 8636 | [1–164] | 8698 | [1–455] |
| 8637 | [1–103] | 8699 | [1–238] |
| 8638 | [1–361] | 8700 | [1–332] |
| 8639 | [1–75] | 8701 | [1–530] |
| 8641 | [1–58] | 8702 | [1–451] |
| 8643 | [1–361] | 8703 | [176–271] |
| 8644 | [1–148] | 8704 | [1–447] |
| 8645 | [1–58] | 8705 | [111–141] |
| 8646 | [1–58] | 8706 | [1–500] |
| 8647 | [1–361] | 8707 | [1–485] |
| 8649 | [1–103] | 8708 | [1–483] |
| 8651 | [1–166] | 8709 | [1–48],[153–433] |
| 8652 | [1–77] | 8710 | [1–260] |
| 8653 | [1–51] | 8711 | [1–251] |
| 8654 | [1–363] | 8712 | [1–115] |
| 8655 | [1–159] | 8713 | [1–447] |
| 8656 | [1–150] | 8714 | [1–431] |
| 8657 | [1–359] | 8715 | [1–454] |
| 8658 | [1–167] | 8716 | [1–62] |
| 8659 | [1–103] | 8717 | [1–309] |
| 8661 | [1–103] | 8718 | [1–384] |
| 8663 | [1–84] | 8719 | [1–375] |
| 8665 | [1–152] | 8721 | [1–236] |
| 8722 | [1–329] | 8775 | [30–336] |
| 8723 | [1–159] | 8776 | [1–273] |
| 8724 | [1–67] | 8777 | [1–226] |
| 8726 | [141–199] | 8778 | [1–226] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 8727 | [1–390] | 8779 | [1–276] | 8862 | [1–379] | 8915 | [1–58] |
| 8728 | [1–28] | 8780 | [1–215] | 8863 | [1–149] | 8916 | [1–103] |
| 8730 | [1–201] | 8781 | [1–410] | 8864 | [1–103] | 8917 | [1–103] |
| 8731 | [1–178] | 8782 | [1–136] | 8865 | [1–103] | 8918 | [1–103] |
| 8732 | [1–291],[408–465] | 8783 | [1–73] | 8866 | [1–58] | 8919 | [1–95] |
| 8733 | [1–172] | 8784 | [1–139] | 8867 | [1–71] | 8921 | [1–58] |
| 8734 | [1–384] | 8785 | [1–396] | 8868 | [1–103] | 8922 | [1–73] |
| 8735 | [1–78] | 8786 | [1–251] | 8869 | [1–164] | 8925 | [1–84] |
| 8736 | [1–52] | 8787 | [1–399] | 8870 | [1–103] | 8926 | [1–103] |
| 8738 | [1–294] | 8788 | [1–509] | 8871 | [1–89] | 8927 | [1–353] |
| 8739 | [1–398] | 8789 | [1–446] | 8872 | [1–381] | 8928 | [1–164] |
| 8740 | [1–337] | 8790 | [1–464] | 8873 | [1–482] | 8929 | [1–76] |
| 8741 | [1–81] | 8791 | [1–461] | 8874 | [1–103] | 8930 | [1–361] |
| 8742 | [1–283],[400–455] | 8792 | [1–235] | 8875 | [1–103] | 8931 | [1–103] |
| 8743 | [1–377] | 8793 | [1–408] | 8876 | [1–95] | 8932 | [1–104] |
| 8744 | [1–287] | 8794 | [1–421] | 8877 | [1–95] | 8935 | [1–132] |
| 8745 | [1–284] | 8796 | [1–159] | 8936 | [1–103] | 8994 | [1–522] |
| 8746 | [1–319] | 8797 | [1–71] | 8937 | [1–362] | 8995 | [1–206] |
| 8749 | [1–81] | 8798 | [1–354] | 8938 | [1–103] | 8996 | [1–62] |
| 8750 | [1–409] | 8799 | [1–408] | 8939 | [1–103] | 8998 | [1–603] |
| 8751 | [1–291],[408–476] | 8800 | [1–295] | 8942 | [1–149] | 9000 | [1–169] |
| 8752 | [1–354] | 8801 | [1–457] | 8944 | [1–103] | 9001 | [1–446] |
| 8753 | [1–327] | 8802 | [1–83] | 8946 | [1–392] | 9002 | [1–341] |
| 8754 | [1–422] | 8803 | [1–158] | 8947 | [1–138] | 9003 | [1–381] |
| 8755 | [1–150] | 8804 | [196–530] | 8948 | [1–65] | 9004 | [1–171] |
| 8756 | [1–94] | 8805 | [1–361] | 8950 | [1–95] | 9005 | [1–366] |
| 8757 | [1–148] | 8806 | [1–158] | 8951 | [1–88] | 9006 | [1–349] |
| 8758 | [1–290] | 8807 | [1–314] | 8952 | [1–152] | 9007 | [1–452] |
| 8759 | [1–289] | 8808 | [1–448] | 8955 | [1–445] | 9008 | [1–425] |
| 8760 | [1–314] | 8810 | [1–181] | 8957 | [1–95] | 9010 | [1–27] |
| 8761 | [1–154] | 8811 | [30–207] | 8958 | [1–103] | 9011 | [1–380] |
| 8762 | [1–203] | 8812 | [1–408] | 8959 | [1–95] | 9012 | [1–468] |
| 8763 | [1–374] | 8813 | [1–372] | 8960 | [1–104] | 9013 | [1–443] |
| 8764 | [58–360] | 8814 | [1–495] | 8961 | [1–89] | 9014 | [1–81] |
| 8765 | [1–384] | 8815 | [1–433] | 8962 | [1–90] | 9015 | [1–381] |
| 8766 | [1–73] | 8816 | [1–471] | 8963 | [1–103] | 9016 | [1–515] |
| 8767 | [1–375] | 8817 | [1–84] | 8964 | [1–103] | 9017 | [1–442] |
| 8768 | [1–281],[398–448] | 8818 | [1–444] | 8965 | [1–114] | 9018 | [1–460] |
| 8769 | [1–341] | 8819 | [1–472] | 8966 | [1–256] | 9019 | [1–261] |
| 8770 | [1–222],[278–342] | 8820 | [1–384] | 8967 | [1–103] | 9020 | [1–411] |
| 8771 | [1–236] | 8821 | [1–410] | 8968 | [1–103] | 9021 | [278–303] |
| 8772 | [1–386] | 8822 | [1–419] | 8969 | [1–89] | 9023 | [1–459] |
| 8773 | [152–211] | 8824 | [1–95] | 8970 | [1–103] | 9024 | [1–387] |
| 8825 | [1–54] | 8878 | [1–103] | 8971 | [1–152] | 9025 | [1–76] |
| 8826 | [1–485] | 8879 | [1–94] | 8972 | [1–164] | 9026 | [1–472] |
| 8827 | [1–434] | 8881 | [1–149] | 8973 | [1–94] | 9027 | [1–315] |
| 8828 | [1–487] | 8883 | [1–95] | 8974 | [1–103] | 9028 | [1–385] |
| 8829 | [1–281] | 8885 | [1–442] | 8975 | [1–103] | 9029 | [1–465] |
| 8830 | [1–544] | 8886 | [1–148] | 8976 | [1–399] | 9030 | [1–470] |
| 8831 | [1–74] | 8887 | [1–103] | 8977 | [1–96] | 9032 | [1–62] |
| 8833 | [1–103] | 8888 | [1–58] | 8978 | [1–103] | 9033 | [93–136] |
| 8834 | [1–103] | 8889 | [1–103] | 8980 | [1–103] | 9034 | [1–422] |
| 8836 | [1–103] | 8890 | [1–361] | 8981 | [1–92] | 9035 | [1–83] |
| 8837 | [1–58] | 8892 | [1–103] | 8982 | [1–372] | 9037 | [1–117] |
| 8838 | [1–361] | 8893 | [1–188] | 8983 | [1–430] | 9038 | [1–72] |
| 8839 | [1–76] | 8894 | [1–103] | 8984 | [1–418] | 9039 | [1–442] |
| 8840 | [1–71] | 8896 | [1–58] | 8986 | [1–323] | 9040 | [1–139] |
| 8841 | [1–475] | 8897 | [1–58] | 8987 | [1–542] | 9041 | [1–164],[286–523] |
| 8842 | [1–76] | 8898 | [1–103] | 8989 | [1–410] | 9042 | [45–432] |
| 8843 | [1–130] | 8899 | [1–150] | 8990 | [1–247] | 9043 | [1–455] |
| 8844 | [1–103] | 8900 | [1–128] | 8991 | [1–89] | 9045 | [1–372] |
| 8845 | [1–133] | 8901 | [1–103] | 8992 | [1–478] | 9046 | [1–508] |
| 8846 | [1–103] | 8902 | [1–84] | 8993 | [1–530] | 9047 | [1–467] |
| 8847 | [1–362] | 8903 | [1–89] | 9048 | [1–461] | 9105 | [1–72],[201–248] |
| 8848 | [1–103] | 8904 | [1–89] | 9049 | [1–232] | 9106 | [1–464] |
| 8849 | [1–73] | 8905 | [1–212] | 9050 | [1–132] | 9107 | [1–157] |
| 8850 | [1–103] | 8907 | [1–95] | 9051 | [109–434] | 9108 | [1–470] |
| 8852 | [1–103] | 8908 | [1–413] | 9052 | [1–63] | 9109 | [1–251] |
| 8855 | [1–103] | 8909 | [1–58] | 9054 | [1–392] | 9110 | [1–247] |
| 8856 | [1–103] | 8910 | [1–58] | 9055 | [1–404] | 9111 | [1–452] |
| 8857 | [1–103] | 8911 | [1–103] | 9056 | [1–149] | 9112 | [1–416] |
| 8858 | [1–84] | 8912 | [1–103] | 9057 | [1–386] | 9113 | [1–444] |
| 8859 | [1–95] | 8913 | [1–103] | 9058 | [1–381] | 9114 | [1–359] |
| 8860 | [1–58] | 8914 | [1–104] | 9059 | [1–79] | 9115 | [1–298] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 9060 | [1–459] | 9116 | [1–326] | 9209 | [1–448] | 9268 | [1–487] |
| 9063 | [1–181] | 9117 | [1–312] | 9210 | [1–283],[325–434] | 9269 | [1–63],[214–357] |
| 9064 | [1–439] | 9118 | [1–194] | 9213 | [1–457] | 9270 | [1–424] |
| 9067 | [1–319] | 9119 | [1–258] | 9214 | [1–388] | 9271 | [1–302],[341–578] |
| 9068 | [1–485] | 9121 | [116–434] | 9215 | [1–429] | 9272 | [1–471] |
| 9069 | [1–487] | 9122 | [1–212] | 9216 | [1–56] | 9273 | [1–449] |
| 9071 | [1–447] | 9123 | [1–410] | 9217 | [1–39],[169–465] | 9274 | [1–305] |
| 9072 | [1–403] | 9125 | [1–422] | 9219 | [1–448] | 9275 | [1–450] |
| 9073 | [1–327] | 9126 | [1–390] | 9220 | [1–225] | 9276 | [1–275],[305–419] |
| 9074 | [1–463] | 9127 | [1–453] | 9277 | [1–398] | 9333 | [1–234] |
| 9075 | [1–385] | 9128 | [107–496] | 9278 | [395–447] | 9334 | [1–472] |
| 9076 | [1–372] | 9130 | [1–275] | 9279 | [1–512] | 9335 | [1–166] |
| 9079 | [1–223] | 9132 | [1–27],[82–170] | 9280 | [1–178] | 9336 | [1–276],[308–381] |
| 9080 | [1–209] | 9133 | [1–93] | 9281 | [1–368] | 9337 | [1–425] |
| 9081 | [1–370] | 9134 | [1–94] | 9282 | [31–457] | 9338 | [1–447] |
| 9083 | [1–511] | 9135 | [1–303] | 9283 | [164–208] | 9339 | [1–483] |
| 9084 | [1–468] | 9136 | [1–235] | 9284 | [1–417] | 9341 | [1–447] |
| 9085 | [1–459] | 9138 | [59–89],[188–335] | 9285 | [1–347] | 9342 | [1–399] |
| 9086 | [1–97] | 9139 | [1–380] | 9286 | [1–438] | 9343 | [1–202] |
| 9087 | [1–498] | 9140 | [1–294] | 9287 | [1–126] | 9344 | [1–432] |
| 9088 | [1–183] | 9141 | [1–184],[262–304] | 9288 | [1–495] | 9345 | [1–138] |
| 9089 | [1–471] | 9142 | [1–359] | 9289 | [1–485] | 9346 | [1–420] |
| 9090 | [1–219] | 9143 | [1–366] | 9290 | [1–239] | 9347 | [1–168],[314–422] |
| 9091 | [1–448] | 9144 | [1–373] | 9291 | [1–431] | 9348 | [1–87] |
| 9093 | [1–175] | 9145 | [1–350] | 9292 | [1–463] | 9349 | [1–430] |
| 9094 | [1–267] | 9147 | [1–412] | 9294 | [1–193],[320–444] | 9350 | [1–513] |
| 9095 | [1–156] | 9148 | [1–422] | 9295 | [1–463] | 9351 | [1–470] |
| 9096 | [1–151],[237–305] | 9149 | [1–447] | 9298 | [1–271] | 9352 | [1–477] |
| 9097 | [1–556] | 9150 | [1–432] | 9299 | [1–299] | 9353 | [1–490] |
| 9098 | [1–429] | 9151 | [1–369] | 9300 | [37–85] | 9355 | [1–415] |
| 9099 | [1–475] | 9154 | [1–439] | 9302 | [1–293] | 9356 | [1–443] |
| 9100 | [1–442] | 9155 | [1–56] | 9303 | [1–385] | 9357 | [1–389] |
| 9101 | [1–475] | 9156 | [1–423] | 9304 | [1–451] | 9358 | [1–475] |
| 9102 | [1–460] | 9157 | [1–426] | 9305 | [1–444] | 9359 | [1–385] |
| 9103 | [1–413] | 9158 | [1–432] | 9306 | [1–510] | 9360 | [1–538] |
| 9104 | [1–26] | 9159 | [1–433] | 9307 | [1–420] | 9361 | [1–225] |
| 9161 | [1–436] | 9221 | [1–452] | 9309 | [1–535] | 9362 | [1–64] |
| 9163 | [1–277] | 9222 | [1–451] | 9310 | [1–534] | 9363 | [1–415] |
| 9164 | [1–395] | 9223 | [1–449] | 9311 | [1–370] | 9364 | [1–413] |
| 9167 | [1–168] | 9224 | [1–277] | 9312 | [1–484] | 9365 | [1–425] |
| 9168 | [1–401] | 9225 | [1–97] | 9313 | [1–538] | 9366 | [70–132],[308–456] |
| 9170 | [1–30] | 9226 | [1–355] | 9314 | [1–81] | 9367 | [1–498] |
| 9171 | [1–404] | 9228 | [218–371] | 9315 | [1–443] | 9368 | [1–373] |
| 9172 | [152–424] | 9229 | [82–384] | 9316 | [1–440] | 9369 | [1–390] |
| 9174 | [1–390] | 9230 | [1–379] | 9317 | [1–441] | 9370 | [1–544] |
| 9175 | [97–473] | 9231 | [1–409] | 9319 | [1–424] | 9371 | [1–451] |
| 9176 | [1–261],[349–428] | 9233 | [1–427] | 9320 | [1–446] | 9372 | [1–272] |
| 9177 | [1–384] | 9234 | [1–425] | 9322 | [1–390] | 9373 | [1–420] |
| 9178 | [1–470] | 9235 | [1–438] | 9323 | [1–217] | 9374 | [1–426] |
| 9179 | [1–435] | 9236 | [1–435] | 9324 | [1–258] | 9375 | [1–237] |
| 9180 | [1–185] | 9237 | [1–88] | 9326 | [1–369] | 9376 | [1–438] |
| 9181 | [1–278],[326–424] | 9238 | [1–455] | 9327 | [1–452] | 9377 | [1–480] |
| 9182 | [1–435] | 9240 | [1–73],[234–374] | 9328 | [1–336] | 9378 | [1–444] |
| 9183 | [1–427] | 9241 | [1–483] | 9329 | [1–272] | 9379 | [1–482] |
| 9184 | [1–422] | 9242 | [1–97],[135–496] | 9331 | [1–437] | 9380 | [1–250] |
| 9185 | [1–392] | 9243 | [1–214] | 9332 | [1–210],[286–425] | 9381 | [1–305] |
| 9186 | [1–191] | 9244 | [1–439] | 9382 | [1–325] | 9439 | [1–234] |
| 9187 | [1–411] | 9245 | [1–472] | 9383 | [1–381] | 9441 | [1–444] |
| 9188 | [1–460] | 9246 | [1–409] | 9385 | [1–436] | 9442 | [1–418] |
| 9189 | [1–426] | 9247 | [1–398] | 9386 | [1–127] | 9443 | [1–223] |
| 9190 | [1–308] | 9248 | [1–387] | 9387 | [1–336] | 9444 | [1–238] |
| 9191 | [1–224],[253–380] | 9250 | [1–203] | 9389 | [1–510] | 9445 | [1–467] |
| 9194 | [1–371] | 9251 | [1–440] | 9390 | [1–447] | 9447 | [1–405] |
| 9195 | [1–167] | 9252 | [1–163] | 9391 | [1–433] | 9448 | [1–191] |
| 9197 | [1–418] | 9255 | [1–402] | 9392 | [1–104] | 9449 | [1–416] |
| 9198 | [1–383] | 9256 | [1–531] | 9393 | [1–435] | 9450 | [1–415] |
| 9200 | [1–446] | 9257 | [1–402] | 9395 | [1–423] | 9452 | [1–279] |
| 9201 | [1–420] | 9258 | [1–461] | 9396 | [1–485] | 9453 | [1–328] |
| 9202 | [1–442] | 9259 | [1–504] | 9397 | [1–471] | 9454 | [1–392] |
| 9203 | [1–414] | 9260 | [1–291] | 9399 | [1–255],[286–420] | 9455 | [1–235] |
| 9204 | [1–423] | 9262 | [1–519] | 9400 | [1–411] | 9456 | [1–537] |
| 9205 | [81–149] | 9263 | [1–466] | 9401 | [1–407] | 9457 | [249–375] |
| 9206 | [1–89] | 9265 | [1–333] | 9402 | [1–263] | 9458 | [1–103] |
| 9207 | [1–378] | 9266 | [1–534] | 9403 | [1–176] | 9460 | [1–71] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 9404 | [1–317] | 9461 | [1–59] | 9548 | [1–73] | 9603 | [1–366] |
| 9405 | [1–455] | 9462 | [145–216] | 9549 | [1–527] | 9604 | [1–78] |
| 9406 | [1–255] | 9463 | [1–328] | 9550 | [1–487] | 9605 | [1–60] |
| 9407 | [1–276] | 9464 | [1–91] | 9606 | [1–435] | 9661 | [1–76] |
| 9408 | [1–454] | 9466 | [1–341] | 9608 | [86–163] | 9662 | [1–446] |
| 9411 | [1–553] | 9467 | [1–165] | 9609 | [1–397] | 9663 | [1–204] |
| 9412 | [1–451] | 9468 | [1–104] | 9610 | [55–502] | 9664 | [1–456] |
| 9413 | [1–407] | 9469 | [1–107] | 9611 | [1–431] | 9665 | [1–469] |
| 9414 | [1–308] | 9470 | [1–358] | 9612 | [1–420] | 9666 | [1–452] |
| 9415 | [204–408] | 9471 | [1–308] | 9613 | [1–248],[380–459] | 9667 | [1–216] |
| 9416 | [1–305] | 9472 | [1–104] | 9614 | [1–478] | 9668 | [1–195],[372–474] |
| 9417 | [1–439] | 9473 | [1–101] | 9615 | [1–336] | 9669 | [1–285] |
| 9419 | [1–430] | 9474 | [1–381] | 9616 | [1–386] | 9671 | [1–81] |
| 9420 | [1–368] | 9475 | [1–107] | 9617 | [1–86] | 9672 | [1–481] |
| 9421 | [1–413] | 9476 | [1–104] | 9618 | [79–117] | 9674 | [1–41] |
| 9422 | [1–422] | 9477 | [1–97] | 9619 | [1–357] | 9677 | [1–434] |
| 9424 | [356–435] | 9478 | [1–60] | 9620 | [1–422] | 9678 | [1–170] |
| 9425 | [1–426] | 9480 | [1–52] | 9621 | [1–80] | 9680 | [1–97] |
| 9426 | [1–490] | 9481 | [1–323] | 9622 | [1–511] | 9681 | [1–372] |
| 9427 | [1–302] | 9482 | [1–96] | 9624 | [1–44] | 9682 | [1–432] |
| 9428 | [1–234] | 9483 | [1–59] | 9625 | [1–327] | 9683 | [1–323] |
| 9429 | [1–440] | 9484 | [1–399] | 9626 | [1–86] | 9684 | [1–432] |
| 9430 | [1–560] | 9485 | [1–103] | 9627 | [1–101],[144–452] | 9685 | [1–90] |
| 9431 | [1–442] | 9486 | [1–61] | 9629 | [1–233] | 9686 | [1–461] |
| 9432 | [1–61] | 9487 | [1–107] | 9630 | [1–321] | 9687 | [1–361] |
| 9433 | [1–398] | 9489 | [1–96] | 9631 | [1–308] | 9688 | [1–416] |
| 9434 | [1–119] | 9491 | [1–88] | 9632 | [1–391] | 9689 | [1–67] |
| 9435 | [1–436] | 9492 | [1–107] | 9633 | [174–274],[414–455] | 9690 | [1–440] |
| 9437 | [114–160] | 9494 | [1–83] | 9634 | [1–433] | 9691 | [1–387] |
| 9495 | [1–88] | 9552 | [1–355] | 9635 | [1–292] | 9692 | [1–445] |
| 9496 | [1–102] | 9553 | [1–173] | 9636 | [1–37],[82–274] | 9693 | [1–51] |
| 9498 | [1–350] | 9556 | [264–405] | 9638 | [1–369] | 9694 | [1–254] |
| 9499 | [1–107] | 9559 | [1–488] | 9639 | [1–473] | 9695 | [1–421] |
| 9500 | [1–58] | 9561 | [1–53],[251–369] | 9640 | [1–292] | 9696 | [1–458] |
| 9501 | [1–96] | 9562 | [1–274] | 9643 | [1–266] | 9697 | [1–391] |
| 9502 | [1–112] | 9563 | [1–363] | 9645 | [1–501] | 9698 | [1–86] |
| 9503 | [1–54] | 9564 | [1–361] | 9646 | [1–134] | 9699 | [1–432] |
| 9504 | [1–105] | 9565 | [1–395] | 9647 | [1–364] | 9701 | [1–336] |
| 9505 | [1–107] | 9566 | [1–444] | 9648 | [1–347] | 9702 | [1–399] |
| 9507 | [1–104] | 9567 | [1–110],[153–191],[279–464] | 9649 | [1–157] | 9703 | [1–89] |
| 9508 | [1–101] | 9568 | [1–485] | 9650 | [1–171] | 9704 | [1–323] |
| 9510 | [1–316] | 9569 | [1–332] | 9651 | [1–430] | 9705 | [1–407] |
| 9511 | [1–421] | 9570 | [1–428] | 9652 | [1–389] | 9706 | [1–383] |
| 9513 | [1–351] | 9571 | [1–501] | 9654 | [1–206] | 9707 | [1–463] |
| 9514 | [1–352] | 9572 | [1–511] | 9655 | [1–137] | 9708 | [1–64],[288–405] |
| 9515 | [1–377] | 9573 | [1–76] | 9656 | [1–111] | 9710 | [1–367] |
| 9516 | [1–162],[237–297] | 9574 | [1–454] | 9657 | [1–244] | 9711 | [31–178] |
| 9518 | [1–240] | 9575 | [93–179] | 9658 | [1–332] | 9712 | [44–71] |
| 9519 | [1–521] | 9576 | [1–318] | 9659 | [1–80] | 9713 | [1–103] |
| 9520 | [99–295] | 9577 | [1–264] | 9660 | [1–389] | 9714 | [1–369] |
| 9521 | [1–579] | 9578 | [1–448] | 9715 | [1–316] | 9769 | [299–466] |
| 9522 | [1–83] | 9579 | [1–455] | 9717 | [1–359] | 9770 | [1–440] |
| 9523 | [1–383] | 9580 | [1–474] | 9718 | [1–57] | 9771 | [1–407] |
| 9525 | [1–328] | 9581 | [1–468] | 9719 | [1–434] | 9772 | [1–443] |
| 9526 | [1–160] | 9582 | [1–426] | 9721 | [1–378] | 9773 | [1–89] |
| 9527 | [1–245] | 9583 | [1–141] | 9722 | [1–55],[118–165],[195–368] | 9774 | [1–151] |
| 9528 | [1–505] | 9584 | [1–192] | 9723 | [1–300] | 9775 | [1–424] |
| 9530 | [33–81],[113–335] | 9585 | [1–359] | 9724 | [1–227] | 9776 | [186–248] |
| 9531 | [1–453] | 9586 | [1–115] | 9726 | [117–183] | 9777 | [1–322] |
| 9532 | [1–434] | 9587 | [1–138] | 9727 | [1–167] | 9779 | [1–106] |
| 9534 | [1–398] | 9588 | [1–63] | 9728 | [1–67] | 9782 | [1–431] |
| 9535 | [1–493] | 9589 | [1–72] | 9729 | [1–356] | 9783 | [1–353] |
| 9536 | [320–348] | 9590 | [1–73] | 9730 | [1–58] | 9784 | [1–346] |
| 9537 | [1–680] | 9591 | [1–135] | 9731 | [1–621] | 9785 | [1–435] |
| 9538 | [1–535] | 9592 | [1–78] | 9732 | [1–207] | 9786 | [1–380] |
| 9539 | [1–239] | 9594 | [1–331] | 9733 | [1–87] | 9787 | [1–362] |
| 9540 | [1–438] | 9595 | [73–138] | 9734 | [1–63] | 9788 | [1–500] |
| 9541 | [1–498] | 9596 | [1–194] | 9735 | [1–135] | 9789 | [1–250],[302–429] |
| 9542 | [1–44] | 9597 | [1–456] | 9736 | [1–93] | 9790 | [1–375] |
| 9543 | [1–72],[173–429] | 9598 | [1–403] | 9738 | [1–130],[218–273] | 9792 | [1–299] |
| 9544 | [1–410] | 9600 | [1–402] | 9739 | [1–146] | 9793 | [1–356] |
| 9545 | [1–371] | 9601 | [1–423] | 9740 | [1–61] | 9794 | [46–456] |
| 9546 | [1–511] | 9602 | [1–114] | 9741 | [1–57] | 9795 | [1–33],[68–385] |

TABLE IVa-continued (Novelty:95%)

| Seq Id No. | Positions of preferred fragments | Seq Id No. | Positions of preferred fragments |
|---|---|---|---|
| 9743 | [1–146] | 9796 | [1–374] |
| 9744 | [1–337] | 9797 | [1–393] |
| 9745 | [1–78] | 9799 | [1–425] |
| 9746 | [1–60] | 9801 | [1–462] |
| 9747 | [1–415] | 9802 | [1–91] |
| 9748 | [1–76],[269–410] | 9803 | [1–131],[191–236] |
| 9749 | [1–88],[196–406] | 9804 | [1–254] |
| 9750 | [1–109] | 9805 | [1–351] |
| 9751 | [1–371] | 9806 | [1–425] |
| 9752 | [1–103] | 9807 | [1–68] |
| 9753 | [1–83] | 9808 | [1–394] |
| 9754 | [1–224] | 9809 | [1–463] |
| 9755 | [1–462] | 9810 | [1–368] |
| 9756 | [1–86] | 9811 | [1–62] |
| 9757 | [1–398] | 9812 | [1–502] |
| 9759 | [1–487] | 9813 | [1–500] |
| 9760 | [1–130] | 9814 | [1–500] |
| 9761 | [1–432] | 9815 | [1–416] |
| 9762 | [1–483] | 9817 | [1–471] |
| 9763 | [1–323] | 9819 | [1–472] |
| 9764 | [1–337] | 9820 | [1–482] |
| 9766 | [1–284] | 9821 | [1–441] |
| 9767 | [1–76] | 9822 | [1–444] |
| 9768 | [1–135] | 9823 | [1–237] |
| 9824 | [1–79] | 9875 | [1–452] |
| 9825 | [1–452] | 9877 | [1–426] |
| 9826 | [1–155] | 9878 | [1–439] |
| 9827 | [1–438] | 9879 | [1–504] |
| 9828 | [1–463] | 9880 | [1–194] |
| 9829 | [1–487] | 9881 | [1–483] |
| 9830 | [1–479] | 9884 | [1–345] |
| 9831 | [1–79] | 9886 | [1–359] |
| 9832 | [1–426] | 9887 | [118–444] |
| 9833 | [1–369] | 9889 | [1–461] |
| 9834 | [1–500] | 9890 | [1–79] |
| 9835 | [1–343] | 9891 | [1–74],[306–439] |
| 9836 | [1–62] | 9893 | [1–482] |
| 9837 | [1–72] | 9895 | [1–379] |
| 9838 | [1–507] | 9896 | [1–449] |
| 9839 | [1–574] | 9897 | [1–478] |
| 9840 | [1–303] | 9898 | [1–414] |
| 9841 | [1–78] | 9899 | [1–177] |
| 9842 | [1–415] | 9900 | [1–245] |
| 9843 | [1–33],[152–214] | 9901 | [1–425] |
| 9844 | [1–529] | 9902 | [1–155] |
| 9845 | [1–71] | 9903 | [1–234],[270–308] |
| 9846 | [1–424] | 9904 | [1–79] |
| 9847 | [1–455] | 9905 | [1–77] |
| 9848 | [1–339] | 9906 | [1–429] |
| 9849 | [1–449] | 9907 | [1–143] |
| 9850 | [1–117] | 9908 | [1–180] |
| 9851 | [1–173] | 9909 | [1–265] |
| 9852 | [1–415] | 9910 | [1–424] |
| 9853 | [1–387] | 9911 | [1–73] |
| 9854 | [1–396] | 9912 | [1–309] |
| 9855 | [1–92] | 9913 | [1–414] |
| 9856 | [1–280] | 9914 | [1–442] |
| 9857 | [1–440] | 9915 | [112–167] |
| 9858 | [1–429] | 9916 | [1–138] |
| 9859 | [1–488] | 9917 | [1–412] |
| 9860 | [1–438] | 9918 | [1–891] |
| 9862 | [1–472] | 9919 | [1–200] |
| 9863 | [1–345] | 9921 | [1–164] |
| 9864 | [1–110] | 9923 | [1–414] |
| 9865 | [1–157] | 9924 | [1–169] |
| 9866 | [1–461] | 9925 | [1–69] |
| 9867 | [32–237] | 9926 | [1–441] |
| 9868 | [1–144] | 9928 | [1–457] |
| 9870 | [1–356] | 9929 | [1–54] |
| 9872 | [1–424] | 9930 | [218–251] |
| 9873 | [1–175] | 9931 | [1–419] |
| 9934 | [1–207] | 9992 | [1–448] |
| 9935 | [1–413] | 9993 | [1–355] |
| 9936 | [1–440] | 9994 | [1–77] |
| 9939 | [1–328] | 9995 | [1–481] |
| 9940 | [1–400] | 9996 | [1–367] |
| 9941 | [1–161] | 9997 | [1–86] |
| 9947 | [1–64] | 9998 | [1–327] |
| 9948 | [1–219] | 9999 | [217–348] |
| 9949 | [1–190] | 10000 | [1–479] |
| 9950 | [1–188] | 10001 | [1–391] |
| 9951 | [1–140] | 10002 | [1–325] |
| 9952 | [1–188] | 10004 | [1–437] |
| 9953 | [1–176] | 10005 | [1–364] |
| 9954 | [1–176] | 10006 | [1–476] |
| 9955 | [1–479] | 10008 | [1–415] |
| 9956 | [1–400] | 10009 | [1–289] |
| 9957 | [1–380] | 10010 | [1–440] |
| 9958 | [1–112] | 10011 | [1–326] |
| 9959 | [1–423] | 10012 | [276–361] |
| 9960 | [1–128] | 10013 | [1–514] |
| 9961 | [1–364] | 10014 | [1–476] |
| 9963 | [1–185] | 10015 | [1–289] |
| 9964 | [1–469] | 10016 | [1–411] |
| 9966 | [1–72] | 10017 | [1–246] |
| 9967 | [1–104] | 10018 | [1–432] |
| 9968 | [1–176] | 10019 | [1–502] |
| 9970 | [1–434] | 10020 | [1–326] |
| 9971 | [1–439] | 10021 | [1–106] |
| 9972 | [1–114] | 10022 | [1–445] |
| 9973 | [1–349] | 10023 | [1–212] |
| 9974 | [1–505] | 10024 | [1–119] |
| 9975 | [1–86] | 10025 | [1–337] |
| 9976 | [1–487] | 10026 | [1–146] |
| 9977 | [1–338] | 10027 | [1–468] |
| 9978 | [1–188] | 10028 | [1–396] |
| 9979 | [1–438] | 10029 | [1–436] |
| 9980 | [1–201] | 10030 | [1–452] |
| 9981 | [1–283] | 10031 | [1–471] |
| 9982 | [1–55] | 10032 | [1–376],[422–527] |
| 9983 | [1–388] | 10033 | [1–463] |
| 9984 | [1–71] | 10034 | [1–461] |
| 9985 | [1–485] | 10035 | [1–439] |
| 9986 | [1–162] | 10036 | [1–86] |
| 9987 | [1–455] | 10037 | [1–478] |
| 9988 | [116–488] | 10038 | [1–36] |
| 9990 | [1–491] | 10039 | [1–393] |
| 9991 | [1–500] | 10040 | [1–435] |
| 10041 | [1–177],[307–433] | 10092 | [1–476] |
| 10042 | [1–43] | 10093 | [1–445] |
| 10044 | [1–461] | 10094 | [1–227] |
| 10045 | [1–135] | 10095 | [1–398] |
| 10046 | [1–72] | 10096 | [1–67] |
| 10047 | [1–78] | 10097 | [1–46],[129–502] |
| 10048 | [1–230] | 10098 | [1–445] |
| 10049 | [1–162] | 10099 | [1–339] |
| 10051 | [1–120] | 10100 | [1–456] |
| 10052 | [1–329] | 10101 | [1–208] |
| 10053 | [225–438] | 10102 | [1–126] |
| 10054 | [1–120] | 10103 | [1–146] |
| 10055 | [1–227] | 10105 | [1–466] |
| 10056 | [1–94] | 10106 | [171–441] |
| 10057 | [1–430] | 10107 | [1–324] |
| 10058 | [1–473] | 10108 | [1–41] |
| 10059 | [1–161] | 10109 | [1–379] |
| 10060 | [1–344] | 10110 | [1–292] |
| 10061 | [1–496] | 10111 | [1–417] |
| 10062 | [1–382] | 10112 | [1–81] |
| 10063 | [160–272] | 10113 | [1–467] |
| 10064 | [1–530] | 10115 | [1–432] |
| 10066 | [1–398] | 10116 | [1–289] |
| 10067 | [1–170] | 10117 | [1–173],[230–335],[365–423] |
| 10068 | [1–404] | 10118 | [1–89] |
| 10069 | [1–103] | 10120 | [1–341] |
| 10070 | [1–120] | 10121 | [1–201] |
| 10071 | [1–261] | 10122 | [1–436] |
| 10072 | [1–322] | 10123 | [1–405] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 10073 | [1–509] | 10124 | [1–343] | 10260 | [1–381] | 10315 | [1–348] |
| 10074 | [1–399] | 10125 | [1–473] | 10261 | [1–433] | 10317 | [1–440] |
| 10075 | [1–484] | 10126 | [1–451] | 10262 | [1–336] | 10318 | [1–433] |
| 10076 | [1–292] | 10127 | [1–342] | 10264 | [1–170] | 10319 | [1–283] |
| 10077 | [1–316] | 10128 | [1–228] | 10265 | [279–373] | 10320 | [1–505] |
| 10078 | [1–390] | 10129 | [1–414] | 10266 | [1–498] | 10321 | [1–157] |
| 10079 | [1–498] | 10130 | [1–107] | 10267 | [1–532] | 10322 | [1–436] |
| 10080 | [1–223] | 10131 | [1–89] | 10268 | [1–563] | 10323 | [1–445] |
| 10082 | [1–284] | 10133 | [1–78] | 10269 | [1–266] | 10324 | [1–450] |
| 10083 | [1–410] | 10134 | [1–125] | 10272 | [1–452] | 10325 | [1–231] |
| 10084 | [1–407] | 10135 | [1–49] | 10273 | [1–352] | 10327 | [1–362] |
| 10085 | [47–345] | 10136 | [1–107] | 10274 | [1–429] | 10328 | [1–304] |
| 10086 | [1–136] | 10137 | [1–257] | 10276 | [1–441] | 10329 | [37–308] |
| 10087 | [1–461] | 10138 | [1–429] | 10277 | [1–237] | 10330 | [218–278] |
| 10088 | [1–519] | 10139 | [1–337] | 10278 | [1–252] | 10331 | [1–259] |
| 10089 | [1–187] | 10140 | [1–476] | 10279 | [1–437] | 10332 | [1–656] |
| 10090 | [1–465] | 10141 | [1–308] | 10280 | [1–52] | 10333 | [1–445] |
| 10091 | [1–67] | 10142 | [1–61] | 10281 | [1–343] | 10334 | [1–258],[387–589] |
| 10144 | [1–51] | 10200 | [1–476] | 10282 | [1–402] | 10335 | [86–160] |
| 10145 | [1–72] | 10201 | [1–78] | 10283 | [1–377] | 10336 | [464–498] |
| 10146 | [1–368] | 10202 | [289–365] | 10284 | [1–386] | 10337 | [1–517] |
| 10148 | [1–145] | 10203 | [1–257] | 10285 | [1–440] | 10338 | [1–493] |
| 10149 | [1–444] | 10204 | [1–215] | 10286 | [1–247] | 10339 | [1–525] |
| 10150 | [1–434] | 10205 | [1–379] | 10287 | [1–422] | 10340 | [1–293] |
| 10151 | [1–142] | 10206 | [1–92] | 10288 | [1–135] | 10342 | [1–399] |
| 10152 | [1–443] | 10207 | [1–487] | 10289 | [1–430] | 10343 | [1–523] |
| 10153 | [1–496] | 10208 | [1–51] | 10290 | [1–427] | 10344 | [1–332] |
| 10154 | [1–119] | 10209 | [1–367] | 10292 | [1–75] | 10345 | [1–370] |
| 10155 | [1–330] | 10210 | [1–88] | 10294 | [1–469] | 10346 | [1–330] |
| 10156 | [1–50] | 10211 | [1–299] | 10295 | [1–30],[68–457],[1103–1211] | 10347 | [1–75] |
| 10157 | [1–347] | 10212 | [1–435] | | | | |
| 10158 | [1–343] | 10213 | [1–77] | 10296 | [1–481] | 10348 | [1–557] |
| 10159 | [1–252] | 10214 | [1–322] | 10297 | [1–259] | 10349 | [1–428] |
| 10161 | [1–67] | 10215 | [1–288] | 10299 | [1–344],[444–519] | 10350 | [1–445] |
| 10162 | [1–323] | 10216 | [1–391] | 10300 | [1–310] | 10351 | [1–127],[164–397] |
| 10163 | [1–345] | 10217 | [1–490] | 10301 | [1–323] | 10352 | [1–451] |
| 10166 | [1–375] | 10218 | [1–448] | 10303 | [1–359] | 10353 | [1–237] |
| 10167 | [1–476] | 10219 | [1–39],[82–455] | 10304 | [1–303] | 10354 | [1–485] |
| 10169 | [1–355] | 10220 | [1–279] | 10305 | [1–462] | 10355 | [1–458] |
| 10170 | [1–472] | 10221 | [1–477] | 10356 | [1–293] | 10407 | [30–86],[250–478] |
| 10171 | [1–467] | 10222 | [1–386] | 10357 | [1–44] | 10408 | [1–536] |
| 10172 | [1–327] | 10223 | [1–395] | 10358 | [1–73] | 10409 | [1–213] |
| 10173 | [1–326] | 10224 | [1–359] | 10359 | [1–431] | 10410 | [1–481] |
| 10175 | [389–488] | 10226 | [55–102] | 10360 | [1–447] | 10411 | [1–468] |
| 10177 | [1–433] | 10227 | [1–271] | 10361 | [1–360] | 10412 | [1–445] |
| 10178 | [1–246] | 10228 | [1–570] | 10362 | [1–460] | 10413 | [1–505] |
| 10179 | [72–108] | 10229 | [1–252] | 10363 | [1–401] | 10414 | [1–510] |
| 10180 | [1–492] | 10230 | [1–488] | 10364 | [1–188] | 10416 | [1–185],[226–358] |
| 10181 | [1–77] | 10231 | [1–328] | 10365 | [1–496] | 10417 | [46–547] |
| 10182 | [1–188] | 10233 | [1–429] | 10367 | [1–449] | 10418 | [1–407] |
| 10183 | [1–40] | 10234 | [1–361] | 10368 | [1–337] | 10419 | [1–73] |
| 10184 | [1–191] | 10235 | [1–306] | 10369 | [1–448] | 10420 | [1–77] |
| 10185 | [1–255] | 10236 | [1–407] | 10370 | [1–116] | 10422 | [1–535] |
| 10186 | [1–326] | 10237 | [1–250] | 10371 | [1–453] | 10423 | [1–357] |
| 10187 | [1–503] | 10238 | [1–252] | 10372 | [1–450] | 10424 | [1–72] |
| 10188 | [1–161] | 10239 | [1–432] | 10373 | [1–427] | 10425 | [267–441] |
| 10190 | [1–314] | 10240 | [1–207] | 10374 | [1–323] | 10427 | [1–99] |
| 10191 | [1–136] | 10241 | [1–315] | 10375 | [1–426] | 10428 | [1–517] |
| 10192 | [1–337] | 10242 | [1–312] | 10376 | [1–489] | 10429 | [1–80] |
| 10193 | [1–271] | 10243 | [1–378] | 10377 | [1–257] | 10430 | [1–448] |
| 10194 | [89–418] | 10244 | [1–341] | 10378 | [1–444] | 10431 | [1–317] |
| 10196 | [1–77] | 10245 | [62–247] | 10379 | [1–574] | 10432 | [1–587] |
| 10197 | [1–76] | 10246 | [1–331] | 10380 | [1–271] | 10433 | [1–435] |
| 10198 | [1–398] | 10247 | [1–318] | 10381 | [1–539] | 10435 | [1–333] |
| 10199 | [1–452] | 10248 | [1–248] | 10382 | [1–232] | 10436 | [1–469] |
| 10249 | [1–460] | 10306 | [1–249] | 10383 | [1–147] | 10437 | [1–306] |
| 10250 | [1–136] | 10307 | [1–344] | 10384 | [1–417] | 10438 | [63–500] |
| 10252 | [1–400] | 10308 | [1–468] | 10385 | [1–478] | 10439 | [108–140],[270–486] |
| 10254 | [1–147] | 10309 | [1–486] | 10386 | [288–376] | 10440 | [1–360] |
| 10255 | [1–55] | 10310 | [187–391] | 10387 | [1–450] | 10441 | [1–452] |
| 10256 | [1–397] | 10311 | [1–72] | 10388 | [1–418] | 10442 | [1–75] |
| 10257 | [1–425] | 10312 | [1–70] | 10389 | [1–593] | 10443 | [1–466] |
| 10258 | [1–319] | 10313 | [1–426] | 10390 | [1–113] | 10444 | [1–463] |
| 10259 | [1–423] | 10314 | [1–444] | 10391 | [1–354] | 10445 | [1–474] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 10392 | [1–395] | 10446 | [1–431] | 10585 | [1–511] | 10641 | [1–169] |
| 10393 | [1–586] | 10448 | [1–505] | 10586 | [1–116] | 10642 | [1–155] |
| 10394 | [1–483] | 10449 | [1–559] | 10587 | [1–312] | 10643 | [1–440] |
| 10397 | [1–535] | 10450 | [189–226] | 10588 | [1–591] | 10644 | [1–129] |
| 10398 | [1–606] | 10451 | [1–515] | 10589 | [1–128], [160–503] | 10645 | [1–541] |
| 10399 | [1–486] | 10452 | [1–533] | 10590 | [1–572] | 10646 | [1–557] |
| 10400 | [1–416] | 10454 | [1–474] | 10592 | [1–127] | 10647 | [1–557] |
| 10401 | [162–503] | 10455 | [1–209],[317–500] | 10593 | [1–370] | 10648 | [1–484] |
| 10402 | [1–481] | 10456 | [1–418] | 10594 | [1–607] | 10649 | [1–553] |
| 10403 | [1–485] | 10457 | [1–362] | 10595 | [1–447] | 10650 | [1–538] |
| 10404 | [1–293] | 10458 | [1–477] | 10597 | [1–445] | 10651 | [1–497] |
| 10405 | [1–423] | 10461 | [1–69] | 10598 | [1–50] | 10652 | [1–445] |
| 10462 | [1–573] | 10514 | [1–142] | 10599 | [1–359] | 10653 | [1–309] |
| 10463 | [1–537] | 10515 | [1–164] | 10601 | [1–443] | 10654 | [1–426] |
| 10464 | [1–378] | 10516 | [1–524] | 10602 | [177–414] | 10655 | [1–234], [412–527] |
| 10465 | [1–105] | 10517 | [1–400] | 10603 | [1–494] | 10656 | [1–149] |
| 10466 | [1–63] | 10518 | [1–387] | 10604 | [1–480] | 10657 | [1–525] |
| 10467 | [1–28],[68–145] | 10519 | [1–408] | 10605 | [1–407] | 10658 | [1–470] |
| 10468 | [1–179],[258–282] | 10520 | [1–433] | 10606 | [50–235] | 10659 | [1–520] |
| 10469 | [1–349] | 10521 | [1–369] | 10607 | [89–303] | 10660 | [1–403] |
| 10470 | [1–89] | 10522 | [1–441] | 10608 | [219–250] | 10661 | [1–428] |
| 10471 | [1–64] | 10523 | [1–74],[284–534] | 10609 | [1–87] | 10662 | [1–367] |
| 10472 | [1–558] | 10525 | [1–473] | 10612 | [423–447] | 10663 | [1–213], [360–468], [529–562] |
| 10473 | [1–474] | 10526 | [114–140] | | | | |
| 10474 | [1–547] | 10527 | [1–51],[271–514] | 10613 | [1–338] | 10664 | [1–583] |
| 10475 | [1–529] | 10528 | [1–209] | 10614 | [1–437] | 10665 | [1–265] |
| 10476 | [1–515] | 10529 | [1–55] | 10615 | [1–480] | 10666 | [1–480] |
| 10477 | [1–454] | 10530 | [266–401] | 10616 | [1–503] | 10668 | [1–260] |
| 10478 | [1–145] | 10531 | [1–74],[274–300] | 10617 | [86–556] | 10669 | [1–493] |
| 10480 | [1–503] | 10532 | [1–416] | 10618 | [1–563] | 10670 | [1–345] |
| 10481 | [1–450] | 10533 | [1–481] | 10619 | [1–454] | 10671 | [1–196] |
| 10483 | [1–369] | 10537 | [1–428] | 10621 | [378–470] | 10672 | [1–447] |
| 10484 | [1–343] | 10538 | [1–405] | 10622 | [1–438] | 10673 | [1–429] |
| 10486 | [56–369] | 10539 | [1–442] | 10674 | [1–531] | 10724 | [1–383] |
| 10487 | [1–439] | 10540 | [1–75] | 10675 | [1–233] | 10725 | [1–414] |
| 10489 | [1–494] | 10542 | [1–493] | 10676 | [1–410] | 10726 | [1–485] |
| 10490 | [1–343] | 10543 | [1–193] | 10677 | [1–205], [238–271], [373–497] | 10727 | [1–270] |
| 10491 | [1–625] | 10545 | [1–506] | | | | |
| 10492 | [1–555] | 10546 | [1–504] | 10678 | [1–402] | 10728 | [1–492] |
| 10493 | [1–600] | 10547 | [1–154] | 10679 | [1–351] | 10729 | [1–496] |
| 10494 | [1–312] | 10548 | [1–501] | 10680 | [1–298] | 10730 | [1–483] |
| 10495 | [1–469] | 10549 | [1–127] | 10681 | [1–413] | 10731 | [1–269] |
| 10497 | [1–406] | 10550 | [1–439] | 10682 | [1–410] | 10732 | [1–168] |
| 10498 | [1–390] | 10551 | [1–409] | 10683 | [1–487] | 10733 | [1–266] |
| 10499 | [169–340] | 10552 | [1–72] | 10684 | [1–546] | 10734 | [1–472] |
| 10500 | [1–142] | 10554 | [1–74],[126–409] | 10685 | [1–501] | 10735 | [1–88] |
| 10501 | [1–467] | 10555 | [1–306] | 10686 | [261–293] | 10736 | [1–264] |
| 10502 | [1–487] | 10556 | [1–491] | 10687 | [1–477] | 10737 | [1–206] |
| 10503 | [1–454] | 10557 | [1–437] | 10688 | [1–447] | 10738 | [1–454] |
| 10504 | [1–399] | 10558 | [1–337] | 10690 | [1–67] | 10739 | [1–485] |
| 10505 | [1–433] | 10559 | [1–233] | 10691 | [1–429] | 10741 | [1–415] |
| 10506 | [1–402] | 10560 | [1–319] | 10692 | [1–356] | 10742 | [1–514] |
| 10507 | [1–395] | 10561 | [1–142] | 10693 | [1–361] | 10744 | [1–481] |
| 10508 | [1–155] | 10563 | [1–249] | 10695 | [1–270] | 10745 | [1–468] |
| 10509 | [1–338] | 10564 | [1–349] | 10696 | [1–521] | 10747 | [1–296] |
| 10510 | [1–99] | 10565 | [1–443] | 10697 | [1–344] | 10748 | [1–277] |
| 10511 | [1–577] | 10566 | [1–419] | 10698 | [1–379] | 10749 | [1–475] |
| 10512 | [181–386] | 10567 | [1–328] | 10699 | [1–419] | 10750 | [1–150] |
| 10513 | [1–151] | 10568 | [1–106] | 10700 | [1–208], [293–470] | 10751 | [1–375] |
| 10569 | [1–575] | 10623 | [368–451] | 10701 | [1–288] | 10752 | [1–239] |
| 10570 | [1–523] | 10624 | [1–529] | 10702 | [1–299] | 10753 | [1–360] |
| 10571 | [216–559] | 10625 | [1–512] | 10703 | [1–470] | 10754 | [1–455] |
| 10572 | [1–354] | 10626 | [1–562] | 10705 | [1–540] | 10755 | [1–258] |
| 10573 | [106–296] | 10627 | [287–337] | 10706 | [1–420] | 10757 | [1–271] |
| 10574 | [1–271] | 10628 | [1–501] | 10707 | [1–233], [265–304] | 10759 | [1–455] |
| 10576 | [1–353] | 10630 | [1–281] | 10708 | [1–499] | 10761 | [1–364] |
| 10577 | [1–314] | 10631 | [1–400] | 10709 | [1–418] | 10762 | [1–81], [211–476] |
| 10578 | [1–119] | 10632 | [1–511] | 10710 | [1–194] | 10763 | [1–70], [135–284] |
| 10579 | [1–351] | 10633 | [1–374] | 10711 | [1–474] | 10764 | [1–71] |
| 10580 | [1–80] | 10634 | [1–487] | 10712 | [1–486] | 10765 | [1–481] |
| 10581 | [1–361] | 10635 | [1–514] | 10713 | [1–58] | 10766 | [1–162] |
| 10582 | [1–39] | 10636 | [1–551] | 10714 | [1–468] | 10767 | [1–506] |
| 10583 | [1–535] | 10638 | [1–451] | 10715 | [1–59] | 10768 | [1–421] |
| 10584 | [1–57] | 10639 | [1–552] | 10716 | [1–433] | 10769 | [1–329] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 10717 | [1–396] | 10770 | [1–354] | 10914 | [197–229] | 10967 | [1–165], [367–591] |
| 10718 | [1–443] | 10771 | [1–127] | 10915 | [1–251] | 10968 | [1–485] |
| 10719 | [1–65] | 10772 | [46–263] | 10916 | [1–59] | 10969 | [1–221] |
| 10720 | [1–421] | 10773 | [1–320] | 10917 | [60–254] | 10970 | [1–397] |
| 10721 | [1–500] | 10774 | [1–203] | 10918 | [1–469] | 10971 | [1–72] |
| 10722 | [1–55], [99–149] | 10776 | [1–375] | 10919 | [1–353] | 10973 | [1–366] |
| 10723 | [1–54] | 10777 | [1–105], [246–372] | 10921 | [1–247] | 10975 | [1–430] |
| 10778 | [1–379] | 10836 | [47–348] | 10922 | [1–80] | 10976 | [1–520] |
| 10779 | [1–268] | 10837 | [1–51] | 10924 | [1–226] | 10977 | [1–374] |
| 10780 | [1–412] | 10838 | [1–55] | 10925 | [1–155], [184–243] | 10978 | [1–149], [230–272], [361–478] |
| 10781 | [1–462] | 10839 | [1–348] | | | | |
| 10782 | [1–431] | 10840 | [1–233] | 10926 | [1–345] | 10980 | [1–55] |
| 10783 | [1–232] | 10841 | [1–446] | 10927 | [1–512] | 10982 | [1–459] |
| 10785 | [1–154] | 10842 | [1–101] | 10928 | [1–463] | 10983 | [1–209] |
| 10786 | [1–434] | 10843 | [1–282] | 10929 | [1–131] | 10984 | [1–250] |
| 10787 | [1–152] | 10845 | [1–471] | 10930 | [1–241] | 10985 | [1–424] |
| 10788 | [1–343] | 10846 | [1–134] | 10931 | [1–242] | 10986 | [1–41], [81–188], [234–438] |
| 10789 | [1–247] | 10847 | [1–166] | | | | |
| 10790 | [1–441] | 10848 | [1–326] | 10933 | [1–386] | 10987 | [1–443] |
| 10791 | [1–93], [188–223] | 10850 | [1–390] | 10934 | [1–464] | 10988 | [1–341] |
| 10792 | [1–441] | 10851 | [1–243] | 10935 | [1–412] | 10989 | [1–274] |
| 10793 | [1–304] | 10852 | [1–483] | 10936 | [1–531] | 10990 | [1–328] |
| 10794 | [1–172] | 10853 | [1–435] | 10937 | [1–304] | 10991 | [1–442] |
| 10795 | [1–254] | 10854 | [1–93] | 10938 | [1–331] | 10993 | [1–178] |
| 10797 | [1–80] | 10856 | [1–487] | 10939 | [1–458] | 10994 | [1–309] |
| 10798 | [191–417] | 10857 | [1–349] | 10940 | [1–136] | 10995 | [1–412] |
| 10799 | [1–268] | 10858 | [1–470] | 10941 | [1–185] | 10997 | [1–246] |
| 10800 | [1–447] | 10859 | [1–433] | 10942 | [1–220] | 10998 | [1–487] |
| 10801 | [86–142] | 10860 | [1–450] | 10943 | [1–366] | 10999 | [1–167] |
| 10802 | [1–245] | 10861 | [1–333] | 11000 | [1–233], [265–292] | 11052 | [1–436] |
| 10803 | [1–124] | 10862 | [1–76], [110–350] | 11001 | [1–73] | 11053 | [1–466] |
| 10804 | [1–361] | 10863 | [1–184] | 11002 | [1–293] | 11054 | [1–483] |
| 10805 | [1–170] | 10864 | [1–450] | 11004 | [64–544] | 11055 | [1–442] |
| 10806 | [1–247] | 10865 | [1–438] | 11005 | [1–223] | 11056 | [1–347] |
| 10807 | [1–343] | 10866 | [1–256] | 11006 | [1–552] | 11057 | [1–355], [406–442] |
| 10811 | [1–188] | 10868 | [1–372] | 11007 | [1–53] | 11058 | [1–432] |
| 10812 | [1–447] | 10869 | [1–358] | 11008 | [1–491] | 11059 | [1–306] |
| 10813 | [1–52] | 10870 | [1–389] | 11009 | [1–155] | 11060 | [1–478] |
| 10814 | [1–237] | 10871 | [1–53] | 11010 | [1–452] | 11062 | [1–295], [390–500] |
| 10815 | [1–232] | 10872 | [1–296] | 11011 | [1–469] | 11063 | [1–85] |
| 10816 | [1–263] | 10873 | [1–378] | 11012 | [1–498] | 11065 | [1–468] |
| 10818 | [1–463] | 10874 | [1–294] | 11014 | [1–460] | 11066 | [1–484] |
| 10819 | [54–436] | 10875 | [1–157] | 11015 | [71–251], [353–468] | 11067 | [1–30], [68–457] |
| 10821 | [1–355] | 10876 | [1–484] | 11016 | [94–419] | 11068 | [1–483] |
| 10822 | [1–88] | 10877 | [1–77] | 11017 | [1–403] | 11069 | [1–283] |
| 10823 | [1–398] | 10878 | [1–438] | 11018 | [1–365] | 11070 | [1–488] |
| 10824 | [1–504] | 10879 | [1–288] | 11019 | [1–458] | 11071 | [1–95], [129–253] |
| 10825 | [1–45], [269–364] | 10880 | [1–58] | 11021 | [1–499] | 11072 | [53–235] |
| 10826 | [1–58] | 10881 | [1–300] | 11022 | [1–80] | 11073 | [1–499] |
| 10827 | [1–440] | 10882 | [1–238] | 11023 | [1–452] | 11074 | [1–401] |
| 10828 | [1–331] | 10883 | [1–340] | 11024 | [1–418] | 11075 | [1–444] |
| 10829 | [1–80] | 10884 | [1–358] | 11025 | [1–497] | 11076 | [114–448] |
| 10832 | [1–69] | 10885 | [1–171] | 11026 | [1–470] | 11077 | [1–209] |
| 10835 | [1–418] | 10886 | [1–429] | 11027 | [1–482] | 11078 | [247–273] |
| 10887 | [1–476] | 10944 | [1–359] | 11028 | [1–498] | 11079 | [1–331] |
| 10888 | [1–301] | 10947 | [1–344] | 11029 | [1–479] | 11080 | [50–235] |
| 10889 | [1–407] | 10948 | [1–391] | 11030 | [52–236] | 11081 | [1–488] |
| 10890 | [1–234], [274–497] | 10950 | [1–369] | 11031 | [1–470] | 11082 | [1–258] |
| 10891 | [1–53] | 10951 | [1–364] | 11032 | [1–416] | 11083 | [1–468] |
| 10892 | [1–360] | 10952 | [1–364] | 11033 | [1–414] | 11084 | [1–339] |
| 10893 | [1–436] | 10953 | [1–239] | 11034 | [1–484] | 11085 | [1–488] |
| 10896 | [1–67] | 10954 | [1–481] | 11035 | [1–489] | 11086 | [1–478] |
| 10898 | [1–156] | 10955 | [1–209] | 11036 | [1–470] | 11087 | [86–135] |
| 10900 | [1–159] | 10956 | [1–67] | 11037 | [1–76] | 11088 | [1–438] |
| 10902 | [1–479] | 10957 | [1–235], [372–428] | 11038 | [1–52], [81–127], [159–469] | 11091 | [1–62] |
| 10903 | [1–476] | 10958 | [1–114], [311–453] | | | | |
| 10904 | [1–373] | 10959 | [1–346] | 11039 | [1–487] | 11092 | [1–336] |
| 10905 | [1–369] | 10960 | [1–506] | 11040 | [1–475] | 11093 | [1–454] |
| 10906 | [1–103] | 10961 | [1–146] | 11041 | [1–482] | 11094 | [72–125] |
| 10907 | [1–68] | 10962 | [1–150] | 11042 | [1–391] | 11095 | [1–67] |
| 10908 | [1–349] | 10963 | [1–597] | 11043 | [1–424] | 11096 | [1–489] |
| 10909 | [1–138] | 10964 | [1–507] | 11045 | [1–306] | 11097 | [1–387] |
| 10911 | [1–184] | 10965 | [1–438] | 11046 | [1–443] | 11098 | [1–132] |
| 10912 | [1–197] | 10966 | [1–356] | 11047 | [1–491] | 11100 | [1–485] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11048 | [1–252] | 11102 | [1–517] | 11244 | [1–103] | 11292 | [1–219] |
| 11049 | [1–414] | 11103 | [1–304] | 11245 | [1–186] | 11293 | [1–219] |
| 11051 | [1–89] | 11104 | [1–457] | 11246 | [1–161] | 11294 | [1–206] |
| 11105 | [1–476] | 11156 | [1–476] | 11247 | [1–374] | 11295 | [1–136] |
| 11106 | [72–108] | 11158 | [1–566] | 11248 | [1–265], [326–418] | 11296 | [1–219] |
| 11107 | [1–446] | 11159 | [1–293] | 11249 | [93–169] | 11297 | [1–219] |
| 11108 | [1–279], [318–397] | 11160 | [1–505] | 11250 | [1–467] | 11298 | [1–399] |
| 11109 | [1–379] | 11161 | [1–176] | 11251 | [1–288] | 11299 | [1–206] |
| 11110 | [1–488] | 11162 | [1–394] | 11252 | [1–250] | 11300 | [1–193] |
| 11111 | [1–414] | 11163 | [1–126] | 11253 | [1–219] | 11301 | [1–129] |
| 11113 | [1–432] | 11164 | [1–460] | 11254 | [1–74] | 11302 | [1–128] |
| 11114 | [1–471] | 11165 | [1–478] | 11255 | [1–219] | 11303 | [1–72] |
| 11115 | [1–452] | 11166 | [1–80] | 11257 | [1–72] | 11304 | [1–219] |
| 11117 | [1–376] | 11167 | [1–311] | 11258 | [1–447] | 11305 | [1–144] |
| 11118 | [1–434] | 11168 | [1–488] | 11259 | [1–219] | 11306 | [1–101] |
| 11119 | [1–457] | 11169 | [1–507] | 11260 | [1–219] | 11307 | [1–136] |
| 11120 | [1–421] | 11170 | [1–495] | 11261 | [1–219] | 11308 | [1–219] |
| 11122 | [1–168] | 11171 | [225–309] | 11262 | [1–282] | 11309 | [1–136] |
| 11123 | [1–469] | 11172 | [1–529] | 11263 | [1–219] | 11310 | [165–489] |
| 11124 | [1–338] | 11173 | [1–482] | 11264 | [1–219] | 11311 | [1–219] |
| 11125 | [1–446] | 11174 | [1–127] | 11265 | [1–73] | 11312 | [1–61] |
| 11126 | [1–398] | 11175 | [1–209] | 11266 | [1–224] | 11313 | [1–419] |
| 11127 | [1–478] | 11176 | [1–282] | 11267 | [1–399] | 11314 | [1–207] |
| 11128 | [1–409] | 11177 | [1–437] | 11315 | [1–207] | 11367 | [1–306] |
| 11129 | [1–397] | 11178 | [1–122] | 11316 | [1–111] | 11369 | [1–125], [332–498] |
| 11130 | [1–474] | 11179 | [1–522] | 11317 | [1–206] | 11370 | [1–439] |
| 11131 | [1–460] | 11180 | [1–137] | 11318 | [1–144] | 11371 | [1–341] |
| 11132 | [1–214] | 11181 | [1–386] | 11319 | [1–110] | 11372 | [151–278] |
| 11133 | [1–509] | 11182 | [1–473] | 11320 | [1–219] | 11373 | [1–157] |
| 11134 | [37–312] | 11183 | [1–278] | 11321 | [1–450] | 11374 | [1–644] |
| 11135 | [1–246] | 11184 | [1–478] | 11322 | [1–219] | 11375 | [1–610] |
| 11136 | [1–495] | 11185 | [1–518] | 11323 | [1–60] | 11376 | [1–489] |
| 11137 | [1–53] | 11187 | [1–502] | 11324 | [1–219] | 11377 | [1–482] |
| 11138 | [1–468] | 11188 | [1–408] | 11325 | [1–72] | 11378 | [216–295] |
| 11139 | [1–415] | 11189 | [1–488] | 11326 | [1–171] | 11381 | [1–361] |
| 11140 | [1–102] | 11190 | [1–60], [242–413] | 11327 | [1–225] | 11382 | [1–76] |
| 11141 | [86–121] | 11191 | [1–428] | 11328 | [1–221] | 11383 | [1–401] |
| 11142 | [1–437] | 11192 | [1–80] | 11329 | [1–219] | 11384 | [1–326] |
| 11143 | [1–439] | 11193 | [1–130] | 11330 | [1–237] | 11385 | [1–233] |
| 11144 | [1–540] | 11194 | [1–83] | 11331 | [1–153] | 11386 | [1–292] |
| 11146 | [1–481] | 11195 | [1–139] | 11332 | [1–219] | 11388 | [1–525] |
| 11147 | [1–273] | 11196 | [1–470] | 11333 | [1–219] | 11389 | [1–543] |
| 11148 | [1–240] | 11197 | [1–391] | 11334 | [1–207] | 11391 | [1–302] |
| 11149 | [1–362] | 11198 | [1–104] | 11335 | [1–121] | 11392 | [1–521] |
| 11150 | [1–491] | 11199 | [1–55] | 11336 | [1–187] | 11393 | [1–353] |
| 11151 | [1–438] | 11200 | [116–175], [451–499] | 11337 | [1–220] | 11394 | [50–94] |
| 11152 | [1–98] | 11202 | [1–492] | 11338 | [1–219] | 11395 | [1–212] |
| 11153 | [1–503] | 11203 | [1–494] | 11339 | [1–219] | 11396 | [1–285] |
| 11154 | [1–479] | 11204 | [40–68] | 11340 | [1–185] | 11398 | [1–147] |
| 11155 | [1–493] | 11205 | [1–515] | 11342 | [1–198] | 11399 | [1–375] |
| 11206 | [1–108] | 11268 | [1–168] | 11343 | [1–498] | 11400 | [1–234] |
| 11208 | [1–381] | 11269 | [1–219] | 11344 | [214–388] | 11401 | [1–77] |
| 11210 | [1–96] | 11270 | [1–219] | 11345 | [1–426] | 11402 | [1–394] |
| 11211 | [1–257] | 11271 | [1–228] | 11346 | [1–430] | 11403 | [1–406] |
| 11213 | [1–201] | 11272 | [1–219] | 11347 | [1–440] | 11404 | [1–350] |
| 11214 | [1–381] | 11273 | [1–219] | 11348 | [1–382] | 11406 | [1–193] |
| 11216 | [1–251] | 11274 | [1–219] | 11349 | [1–483] | 11407 | [1–294] |
| 11217 | [1–207] | 11275 | [1–189] | 11350 | [1–298], [329–378] | 11408 | [31–460] |
| 11219 | [1–34] | 11276 | [1–219] | 11351 | [1–34], [79–427] | 11409 | [1–401] |
| 11220 | [1–235] | 11277 | [1–219] | 11352 | [1–342] | 11410 | [1–428] |
| 11221 | [1–321] | 11278 | [1–118] | 11353 | [1–330] | 11411 | [1–203] |
| 11223 | [233–306] | 11279 | [1–469] | 11354 | [1–149], [188–409] | 11412 | [1–326] |
| 11224 | [1–169] | 11280 | [1–207] | 11355 | [1–471] | 11413 | [1–99] |
| 11228 | [1–134] | 11281 | [1–219] | 11356 | [1–307] | 11414 | [1–57] |
| 11229 | [79–425] | 11282 | [1–136] | 11357 | [1–107] | 11415 | [1–428] |
| 11231 | [74–248] | 11283 | [1–206] | 11358 | [1–330] | 11416 | [1–307] |
| 11234 | [1–201] | 11284 | [1–219] | 11362 | [418–523] | 11417 | [31–466] |
| 11236 | [1–405] | 11285 | [1–206] | 11363 | [1–415] | 11418 | [1–316] |
| 11238 | [1–362] | 11286 | [1–219] | 11365 | [1–281] | 11419 | [1–306] |
| 11239 | [1–39], [300–343] | 11287 | [1–111] | 11366 | [1–505] | 11420 | [1–136] |
| 11240 | [1–151] | 11288 | [1–219] | 11421 | [1–249] | 11478 | [1–149] |
| 11241 | [1–358] | 11289 | [1–219] | 11423 | [1–430] | 11479 | [1–418] |
| 11242 | [1–310] | 11290 | [1–74] | 11424 | [1–480] | 11480 | [1–415] |
| 11243 | [1–370] | 11291 | [1–136] | 11425 | [1–457] | 11482 | [1–442] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11426 | [1–309] | 11483 | [1–385] | 11568 | [1–305] | 11617 | [1–225] |
| 11427 | [1–309] | 11484 | [1–476] | 11569 | [1–200] | 11619 | [1–200] |
| 11428 | [1–198] | 11485 | [1–426] | 11570 | [1–200] | 11620 | [1–322] |
| 11429 | [1–198] | 11486 | [1–118] | 11571 | [1–111] | 11621 | [1–369] |
| 11430 | [1–230] | 11487 | [1–351] | 11572 | [1–93] | 11622 | [1–166] |
| 11431 | [1–180] | 11488 | [1–443] | 11573 | [1–172] | 11623 | [1–170] |
| 11432 | [1–393] | 11490 | [1–370] | 11574 | [1–159] | 11624 | [1–152] |
| 11433 | [1–378] | 11491 | [1–349] | 11575 | [1–173] | 11625 | [1–144] |
| 11434 | [1–291] | 11492 | [1–422] | 11576 | [1–408] | 11626 | [1–225] |
| 11436 | [1–102] | 11493 | [1–132] | 11577 | [1–311] | 11627 | [1–226] |
| 11437 | [1–436] | 11494 | [1–106] | 11578 | [1–125] | 11628 | [1–341] |
| 11438 | [1–261] | 11495 | [1–392] | 11579 | [1–314] | 11629 | [1–173] |
| 11439 | [1–504] | 11496 | [270–366] | 11580 | [1–162] | 11630 | [1–316] |
| 11440 | [1–506] | 11497 | [1–79] | 11581 | [1–327] | 11631 | [1–78] |
| 11441 | [243–452] | 11498 | [1–553] | 11582 | [1–309] | 11632 | [1–195] |
| 11442 | [119–187] | 11499 | [1–504] | 11583 | [1–53] | 11633 | [1–78] |
| 11444 | [1–396] | 11500 | [1–55], [228–577] | 11634 | [1–221] | 11684 | [1–194] |
| 11445 | [1–261] | 11501 | [1–161] | 11635 | [1–242] | 11686 | [1–129] |
| 11446 | [1–137] | 11502 | [1–515] | 11636 | [1–134] | 11687 | [1–174] |
| 11447 | [256–367] | 11503 | [120–154] | 11638 | [1–173] | 11688 | [1–158] |
| 11448 | [11–346] | 11504 | [1–176] | 11639 | [1–127] | 11689 | [1–82] |
| 11449 | [1–486] | 11505 | [183–238] | 11640 | [1–216] | 11690 | [1–378] |
| 11451 | [1–352] | 11507 | [1–177] | 11641 | [1–303] | 11691 | [1–317] |
| 11452 | [1–241] | 11508 | [1–178] | 11642 | [1–336] | 11692 | [1–118] |
| 11453 | [1–400] | 11510 | [1–191] | 11643 | [1–112] | 11693 | [1–347] |
| 11454 | [1–495] | 11511 | [1–318] | 11644 | [1–170] | 11694 | [1–278] |
| 11456 | [1–286] | 11512 | [1–345] | 11645 | [1–109] | 11695 | [1–361] |
| 11457 | [1–374] | 11513 | [1–317] | 11646 | [1–122] | 11697 | [1–187] |
| 11458 | [1–366] | 11515 | [149–232] | 11647 | [1–294] | 11698 | [1–140] |
| 11459 | [1–365] | 11516 | [1–316] | 11648 | [1–189] | 11699 | [1–130] |
| 11460 | [1–388] | 11517 | [1–314] | 11649 | [1–301] | 11701 | [1–212] |
| 11463 | [1–384] | 11518 | [1–92] | 11650 | [1–152] | 11702 | [1–155] |
| 11464 | [1–339] | 11519 | [1–224] | 11651 | [1–55] | 11703 | [1–285] |
| 11465 | [1–349] | 11520 | [1–221] | 11652 | [1–109] | 11704 | [1–365] |
| 11468 | [1–398] | 11521 | [1–388] | 11653 | [1–201] | 11705 | [1–137] |
| 11469 | [1–453] | 11522 | [1–140] | 11654 | [1–110] | 11707 | [1–397] |
| 11470 | [1–169] | 11523 | [1–172] | 11655 | [1–333] | 11708 | [1–128] |
| 11471 | [1–446] | 11525 | [1–147] | 11656 | [1–127] | 11709 | [1–114] |
| 11472 | [1–396] | 11526 | [1–298] | 11657 | [1–62] | 11710 | [1–84] |
| 11473 | [1–311] | 11528 | [1–300] | 11658 | [1–63] | 11711 | [1–237] |
| 11474 | [1–441] | 11529 | [1–303] | 11659 | [1–361] | 11712 | [1–490] |
| 11475 | [1–367] | 11530 | [1–317] | 11660 | [1–149] | 11713 | [1–173] |
| 11476 | [1–348] | 11531 | [1–457] | 11661 | [1–162] | 11714 | [1–191] |
| 11532 | [1–402] | 11585 | [1–281] | 11662 | [1–225] | 11715 | [1–123] |
| 11533 | [1–387] | 11586 | [1–160] | 11663 | [1–99] | 11716 | [1–200] |
| 11534 | [1–175] | 11587 | [1–315] | 11665 | [1–347] | 11717 | [1–439] |
| 11535 | [1–312] | 11588 | [1–431] | 11666 | [1–173] | 11718 | [1–199] |
| 11537 | [1–37], [256–371] | 11589 | [1–320] | 11667 | [1–200] | 11719 | [1–163] |
| 11538 | [1–306] | 11590 | [1–200] | 11668 | [1–163] | 11720 | [1–195] |
| 11539 | [1–313] | 11591 | [1–200] | 11669 | [1–132] | 11721 | [1–231] |
| 11540 | [1–77] | 11592 | [1–171] | 11670 | [1–329] | 11722 | [1–172] |
| 11541 | [1–463] | 11593 | [1–162] | 11671 | [1–174] | 11723 | [1–339] |
| 11542 | [1–316] | 11594 | [1–118] | 11672 | [1–305] | 11724 | [1–171] |
| 11543 | [1–297] | 11595 | [217–245] | 11673 | [1–337] | 11725 | [1–343] |
| 11544 | [1–383] | 11596 | [1–86] | 11675 | [1–261] | 11726 | [1–394] |
| 11545 | [1–456] | 11597 | [1–347] | 11676 | [1–107] | 11727 | [1–358] |
| 11547 | [1–209] | 11598 | [1–200] | 11677 | [1–114] | 11728 | [1–200] |
| 11548 | [1–163] | 11599 | [1–299] | 11678 | [1–144] | 11729 | [1–278] |
| 11549 | [1–268] | 11600 | [1–347] | 11679 | [1–189] | 11730 | [1–303] |
| 11550 | [1–409] | 11601 | [1–114] | 11680 | [1–174] | 11731 | [1–126] |
| 11551 | [1–493] | 11602 | [1–168] | 11681 | [1–200] | 11732 | [1–142] |
| 11552 | [1–369] | 11603 | [1–200] | 11682 | [1–104] | 11733 | [1–181] |
| 11553 | [1–220] | 11604 | [1–371] | 11683 | [1–179] | 11734 | [1–311] |
| 11554 | [1–495] | 11605 | [1–280] | 11735 | [1–225] | 11784 | [1–222] |
| 11556 | [1–120] | 11606 | [1–157], [224–250] | 11736 | [1–213] | 11785 | [1–200] |
| 11557 | [295–320] | 11607 | [1–165] | 11737 | [1–179], [323–374] | 11786 | [1–162] |
| 11558 | [1–530] | 11608 | [1–353] | 11738 | [1–126] | 11787 | [1–254] |
| 11559 | [1–460] | 11609 | [1–385] | 11739 | [1–162] | 11788 | [1–172] |
| 11562 | [1–147] | 11610 | [1–383] | 11740 | [1–80] | 11789 | [1–186] |
| 11563 | [1–324] | 11611 | [1–174] | 11741 | [1–109] | 11790 | [1–479] |
| 11564 | [1–280] | 11612 | [1–295] | 11742 | [1–364] | 11791 | [1–316] |
| 11565 | [1–387] | 11613 | [1–68] | 11743 | [1–110] | 11792 | [1–133] |
| 11566 | [1–148] | 11614 | [1–160] | 11744 | [1–98] | 11793 | [1–358] |
| 11567 | [1–318] | 11615 | [1–281] | 11745 | [1–171] | 11794 | [1–226] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11746 | [1–305] | 11795 | [1–192] | 11869 | [1–170] | 11923 | [1–155] |
| 11747 | [1–565] | 11796 | [1–186] | 11870 | [1–158] | 11924 | [1–172] |
| 11748 | [1–187] | 11797 | [1–90] | 11871 | [1–336] | 11925 | [1–172] |
| 11749 | [1–253] | 11798 | [1–298] | 11872 | [1–57] | 11926 | [1–171] |
| 11750 | [1–311] | 11799 | [1–106] | 11873 | [1–366] | 11927 | [146–509] |
| 11751 | [1–293] | 11800 | [1–118] | 11876 | [1–59] | 11928 | [1–100] |
| 11752 | [1–302] | 11801 | [1–224] | 11877 | [1–279] | 11929 | [1–307] |
| 11754 | [1–200] | 11802 | [1–197] | 11878 | [1–174] | 11930 | [1–298] |
| 11755 | [1–302] | 11803 | [1–213] | 11879 | [1–318] | 11931 | [1–201] |
| 11756 | [1–129] | 11804 | [1–226] | 11932 | [1–316] | 11979 | [1–201] |
| 11757 | [1–462] | 11805 | [1–340] | 11933 | [1–225] | 11980 | [1–132] |
| 11758 | [1–130] | 11806 | [1–345] | 11934 | [1–125] | 11981 | [124–350] |
| 11759 | [1–136] | 11807 | [1–243] | 11935 | [1–314] | 11982 | [1–311] |
| 11760 | [1–271] | 11808 | [1–171] | 11936 | [1–225] | 11983 | [1–371] |
| 11761 | [1–136] | 11809 | [1–207] | 11937 | [1–226] | 11984 | [1–331] |
| 11762 | [1–200] | 11810 | [1–126] | 11938 | [1–201] | 11985 | [1–200] |
| 11763 | [1–309] | 11811 | [1–235] | 11939 | [1–303] | 11986 | [1–173] |
| 11764 | [1–152] | 11812 | [1–121] | 11940 | [1–198] | 11987 | [1–110] |
| 11765 | [1–196] | 11813 | [1–172] | 11941 | [1–343] | 11988 | [1–112] |
| 11766 | [1–118] | 11814 | [1–331] | 11942 | [1–143] | 11989 | [1–92], [273–311] |
| 11767 | [1–111] | 11815 | [1–117] | 11943 | [1–292] | 11990 | [1–108] |
| 11768 | [1–448] | 11816 | [1–213] | 11944 | [1–82] | 11991 | [1–79] |
| 11769 | [1–283] | 11817 | [1–79] | 11945 | [1–173] | 11992 | [1–358] |
| 11770 | [1–340] | 11818 | [1–187] | 11946 | [1–200] | 11993 | [1–118] |
| 11771 | [1–173] | 11819 | [1–53] | 11947 | [1–343] | 11994 | [1–265] |
| 11772 | [1–200] | 11820 | [1–241] | 11948 | [1–113] | 11996 | [1–163] |
| 11773 | [1–200] | 11821 | [1–122] | 11949 | [1–82] | 11997 | [1–121] |
| 11774 | [1–257] | 11822 | [1–139] | 11950 | [1–137] | 11998 | [1–330] |
| 11775 | [1–174] | 11823 | [1–173] | 11951 | [1–301] | 11999 | [1–291] |
| 11776 | [1–296] | 11824 | [1–201] | 11952 | [1–136] | 12000 | [1–226] |
| 11777 | [1–170] | 11825 | [1–200] | 11953 | [1–108] | 12001 | [1–99] |
| 11778 | [1–200] | 11826 | [1–490] | 11954 | [1–165] | 12002 | [1–200] |
| 11779 | [1–207] | 11827 | [1–305] | 11955 | [1–119] | 12003 | [1–250] |
| 11781 | [1–110] | 11828 | [1–371] | 11956 | [1–479] | 12004 | [1–314] |
| 11782 | [1–226] | 11829 | [1–336] | 11957 | [1–152] | 12005 | [1–68] |
| 11783 | [1–126] | 11830 | [1–225] | 11958 | [1–78] | 12006 | [1–69] |
| 11831 | [1–306] | 11880 | [1–360] | 11959 | [1–273] | 12007 | [1–103] |
| 11832 | [1–142] | 11881 | [1–306] | 11960 | [1–200] | 12008 | [1–303] |
| 11833 | [1–492] | 11882 | [1–188] | 11961 | [1–235] | 12009 | [1–321] |
| 11834 | [1–225] | 11883 | [1–121] | 11962 | [1–118] | 12010 | [1–173] |
| 11835 | [1–200] | 11884 | [1–547] | 11963 | [1–173] | 12011 | [1–170] |
| 11836 | [1–377] | 11885 | [1–117] | 11964 | [1–108] | 12012 | [1–200] |
| 11837 | [1–303] | 11886 | [1–209] | 11965 | [1–200] | 12013 | [1–181] |
| 11838 | [1–156] | 11887 | [1–69] | 11966 | [1–174] | 12014 | [1–200] |
| 11839 | [1–181] | 11888 | [1–82] | 11967 | [1–61] | 12015 | [1–82] |
| 11840 | [1–213] | 11889 | [1–290] | 11968 | [1–312] | 12016 | [1–433] |
| 11841 | [1–82] | 11890 | [1–281] | 11969 | [1–314] | 12017 | [1–306] |
| 11842 | [1–120] | 11891 | [1–111] | 11970 | [1–57] | 12018 | [1–326] |
| 11843 | [1–507] | 11895 | [1–483] | 11971 | [1–312] | 12019 | [1–180] |
| 11844 | [1–200] | 11896 | [1–314] | 11972 | [1–110] | 12020 | [1–516] |
| 11845 | [1–158] | 11897 | [1–163] | 11973 | [1–316] | 12021 | [1–293] |
| 11846 | [1–200] | 11898 | [1–143] | 11974 | [1–78] | 12022 | [1–161] |
| 11847 | [1–190] | 11899 | [1–471] | 11975 | [1–89] | 12023 | [1–200] |
| 11848 | [1–166] | 11900 | [1–118] | 11976 | [1–314] | 12024 | [1–316] |
| 11849 | [1–364] | 11901 | [1–314] | 11977 | [1–437] | 12025 | [1–110] |
| 11850 | [1–213] | 11902 | [1–200] | 11978 | [1–106] | 12026 | [1–326] |
| 11851 | [1–246] | 11904 | [1–207] | 12027 | [1–142] | 12078 | [1–225] |
| 11852 | [1–314] | 11905 | [1–200] | 12028 | [1–126] | 12079 | [1–106] |
| 11853 | [1–200] | 11906 | [1–322] | 12029 | [1–219] | 12080 | [1–111] |
| 11854 | [1–373] | 11907 | [1–317] | 12030 | [1–294] | 12081 | [1–317] |
| 11855 | [1–345] | 11908 | [1–296] | 12031 | [1–355] | 12082 | [1–490] |
| 11856 | [1–187] | 11909 | [1–67] | 12032 | [1–335] | 12083 | [1–115] |
| 11857 | [1–148] | 11910 | [1–174] | 12033 | [1–315] | 12084 | [1–327] |
| 11858 | [1–200] | 11911 | [1–253] | 12035 | [1–187] | 12085 | [1–221] |
| 11859 | [1–128] | 11912 | [1–68] | 12036 | [1–189] | 12087 | [1–83] |
| 11860 | [1–174] | 11914 | [1–306] | 12037 | [1–77] | 12088 | [1–82] |
| 11861 | [1–99] | 11915 | [1–173] | 12038 | [1–144] | 12089 | [1–372] |
| 11862 | [1–344] | 11916 | [1–419] | 12040 | [1–220] | 12090 | [1–243] |
| 11863 | [1–164] | 11917 | [1–298] | 12041 | [1–294] | 12091 | [202–488] |
| 11864 | [1–82] | 11918 | [1–353] | 12042 | [1–125] | 12092 | [1–124] |
| 11865 | [1–200] | 11919 | [1–200] | 12043 | [1–129] | 12093 | [1–195] |
| 11866 | [1–141] | 11920 | [1–162] | 12044 | [1–200] | 12094 | [1–143] |
| 11867 | [1–304] | 11921 | [1–123] | 12045 | [1–120] | 12095 | [1–200] |
| 11868 | [1–96] | 11922 | [1–209] | 12046 | [1–344] | 12096 | [1–368] |

TABLE IVa-continued (Novelty:95%)

| Seq Id No. | Positions of preferred fragments | Seq Id No. | Positions of preferred fragments |
|---|---|---|---|
| 12047 | [1–173] | 12097 | [1–325] |
| 12048 | [1–78] | 12098 | [1–170] |
| 12049 | [1–154] | 12099 | [1–84] |
| 12051 | [1–163] | 12101 | [1–379] |
| 12052 | [1–166] | 12102 | [1–66] |
| 12053 | [1–145] | 12103 | [1–82] |
| 12054 | [1–263] | 12104 | [1–200] |
| 12055 | [1–313] | 12105 | [1–331] |
| 12056 | [1–221] | 12106 | [1–74] |
| 12057 | [1–194] | 12107 | [1–173] |
| 12058 | [1–175] | 12108 | [1–53] |
| 12059 | [1–333] | 12109 | [1–201] |
| 12060 | [1–199] | 12110 | [1–251] |
| 12062 | [1–419] | 12111 | [1–115] |
| 12063 | [1–447] | 12112 | [1–478] |
| 12064 | [1–306] | 12113 | [1–304] |
| 12065 | [1–200] | 12114 | [1–244] |
| 12066 | [1–117] | 12115 | [1–301] |
| 12067 | [1–383] | 12116 | [1–112] |
| 12068 | [1–173] | 12117 | [1–200] |
| 12069 | [1–114] | 12118 | [1–109] |
| 12070 | [1–161] | 12119 | [1–108] |
| 12071 | [1–452] | 12121 | [1–159] |
| 12072 | [1–301] | 12122 | [1–324] |
| 12073 | [1–174] | 12124 | [1–324] |
| 12074 | [1–164] | 12125 | [1–153] |
| 12075 | [1–163] | 12126 | [1–337] |
| 12076 | [1–170] | 12127 | [1–82] |
| 12077 | [1–240] | 12128 | [1–200] |
| 12129 | [1–164] | 12178 | [1–323] |
| 12130 | [1–77] | 12179 | [1–163] |
| 12131 | [1–82] | 12180 | [1–58] |
| 12132 | [1–200] | 12181 | [1–159] |
| 12133 | [1–113] | 12182 | [1–160] |
| 12135 | [1–52] | 12183 | [1–317] |
| 12136 | [1–200] | 12184 | [1–336] |
| 12137 | [1–82] | 12185 | [1–111] |
| 12138 | [1–321] | 12186 | [1–304] |
| 12139 | [1–56] | 12187 | [1–157] |
| 12140 | [1–104] | 12188 | [1–304] |
| 12141 | [1–200] | 12189 | [1–161] |
| 12142 | [1–420] | 12190 | [1–301] |
| 12143 | [1–136] | 12191 | [1–383] |
| 12144 | [1–108] | 12192 | [1–372] |
| 12145 | [1–458] | 12193 | [34–211] |
| 12146 | [1–459] | 12194 | [1–114] |
| 12147 | [1–373] | 12195 | [1–83] |
| 12148 | [1–171] | 12196 | [1–129] |
| 12149 | [1–289] | 12198 | [1–81] |
| 12150 | [1–57] | 12199 | [1–173] |
| 12151 | [1–173] | 12200 | [1–363] |
| 12152 | [1–207] | 12201 | [1–200] |
| 12153 | [1–284] | 12202 | [1–294] |
| 12154 | [1–225] | 12203 | [1–360] |
| 12155 | [1–162] | 12204 | [1–118] |
| 12156 | [1–200] | 12205 | [1–172] |
| 12157 | [1–156] | 12206 | [1–236] |
| 12158 | [1–200] | 12207 | [1–311] |
| 12159 | [1–307] | 12208 | [1–68] |
| 12160 | [1–98] | 12209 | [1–439] |
| 12161 | [1–91] | 12210 | [1–163] |
| 12162 | [1–120] | 12211 | [1–209] |
| 12163 | [1–257] | 12212 | [1–155] |
| 12165 | [1–50] | 12213 | [1–243] |
| 12166 | [1–477] | 12214 | [1–128] |
| 12167 | [1–118] | 12215 | [1–508] |
| 12168 | [1–383] | 12216 | [1–94] |
| 12169 | [1–312] | 12217 | [1–163] |
| 12170 | [1–371] | 12218 | [1–440] |
| 12171 | [1–172] | 12219 | [1–192] |
| 12172 | [1–175] | 12220 | [1–225] |
| 12173 | [1–125] | 12221 | [1–162] |
| 12174 | [1–127] | 12222 | [1–443] |
| 12175 | [1–83] | 12223 | [1–226] |
| 12176 | [1–371] | 12224 | [1–200] |
| 12177 | [1–520] | 12225 | [1–78] |
| 12226 | [1–127] | 12275 | [1–367] |
| 12227 | [1–361] | 12276 | [1–78] |
| 12228 | [1–134] | 12279 | [1–202] |
| 12229 | [1–176] | 12280 | [1–341] |
| 12231 | [1–63] | 12281 | [1–174] |
| 12232 | [1–457] | 12282 | [1–225] |
| 12233 | [1–172] | 12283 | [1–372] |
| 12234 | [1–343] | 12284 | [1–370] |
| 12235 | [1–174] | 12285 | [1–165] |
| 12236 | [1–313] | 12286 | [1–200] |
| 12237 | [1–383] | 12287 | [107–134], [250–488] |
| 12238 | [1–380] | 12288 | [1–310] |
| 12239 | [1–485] | 12289 | [1–209] |
| 12240 | [1–176] | 12290 | [1–351] |
| 12241 | [1–372] | 12291 | [1–124] |
| 12242 | [1–171] | 12292 | [1–215] |
| 12243 | [1–163] | 12293 | [1–485] |
| 12244 | [1–485] | 12294 | [1–174] |
| 12245 | [1–155] | 12295 | [1–300] |
| 12246 | [1–211] | 12296 | [1–339] |
| 12247 | [1–353] | 12297 | [1–243] |
| 12248 | [1–314] | 12298 | [1–67] |
| 12249 | [1–225] | 12299 | [1–78] |
| 12250 | [1–173] | 12300 | [1–170] |
| 12251 | [1–104] | 12301 | [1–200] |
| 12252 | [1–247] | 12302 | [1–174] |
| 12253 | [1–173] | 12303 | [1–309] |
| 12254 | [1–162] | 12304 | [1–74] |
| 12255 | [1–327] | 12305 | [1–246] |
| 12256 | [1–190] | 12306 | [248–304] |
| 12257 | [1–200] | 12308 | [1–162] |
| 12258 | [1–200] | 12309 | [1–92] |
| 12259 | [1–225] | 12310 | [1–296] |
| 12260 | [1–170] | 12311 | [1–149] |
| 12261 | [1–93] | 12312 | [1–401] |
| 12262 | [1–116] | 12313 | [1–235] |
| 12263 | [1–112] | 12314 | [1–40], [283–444] |
| 12264 | [1–159] | 12315 | [1–135] |
| 12266 | [1–77] | 12316 | [1–372] |
| 12267 | [1–438] | 12317 | [1–400] |
| 12268 | [1–365] | 12318 | [1–475] |
| 12269 | [1–302] | 12319 | [1–337] |
| 12270 | [1–175] | 12320 | [1–225] |
| 12271 | [1–124] | 12322 | [1–82] |
| 12272 | [1–175] | 12323 | [1–200] |
| 12273 | [1–99] | 12324 | [1–310] |
| 12274 | [1–187] | 12325 | [1–117] |
| 12326 | [1–289] | 12373 | [1–313] |
| 12327 | [1–128] | 12374 | [1–130] |
| 12328 | [1–141] | 12375 | [1–449] |
| 12329 | [1–314] | 12376 | [1–375] |
| 12330 | [1–123] | 12377 | [1–55] |
| 12331 | [1–174] | 12378 | [1–134] |
| 12332 | [1–53] | 12379 | [1–137] |
| 12333 | [1–302] | 12380 | [1–305] |
| 12334 | [1–163] | 12381 | [1–200] |
| 12335 | [1–162] | 12382 | [1–162] |
| 12336 | [1–173] | 12383 | [1–175] |
| 12337 | [1–142] | 12384 | [1–243] |
| 12338 | [1–155] | 12385 | [1–343] |
| 12339 | [1–366] | 12386 | [1–433] |
| 12340 | [1–314] | 12387 | [1–354] |
| 12341 | [1–80] | 12388 | [1–162] |
| 12342 | [1–360] | 12389 | [1–111] |
| 12343 | [1–225] | 12390 | [1–72] |
| 12344 | [1–187] | 12391 | [1–170] |
| 12345 | [1–173] | 12392 | [1–101] |
| 12346 | [1–147] | 12393 | [1–302] |
| 12347 | [1–354] | 12394 | [1–253] |
| 12348 | [1–108] | 12395 | [1–123] |
| 12349 | [1–225] | 12396 | [1–200] |
| 12350 | [1–224] | 12397 | [1–111] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 12351 | [1–307] | 12398 | [1–78] | 12530 | [1–53] | 12585 | [1–423] |
| 12352 | [1–144] | 12399 | [1–369] | 12531 | [1–302] | 12586 | [1–328] |
| 12353 | [1–200] | 12400 | [1–153] | 12532 | [1–465] | 12587 | [1–393] |
| 12354 | [1–132] | 12401 | [1–148] | 12533 | [1–445] | 12588 | [1–95] |
| 12355 | [1–318] | 12402 | [1–174] | 12534 | [1–106] | 12589 | [1–76] |
| 12356 | [1–169], [254–373] | 12403 | [1–108] | 12535 | [1–440] | 12590 | [1–440] |
| 12357 | [1–200] | 12404 | [1–66] | 12536 | [1–193] | 12591 | [1–222] |
| 12358 | [1–173] | 12405 | [1–311] | 12537 | [1–347] | 12592 | [1–156] |
| 12359 | [1–173] | 12406 | [1–156] | 12538 | [1–421] | 12593 | [1–473] |
| 12360 | [1–200] | 12407 | [1–158] | 12539 | [1–27] | 12594 | [1–412] |
| 12361 | [1–296] | 12408 | [1–293] | 12540 | [1–477] | 12595 | [1–33], [72–398] |
| 12362 | [1–213] | 12409 | [1–197] | 12541 | [1–473] | 12596 | [46–102] |
| 12363 | [1–96] | 12410 | [1–200] | 12542 | [1–133], [165–266] | 12597 | [1–370] |
| 12364 | [1–143] | 12411 | [1–200] | 12543 | [1–315] | 12598 | [1–461] |
| 12365 | [1–444] | 12412 | [1–486] | 12544 | [1–476] | 12599 | [1–54] |
| 12366 | [1–371] | 12413 | [1–277] | 12546 | [1–488] | 12600 | [1–169] |
| 12367 | [1–89] | 12414 | [1–163] | 12548 | [72–104] | 12601 | [1–243] |
| 12368 | [1–82] | 12415 | [1–173] | 12549 | [1–194] | 12602 | [1–397] |
| 12369 | [1–108] | 12416 | [1–162] | 12550 | [1–414] | 12603 | [1–478] |
| 12370 | [1–173] | 12417 | [1–109] | 12551 | [1–163] | 12604 | [1–321], [353–436] |
| 12371 | [1–105] | 12418 | [1–312] | 12552 | [1–450] | 12605 | [1–377] |
| 12372 | [1–202] | 12419 | [1–173] | 12554 | [1–307] | 12606 | [1–458] |
| 12420 | [1–355] | 12470 | [1–485] | 12555 | [1–468] | 12608 | [1–64] |
| 12421 | [1–163] | 12471 | [1–94] | 12556 | [1–425] | 12610 | [1–138], [181–521] |
| 12422 | [1–140] | 12472 | [1–485] | 12557 | [1–395] | 12612 | [1–200] |
| 12423 | [1–327] | 12473 | [1–450] | 12558 | [266–493] | 12613 | [1–409] |
| 12424 | [1–173] | 12474 | [1–217] | 12559 | [1–471] | 12614 | [1–376] |
| 12425 | [1–306] | 12476 | [1–478] | 12561 | [1–479] | 12615 | [1–397] |
| 12426 | [1–225] | 12477 | [1–473] | 12562 | [1–428] | 12616 | [1–506] |
| 12427 | [1–129] | 12478 | [1–460] | 12564 | [1–458] | 12617 | [1–458] |
| 12428 | [1–314] | 12479 | [1–437] | 12565 | [1–335] | 12618 | [1–427], [496–544] |
| 12429 | [1–83] | 12480 | [1–60] | 12566 | [1–77] | 12619 | [1–463] |
| 12430 | [1–97] | 12481 | [1–459] | 12567 | [1–422] | 12620 | [1–325] |
| 12431 | [1–158] | 12482 | [1–438] | 12568 | [1–373] | 12621 | [1–70] |
| 12432 | [1–125] | 12483 | [1–486] | 12569 | [1–392] | 12622 | [1–97] |
| 12433 | [1–367] | 12485 | [1–483] | 12571 | [121–314] | 12623 | [1–274] |
| 12434 | [1–82] | 12486 | [1–385] | 12572 | [1–477] | 12624 | [1–466] |
| 12435 | [1–346] | 12487 | [1–196] | 12573 | [1–134] | 12625 | [142–438] |
| 12436 | [1–70] | 12489 | [1–380] | 12574 | [1–428] | 12626 | [1–147] |
| 12437 | [1–507] | 12490 | [1–86] | 12575 | [1–70] | 12627 | [1–272] |
| 12438 | [1–158] | 12491 | [1–393] | 12577 | [1–318] | 12628 | [1–412] |
| 12439 | [1–294] | 12492 | [1–469] | 12578 | [1–59] | 12629 | [1–409] |
| 12440 | [1–70] | 12493 | [1–436] | 12630 | [1–456] | 12688 | [1–468] |
| 12441 | [1–94] | 12494 | [1–153], [252–458] | 12631 | [1–297] | 12689 | [1–281] |
| 12442 | [1–374] | 12495 | [1–230] | 12632 | [1–263] | 12690 | [1–453] |
| 12443 | [1–280] | 12496 | [1–494] | 12633 | [1–421] | 12691 | [1–460] |
| 12444 | [1–143] | 12497 | [1–468] | 12634 | [1–146] | 12692 | [1–61] |
| 12445 | [1–187] | 12498 | [1–454] | 12635 | [1–553] | 12693 | [1–193] |
| 12446 | [1–76] | 12499 | [1–146] | 12636 | [1–279], [310–426] | 12694 | [1–447] |
| 12447 | [1–331] | 12500 | [1–127] | 12638 | [1–449] | 12695 | [1–315] |
| 12448 | [1–107] | 12501 | [1–129] | 12642 | [1–291] | 12696 | [1–108] |
| 12449 | [1–173] | 12502 | [1–510] | 12643 | [1–488] | 12697 | [1–398] |
| 12450 | [1–83] | 12503 | [1–276] | 12644 | [1–344] | 12698 | [1–267] |
| 12451 | [1–200] | 12505 | [1–462] | 12645 | [1–316] | 12699 | [1–318] |
| 12453 | [1–154] | 12506 | [1–134] | 12646 | [1–139] | 12700 | [1–385] |
| 12454 | [1–69] | 12507 | [1–419] | 12647 | [1–122] | 12701 | [1–50] |
| 12455 | [1–99] | 12508 | [1–455] | 12648 | [1–331] | 12702 | [1–286] |
| 12456 | [1–408] | 12509 | [1–445] | 12649 | [1–424] | 12704 | [1–219] |
| 12457 | [1–455] | 12510 | [1–458] | 12650 | [1–395] | 12705 | [1–63] |
| 12459 | [1–369] | 12511 | [1–238] | 12651 | [1–344] | 12706 | [1–184] |
| 12460 | [1–432] | 12512 | [1–442] | 12652 | [1–60] | 12707 | [1–199] |
| 12461 | [1–422] | 12514 | [1–177] | 12653 | [1–347] | 12708 | [1–173], [211–258] |
| 12462 | [1–325] | 12515 | [1–406] | 12654 | [1–324] | 12710 | [1–81] |
| 12463 | [52–236] | 12516 | [1–75] | 12655 | [1–422] | 12711 | [1–293] |
| 12464 | [1–70] | 12518 | [86–118] | 12656 | [1–152] | 12712 | [1–372] |
| 12465 | [81–138], [226–287] | 12521 | [1–527] | 12657 | [1–54] | 12713 | [1–208] |
| 12466 | [1–418] | 12522 | [1–531] | 12659 | [1–321] | 12716 | [1–479] |
| 12468 | [1–325] | 12523 | [1–450] | 12660 | [1–240] | 12717 | [1–169] |
| 12469 | [1–414] | 12524 | [1–47] | 12661 | [1–292] | 12718 | [1–328] |
| 12525 | [1–448] | 12579 | [1–432] | 12662 | [1–177] | 12719 | [1–333] |
| 12526 | [1–415] | 12580 | [1–444] | 12663 | [1–87] | 12720 | [1–291] |
| 12527 | [1–312] | 12581 | [1–409] | 12664 | [1–424] | 12722 | [1–329] |
| 12528 | [1–472] | 12583 | [1–467] | 12665 | [1–275] | 12723 | [1–400] |
| 12529 | [1–483] | 12584 | [1–423] | 12667 | [1–380] | 12725 | [1–263] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 12669 | [1–490] | 12726 | [1–322] | 12866 | [1–356] | 12922 | [1–68] |
| 12670 | [1–526] | 12727 | [1–261] | 12867 | [1–208] | 12923 | [1–184] |
| 12671 | [1–120] | 12728 | [1–138] | 12868 | [1–319] | 12924 | [1–502] |
| 12672 | [1–459] | 12729 | [1–243] | 12869 | [1–443] | 12926 | [1–491] |
| 12673 | [1–505] | 12730 | [1–413] | 12871 | [1–320] | 12927 | [1–414] |
| 12674 | [1–292] | 12731 | [1–393] | 12873 | [1–359] | 12928 | [1–259] |
| 12675 | [1–444] | 12733 | [1–387] | 12874 | [1–400] | 12929 | [1–222] |
| 12676 | [1–298] | 12734 | [1–173] | 12876 | [1–81] | 12930 | [1–71] |
| 12677 | [1–429] | 12735 | [147–416] | 12878 | [1–357] | 12931 | [1–53] |
| 12679 | [1–297] | 12737 | [1–494] | 12879 | [1–235] | 12932 | [1–281] |
| 12680 | [1–318] | 12738 | [1–56] | 12880 | [1–425] | 12933 | [1–493] |
| 12681 | [1–88] | 12740 | [1–257] | 12881 | [1–106] | 12934 | [1–276] |
| 12682 | [1–83] | 12741 | [1–310] | 12882 | [1–473] | 12935 | [1–101] |
| 12683 | [1–460] | 12743 | [1–155] | 12885 | [1–101] | 12936 | [1–350] |
| 12685 | [243–361] | 12744 | [1–290] | 12886 | [1–439] | 12938 | [1–340] |
| 12746 | [1–443] | 12803 | [1–248] | 12887 | [1–307] | 12939 | [1–62] |
| 12749 | [231–434] | 12804 | [1–263] | 12888 | [1–297] | 12940 | [1–372] |
| 12750 | [1–184] | 12805 | [1–140] | 12889 | [1–68] | 12941 | [1–330] |
| 12753 | [1–187] | 12806 | [1–185] | 12891 | [1–454] | 12942 | [1–413] |
| 12754 | [1–224] | 12807 | [1–442] | 12892 | [1–130] | 12943 | [1–417] |
| 12755 | [1–412] | 12808 | [1–338] | 12893 | [1–184] | 12944 | [1–514] |
| 12756 | [1–343] | 12809 | [1–28] | 12894 | [1–289] | 12945 | [1–309], [400–482] |
| 12757 | [1–480] | 12810 | [1–455] | 12895 | [1–335] | 12946 | [1–324] |
| 12758 | [1–409] | 12811 | [1–97] | 12896 | [1–323] | 12947 | [1–399] |
| 12760 | [1–376] | 12813 | [1–308] | 12897 | [1–397] | 12948 | [136–281] |
| 12761 | [1–308] | 12814 | [1–226] | 12898 | [1–440] | 12950 | [1–513] |
| 12762 | [1–199] | 12815 | [1–345] | 12899 | [1–94] | 12951 | [1–308] |
| 12763 | [1–411] | 12816 | [1–500] | 12900 | [1–459] | 12952 | [1–82] |
| 12764 | [1–192] | 12818 | [1–122] | 12901 | [1–352] | 12953 | [37–315] |
| 12765 | [1–141] | 12819 | [1–67] | 12902 | [1–318] | 12954 | [1–509] |
| 12767 | [1–85] | 12820 | [1–435] | 12903 | [1–124] | 12955 | [1–175] |
| 12768 | [1–130] | 12821 | [1–472] | 12904 | [1–468] | 12956 | [1–473] |
| 12769 | [1–393] | 12822 | [1–169] | 12905 | [1–479] | 12957 | [1–452] |
| 12770 | [1–393] | 12823 | [1–530] | 12907 | [1–357] | 12958 | [1–324] |
| 12771 | [1–389] | 12824 | [1–101] | 12908 | [1–380] | 12959 | [1–311] |
| 12772 | [1–227] | 12825 | [1–154] | 12960 | [1–372] | 13011 | [1–91] |
| 12773 | [1–362] | 12826 | [64–373] | 12961 | [1–458] | 13012 | [1–364] |
| 12774 | [1–100] | 12827 | [1–58] | 12962 | [1–494] | 13013 | [1–184] |
| 12775 | [1–242] | 12828 | [1–505] | 12963 | [1–184], [228–287] | 13014 | [1–309] |
| 12776 | [1–424] | 12829 | [89–116] | 12964 | [1–366] | 13015 | [1–443] |
| 12777 | [1–458] | 12830 | [1–111] | 12965 | [1–288] | 13016 | [1–242], [282–508] |
| 12781 | [1–174] | 12831 | [1–398] | 12968 | [1–352] | 13017 | [1–420] |
| 12782 | [1–340] | 12832 | [1–475] | 12969 | [1–313] | 13018 | [1–487] |
| 12783 | [1–320] | 12834 | [1–429] | 12970 | [1–345] | 13019 | [1–347] |
| 12784 | [36–351] | 12835 | [1–552] | 12971 | [1–486] | 13020 | [1–435] |
| 12785 | [1–74] | 12836 | [1–358] | 12972 | [1–188] | 13022 | [1–311] |
| 12786 | [1–458] | 12837 | [1–363] | 12973 | [1–254] | 13023 | [94–143], [182–528] |
| 12787 | [1–274] | 12838 | [1–421] | 12974 | [1–526] | 13024 | [1–304] |
| 12788 | [1–405] | 12839 | [1–267] | 12975 | [1–477] | 13026 | [1–268] |
| 12789 | [1–118] | 12840 | [1–454] | 12976 | [1–471] | 13027 | [1–484] |
| 12790 | [1–473] | 12841 | [1–316] | 12977 | [1–161] | 13028 | [254–498] |
| 12791 | [1–185] | 12842 | [1–434] | 12978 | [1–397] | 13029 | [1–386] |
| 12792 | [53–369] | 12843 | [1–515] | 12979 | [1–361] | 13030 | [1–116] |
| 12793 | [1–152] | 12845 | [1–327] | 12980 | [1–195], [377–404] | 13031 | [1–433] |
| 12794 | [1–335] | 12846 | [1–442] | 12981 | [1–450] | 13032 | [1–64] |
| 12795 | [1–28] | 12847 | [1–222] | 12982 | [1–309] | 13033 | [1–336] |
| 12796 | [1–479] | 12848 | [1–451] | 12983 | [1–356] | 13034 | [1–524] |
| 12797 | [1–288] | 12849 | [1–441] | 12984 | [36–351] | 13035 | [1–170], [201–330] |
| 12798 | [1–392] | 12850 | [1–415] | 12985 | [1–465] | 13036 | [1–315] |
| 12799 | [191–253] | 12851 | [1–497] | 12986 | [1–188] | 13037 | [1–483] |
| 12800 | [1–343] | 12852 | [1–397] | 12987 | [1–439] | 13038 | [1–462] |
| 12802 | [1–438] | 12853 | [1–476] | 12988 | [46–103] | 13039 | [1–456] |
| 12854 | [1–513] | 12909 | [1–300] | 12989 | [1–294] | 13041 | [1–442] |
| 12855 | [1–115] | 12910 | [1–476] | 12990 | [1–299] | 13043 | [1–127] |
| 12856 | [1–97] | 12911 | [1–431] | 12992 | [1–307] | 13044 | [1–306] |
| 12857 | [1–267] | 12912 | [1–257] | 12993 | [1–348] | 13045 | [1–413] |
| 12858 | [1–144], [191–397] | 12913 | [1–271] | 12994 | [1–324] | 13046 | [1–309] |
| 12859 | [1–313] | 12914 | [1–283] | 12995 | [1–441] | 13047 | [1–109] |
| 12860 | [1–492] | 12915 | [1–259] | 12996 | [1–354] | 13048 | [1–152] |
| 12861 | [1–326] | 12916 | [1–307] | 12997 | [1–155] | 13049 | [1–59], [309–396] |
| 12862 | [1–303] | 12918 | [1–61] | 12999 | [1–419] | 13050 | [1–438] |
| 12863 | [1–536] | 12919 | [1–274] | 13000 | [1–137] | 13051 | [1–179] |
| 12864 | [1–238] | 12920 | [1–80], [120–209] | 13001 | [1–325] | 13052 | [1–425] |
| 12865 | [1–475] | 12921 | [1–338] | 13002 | [71–293] | 13053 | [1–204] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 13003 | [1–119] | 13054 | [1–381] | 13187 | [1–197] | 13242 | [1–432] |
| 13004 | [1–471] | 13055 | [1–178] | 13188 | [1–317] | 13243 | [1–89] |
| 13005 | [1–291] | 13056 | [1–542] | 13190 | [1–346] | 13245 | [385–467] |
| 13006 | [1–99] | 13057 | [1–109], [342–448] | 13191 | [1–455] | 13247 | [1–109] |
| 13007 | [1–94] | 13058 | [1–219] | 13193 | [42–66] | 13248 | [1–457] |
| 13008 | [1–346] | 13059 | [1–192] | 13194 | [1–160] | 13249 | [1–313], [347–485] |
| 13009 | [1–329] | 13060 | [1–294] | 13195 | [1–372] | 13250 | [1–445] |
| 13010 | [1–498] | 13061 | [1–430] | 13197 | [91–498] | 13251 | [1–174] |
| 13062 | [1–341] | 13116 | [1–317] | 13198 | [1–479] | 13252 | [219–469] |
| 13063 | [1–381] | 13117 | [1–113], [203–461] | 13199 | [1–227] | 13253 | [1–450] |
| 13064 | [1–442] | 13118 | [1–295] | 13200 | [1–420] | 13254 | [1–488] |
| 13065 | [1–295] | 13119 | [1–507] | 13201 | [1–73] | 13255 | [39–257] |
| 13066 | [1–127], [276–492] | 13120 | [1–258] | 13202 | [1–339] | 13256 | [104–479] |
| 13067 | [1–500] | 13121 | [1–357] | 13203 | [1–230] | 13257 | [1–464] |
| 13068 | [110–353] | 13122 | [1–125] | 13204 | [1–53] | 13258 | [1–338] |
| 13069 | [1–53] | 13123 | [1–82] | 13206 | [1–431] | 13260 | [1–475] |
| 13070 | [1–292] | 13124 | [1–298] | 13207 | [1–450] | 13261 | [1–289] |
| 13071 | [1–434] | 13125 | [1–85] | 13208 | [1–404] | 13264 | [1–94] |
| 13072 | [1–361] | 13126 | [1–185] | 13210 | [1–171] | 13265 | [1–467] |
| 13074 | [1–295] | 13127 | [1–327] | 13212 | [1–447] | 13266 | [1–79] |
| 13076 | [1–390] | 13128 | [1–322] | 13213 | [1–454] | 13268 | [1–30] |
| 13077 | [1–82] | 13129 | [1–319] | 13214 | [1–349] | 13269 | [1–404] |
| 13078 | [1–506] | 13130 | [1–473] | 13215 | [1–59] | 13271 | [1–367] |
| 13079 | [1–72] | 13132 | [1–204] | 13217 | [1–433] | 13272 | [1–465] |
| 13080 | [1–438] | 13133 | [1–389] | 13218 | [1–469] | 13273 | [1–199] |
| 13082 | [1–167] | 13134 | [1–256] | 13219 | [1–128] | 13274 | [1–322] |
| 13083 | [1–400] | 13135 | [1–444] | 13220 | [1–164], [230–271] | 13275 | [1–419] |
| 13084 | [1–59] | 13136 | [1–518] | 13221 | [1–459] | 13276 | [1–432] |
| 13085 | [1–458] | 13137 | [1–316] | 13277 | [1–466] | 13331 | [1–485] |
| 13086 | [1–207] | 13138 | [1–441] | 13278 | [1–351] | 13332 | [1–111] |
| 13087 | [1–461] | 13140 | [1–280] | 13279 | [1–465] | 13333 | [1–187] |
| 13088 | [1–416] | 13141 | [1–394] | 13280 | [1–434] | 13334 | [1–176] |
| 13089 | [1–319] | 13142 | [1–395] | 13283 | [1–341] | 13335 | [42–481] |
| 13090 | [1–266] | 13143 | [1–328] | 13284 | [1–442] | 13336 | [1–500] |
| 13091 | [1–311] | 13144 | [1–81] | 13285 | [1–32] | 13337 | [1–422] |
| 13092 | [1–426] | 13146 | [1–376] | 13287 | [1–305] | 13338 | [47–446] |
| 13093 | [1–219] | 13147 | [1–307] | 13288 | [1–455] | 13339 | [1–130] |
| 13094 | [1–320] | 13148 | [1–263] | 13289 | [1–360] | 13340 | [1–348] |
| 13095 | [1–97] | 13149 | [1–131] | 13290 | [1–414] | 13341 | [1–200] |
| 13096 | [1–179] | 13150 | [1–630] | 13291 | [1–269] | 13342 | [1–290] |
| 13097 | [1–289] | 13151 | [1–474] | 13292 | [1–313] | 13344 | [1–87] |
| 13101 | [1–503] | 13152 | [1–81] | 13293 | [1–200] | 13345 | [1–376] |
| 13102 | [1–272] | 13153 | [1–457] | 13294 | [94–257] | 13346 | [1–476] |
| 13103 | [1–282] | 13154 | [1–402] | 13295 | [1–171] | 13347 | [1–429] |
| 13104 | [1–302] | 13155 | [1–440] | 13296 | [1–269] | 13349 | [1–339] |
| 13105 | [1–370] | 13156 | [1–384] | 13297 | [1–192] | 13350 | [1–300] |
| 13106 | [1–69] | 13157 | [1–297] | 13298 | [1–474] | 13351 | [1–439] |
| 13107 | [1–272] | 13158 | [1–378] | 13299 | [1–87] | 13352 | [1–267] |
| 13108 | [1–319] | 13159 | [1–262] | 13300 | [1–75] | 13353 | [1–339] |
| 13109 | [1–235] | 13160 | [1–428] | 13302 | [1–300] | 13354 | [107–156] |
| 13111 | [1–325] | 13161 | [1–326] | 13303 | [1–338] | 13355 | [1–377] |
| 13112 | [1–259] | 13162 | [1–432] | 13304 | [1–347] | 13356 | [1–342] |
| 13113 | [1–179] | 13163 | [1–459] | 13305 | [1–250] | 13358 | [1–171] |
| 13114 | [1–219] | 13164 | [124–148], [355–438] | 13306 | [1–200] | 13360 | [464–513] |
| 13115 | [1–499] | 13165 | [1–445] | 13307 | [1–461] | 13362 | [1–291] |
| 13166 | [1–461] | 13222 | [1–477] | 13308 | [1–304] | 13363 | [1–130] |
| 13167 | [1–85] | 13223 | [1–56] | 13309 | [1–140] | 13364 | [1–225] |
| 13168 | [1–495] | 13224 | [1–318] | 13310 | [47–236] | 13370 | [1–25] |
| 13169 | [1–186], [306–340] | 13226 | [1–478] | 13311 | [1–325] | 13371 | [1–294] |
| 13170 | [1–50] | 13227 | [1–86] | 13312 | [1–415] | 13372 | [1–229] |
| 13171 | [1–113] | 13228 | [1–139], [170–419] | 13313 | [1–370] | 13373 | [1–267] |
| 13172 | [1–110] | 13229 | [1–446] | 13315 | [1–386] | 13374 | [1–279] |
| 13173 | [1–407] | 13230 | [1–517] | 13316 | [1–208] | 13378 | [1–303] |
| 13174 | [1–407] | 13231 | [1–444] | 13317 | [1–142] | 13379 | [1–208] |
| 13175 | [1–470] | 13232 | [1–443] | 13318 | [1–314] | 13381 | [1–66], [187–416] |
| 13176 | [1–438] | 13233 | [1–455] | 13319 | [1–355] | 13386 | [1–453] |
| 13177 | [1–421] | 13234 | [1–61] | 13320 | [1–319] | 13387 | [1–382] |
| 13178 | [1–431] | 13235 | [1–446] | 13321 | [1–382] | 13388 | [1–469] |
| 13179 | [1–493] | 13236 | [1–454] | 13322 | [1–375] | 13389 | [1–83] |
| 13180 | [270–667] | 13237 | [1–452] | 13323 | [1–33] | 13390 | [1–271] |
| 13181 | [1–197] | 13238 | [1–243] | 13324 | [1–467] | 13391 | [1–390] |
| 13182 | [1–457] | 13239 | [1–433] | 13325 | [1–380] | 13393 | [1–172] |
| 13184 | [1–325] | 13240 | [1–414] | 13327 | [1–298] | 13394 | [1–461] |
| 13186 | [1–454] | 13241 | [1–437] | 13329 | [1–129] | 13395 | [1–85] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 13330 | [1–160] | 13396 | [1–117] | 13545 | [1–200] | 13595 | [1–173] |
| 13397 | [1–60], [135–469] | 13462 | [1–267] | 13546 | [1–53] | 13596 | [1–111] |
| 13400 | [1–269] | 13463 | [1–370] | 13547 | [1–129] | 13597 | [1–270] |
| 13401 | [1–64] | 13464 | [1–91] | 13548 | [1–232] | 13598 | [1–306] |
| 13402 | [1–446] | 13465 | [1–263] | 13549 | [1–134] | 13599 | [1–225] |
| 13403 | [1–421] | 13466 | [1–482] | 13550 | [1–170] | 13600 | [1–157] |
| 13404 | [103–263] | 13467 | [1–459] | 13551 | [1–225] | 13601 | [1–81] |
| 13408 | [1–26] | 13468 | [1–132] | 13552 | [1–97] | 13602 | [1–375] |
| 13409 | [1–366] | 13469 | [1–69] | 13553 | [1–162] | 13603 | [1–125] |
| 13410 | [1–438] | 13470 | [238–428] | 13554 | [1–78] | 13604 | [1–312] |
| 13411 | [1–267] | 13471 | [1–426] | 13555 | [1–338] | 13605 | [1–342] |
| 13413 | [227–419] | 13472 | [76–461] | 13556 | [1–446] | 13606 | [116–183] |
| 13414 | [1–358] | 13473 | [1–464] | 13557 | [1–419] | 13607 | [1–112] |
| 13416 | [1–68] | 13475 | [1–342] | 13558 | [1–125] | 13608 | [1–120] |
| 13417 | [1–313] | 13476 | [1–126], [303–362] | 13559 | [1–129] | 13609 | [1–108] |
| 13418 | [155–187] | 13478 | [1–447] | 13560 | [1–380] | 13610 | [1–174] |
| 13419 | [1–311] | 13479 | [1–202] | 13561 | [1–285] | 13611 | [1–377] |
| 13421 | [1–457] | 13480 | [1–63] | 13563 | [1–383] | 13612 | [1–303] |
| 13422 | [1–466] | 13481 | [1–495] | 13564 | [1–92] | 13613 | [1–506] |
| 13423 | [1–440] | 13482 | [1–466] | 13566 | [1–93] | 13614 | [1–165] |
| 13424 | [1–447] | 13483 | [77–174] | 13567 | [1–119] | 13617 | [177–246] |
| 13426 | [1–99] | 13484 | [1–374] | 13618 | [1–494] | 13682 | [1–424] |
| 13427 | [1–480] | 13485 | [1–478] | 13619 | [1–436] | 13683 | [1–454] |
| 13429 | [1–169] | 13486 | [1–370] | 13620 | [1–92] | 13684 | [1–297], [344–505] |
| 13430 | [1–459] | 13487 | [1–170] | 13621 | [1–522] | 13685 | [143–173] |
| 13431 | [1–304] | 13488 | [1–200] | 13622 | [1–443] | 13686 | [1–376] |
| 13432 | [1–415] | 13490 | [1–200] | 13623 | [1–221], [302–460] | 13687 | [1–103], [211–469] |
| 13434 | [1–372] | 13491 | [55–214], [249–482] | 13624 | [1–386] | 13688 | [1–291] |
| 13436 | [1–313] | 13492 | [1–66] | 13625 | [1–476] | 13689 | [1–402] |
| 13438 | [1–464] | 13494 | [1–313] | 13628 | [1–115] | 13690 | [1–510] |
| 13439 | [1–464] | 13495 | [1–254] | 13630 | [1–232] | 13691 | [1–492] |
| 13440 | [1–147] | 13496 | [1–92] | 13631 | [1–471] | 13693 | [1–511] |
| 13442 | [1–511] | 13497 | [1–72] | 13633 | [1–60], [129–314], [374–466] | 13694 | [1–229] |
| 13444 | [1–120] | 13498 | [1–50] | | | | |
| 13445 | [1–441] | 13499 | [1–82] | 13634 | [1–513] | 13695 | [1–513] |
| 13446 | [1–300] | 13500 | [1–200] | 13637 | [1–504] | 13696 | [1–472] |
| 13447 | [1–388] | 13501 | [1–354] | 13638 | [1–465] | 13697 | [1–312] |
| 13448 | [1–54] | 13502 | [1–329] | 13640 | [1–443] | 13699 | [1–130] |
| 13449 | [1–269] | 13503 | [1–321] | 13641 | [1–385] | 13700 | [1–266] |
| 13450 | [1–403] | 13504 | [1–201] | 13643 | [1–328] | 13704 | [1–125], [167–479] |
| 13451 | [1–303] | 13505 | [1–481] | 13644 | [1–362] | 13705 | [1–462] |
| 13454 | [1–441] | 13508 | [1–330] | 13645 | [92–267] | 13706 | [85–474] |
| 13455 | [1–429] | 13509 | [1–336] | 13647 | [1–113] | 13707 | [1–203] |
| 13456 | [1–191] | 13510 | [1–383] | 13649 | [1–62] | 13708 | [1–486] |
| 13457 | [1–91] | 13511 | [1–112] | 13651 | [1–486] | 13709 | [1–431] |
| 13458 | [1–81] | 13512 | [1–293] | 13652 | [1–442] | 13710 | [1–425] |
| 13459 | [1–90] | 13513 | [1–495] | 13653 | [1–475] | 13711 | [1–468] |
| 13461 | [1–56] | 13515 | [1–337] | 13654 | [1–79] | 13712 | [158–358] |
| 13516 | [1–267] | 13568 | [1–297] | 13655 | [1–284] | 13713 | [45–421] |
| 13517 | [1–207] | 13569 | [1–156] | 13656 | [1–473] | 13714 | [1–237] |
| 13518 | [1–378] | 13570 | [1–324] | 13658 | [1–145] | 13715 | [1–467] |
| 13519 | [1–372] | 13571 | [1–115] | 13659 | [1–490] | 13716 | [1–499] |
| 13520 | [1–271] | 13572 | [1–109] | 13660 | [1–481] | 13717 | [1–504] |
| 13521 | [1–144] | 13573 | [1–224] | 13662 | [1–102] | 13718 | [1–489] |
| 13522 | [1–225] | 13574 | [1–342] | 13663 | [1–440] | 13719 | [1–420] |
| 13524 | [1–119] | 13575 | [1–200] | 13664 | [1–447] | 13720 | [1–507] |
| 13525 | [1–243] | 13576 | [1–161] | 13665 | [1–471] | 13721 | [1–487] |
| 13526 | [1–82] | 13577 | [1–149] | 13667 | [1–86], [175–253] | 13722 | [1–468] |
| 13527 | [1–92] | 13578 | [1–92] | 13668 | [387–475] | 13723 | [1–372] |
| 13528 | [1–200] | 13579 | [1–70] | 13671 | [1–371] | 13724 | [1–116] |
| 13529 | [1–170] | 13580 | [1–51] | 13673 | [1–460] | 13725 | [227–483] |
| 13530 | [1–337] | 13581 | [58–272] | 13674 | [1–447] | 13726 | [1–454] |
| 13532 | [1–133] | 13582 | [1–111] | 13675 | [1–479] | 13727 | [1–476] |
| 13534 | [1–115] | 13583 | [1–152] | 13676 | [1–70] | 13728 | [1–458] |
| 13535 | [1–374] | 13584 | [1–412] | 13677 | [193–468] | 13729 | [1–74], [117–417] |
| 13536 | [1–254] | 13585 | [87–118] | 13678 | [1–93], [189–467] | 13730 | [1–137] |
| 13537 | [1–296] | 13586 | [1–85], [153–504] | 13679 | [1–192] | 13731 | [1–370] |
| 13538 | [1–200] | 13587 | [1–374] | 13680 | [1–355] | 13732 | [1–113] |
| 13539 | [1–112] | 13588 | [1–313] | 13681 | [1–463] | 13733 | [45–408] |
| 13540 | [1–354] | 13589 | [1–107] | 13734 | [245–472] | 13791 | [1–500] |
| 13541 | [1–309] | 13590 | [1–366] | 13735 | [1–263] | 13793 | [255–433] |
| 13542 | [1–348] | 13591 | [1–175] | 13737 | [1–476] | 13794 | [1–215] |
| 13543 | [1–361] | 13592 | [1–91] | 13738 | [1–282] | 13795 | [1–507] |
| 13544 | [1–161] | 13594 | [1–144] | 13739 | [1–469] | 13796 | [1–363] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 13740 | [1–348] | 13797 | [1–146] | 13884 | [1–85] | 13938 | [1–340] |
| 13741 | [132–357] | 13798 | [1–209], [398–451] | 13885 | [1–403] | 13939 | [1–451] |
| 13742 | [1–136], [416–483] | 13799 | [1–294] | 13886 | [1–343] | 13940 | [1–413] |
| 13744 | [1–468] | 13800 | [1–343] | 13887 | [1–211] | 13941 | [1–426] |
| 13745 | [1–480] | 13801 | [1–420] | 13888 | [1–513] | 13942 | [1–218] |
| 13746 | [239–449] | 13802 | [1–134], [255–465] | 13889 | [1–214] | 13943 | [1–155], [199–395] |
| 13747 | [1–462] | 13803 | [1–369] | 13890 | [1–488] | 13944 | [1–507] |
| 13748 | [1–491] | 13805 | [1–139] | 13891 | [1–574] | 13945 | [1–487] |
| 13749 | [1–361] | 13806 | [59–100] | 13893 | [1–503] | 13946 | [1–223] |
| 13750 | [1–287] | 13807 | [1–348] | 13894 | [1–100] | 13947 | [80–456] |
| 13751 | [1–436] | 13808 | [1–72] | 13896 | [1–388] | 13948 | [1–123] |
| 13752 | [1–59] | 13809 | [1–125], [157–471] | 13897 | [75–543] | 13949 | [1–488] |
| 13755 | [1–461] | 13811 | [1–466] | 13898 | [1–521] | 13950 | [1–508] |
| 13756 | [1–93] | 13812 | [1–320] | 13899 | [1–133] | 13951 | [1–443] |
| 13758 | [1–433] | 13813 | [1–294] | 13900 | [73–127] | 13952 | [1–172], [283–449] |
| 13759 | [1–61] | 13814 | [1–475] | 13901 | [1–103] | 13953 | [1–89] |
| 13760 | [1–437] | 13815 | [1–481] | 13954 | [1–511] | 14008 | [1–478] |
| 13761 | [1–60] | 13816 | [1–41] | 13956 | [1–200] | 14009 | [1–336] |
| 13764 | [1–493] | 13818 | [1–443] | 13957 | [1–330] | 14011 | [1–281] |
| 13765 | [1–115] | 13820 | [1–105] | 13958 | [1–94] | 14012 | [1–524] |
| 13766 | [1–459] | 13821 | [1–428] | 13959 | [1–399] | 14013 | [1–529] |
| 13767 | [1–543] | 13822 | [1–485] | 13960 | [53–236] | 14014 | [1–343] |
| 13768 | [1–392] | 13823 | [1–257] | 13961 | [1–512] | 14015 | [1–231] |
| 13769 | [1–97] | 13824 | [1–139] | 13963 | [1–62] | 14016 | [1–518] |
| 13770 | [1–178] | 13825 | [1–477] | 13964 | [1–510] | 14017 | [1–57] |
| 13771 | [1–463] | 13826 | [37–460] | 13965 | [1–112] | 14018 | [1–440] |
| 13772 | [1–396] | 13827 | [1–481] | 13967 | [1–422] | 14019 | [1–496] |
| 13773 | [1–313] | 13828 | [1–52] | 13968 | [1–512] | 14020 | [1–499] |
| 13774 | [1–582] | 13829 | [1–471] | 13969 | [200–485] | 14021 | [1–428] |
| 13775 | [1–507] | 13830 | [1–428] | 13970 | [73–178] | 14022 | [1–387] |
| 13776 | [1–342] | 13831 | [1–32] | 13971 | [1–435] | 14023 | [1–382] |
| 13777 | [1–407] | 13832 | [224–496] | 13972 | [1–542] | 14024 | [1–87] |
| 13778 | [1–475] | 13833 | [1–402] | 13973 | [1–491] | 14025 | [1–255] |
| 13779 | [1–534] | 13834 | [1–479] | 13974 | [1–55] | 14026 | [211–502] |
| 13780 | [1–264] | 13835 | [1–487] | 13975 | [1–180] | 14027 | [1–317] |
| 13782 | [1–320], [363–485] | 13836 | [1–62] | 13976 | [1–77] | 14028 | [1–119] |
| 13783 | [1–81] | 13837 | [381–537] | 13977 | [1–266] | 14030 | [1–228] |
| 13784 | [1–266] | 13838 | [1–481] | 13978 | [1–327] | 14031 | [1–483] |
| 13786 | [1–499] | 13839 | [271–452] | 13979 | [1–387] | 14032 | [1–89] |
| 13787 | [1–478] | 13841 | [1–353] | 13980 | [1–339] | 14033 | [1–77] |
| 13788 | [1–605] | 13842 | [1–63] | 13982 | [1–417] | 14034 | [1–458] |
| 13789 | [48–472] | 13843 | [1–494] | 13984 | [1–241] | 14035 | [1–58], [214–440] |
| 13844 | [1–429] | 13903 | [89–176] | 13985 | [1–447] | 14036 | [1–312] |
| 13845 | [1–472] | 13904 | [1–74] | 13986 | [1–145] | 14037 | [1–460] |
| 13846 | [1–268] | 13905 | [1–40], [82–259] | 13987 | [1–100] | 14038 | [1–490] |
| 13847 | [1–316] | 13906 | [1–159] | 13988 | [1–499] | 14039 | [1–475] |
| 13848 | [214–390] | 13907 | [1–276] | 13989 | [79–150] | 14040 | [1–272], [385–478] |
| 13850 | [1–465] | 13908 | [1–181] | 13990 | [1–459] | 14041 | [1–510] |
| 13851 | [1–234] | 13909 | [1–69] | 13991 | [1–501] | 14043 | [1–535] |
| 13852 | [1–52] | 13911 | [1–600] | 13992 | [86–132] | 14044 | [1–319] |
| 13853 | [1–304] | 13912 | [1–183] | 13994 | [1–480] | 14045 | [1–479] |
| 13854 | [1–486] | 13913 | [216–327] | 13995 | [1–485] | 14046 | [1–485] |
| 13855 | [1–354] | 13914 | [1–254] | 13996 | [1–343] | 14048 | [1–371] |
| 13856 | [1–464] | 13915 | [1–75] | 13997 | [1–466] | 14049 | [1–290], [327–473] |
| 13859 | [1–667] | 13916 | [1–181] | 13999 | [1–479] | 14050 | [1–111] |
| 13860 | [147–353] | 13917 | [1–67] | 14000 | [1–467] | 14051 | [1–499] |
| 13862 | [1–506] | 13918 | [1–108] | 14001 | [1–368] | 14053 | [1–155] |
| 13863 | [1–480] | 13919 | [1–437] | 14002 | [1–325] | 14054 | [1–195], [247–486] |
| 13864 | [1–315] | 13920 | [1–64] | 14003 | [1–115] | 14055 | [1–513] |
| 13865 | [1–149], [237–516] | 13921 | [1–54], [345–463] | 14004 | [1–132], [395–447] | 14056 | [1–111], [260–383] |
| 13866 | [1–491] | 13922 | [1–304], [663–691] | 14005 | [1–418] | 14057 | [1–485] |
| 13868 | [1–468] | 13923 | [1–381] | 14006 | [1–492] | 14058 | [1–201] |
| 13869 | [1–382] | 13924 | [1–450] | 14007 | [1–447] | 14059 | [1–322] |
| 13872 | [1–278] | 13925 | [1–356] | 14061 | [1–129] | 14120 | [1–430] |
| 13873 | [1–386] | 13927 | [1–477] | 14062 | [81–421] | 14122 | [1–403] |
| 13875 | [1–502] | 13929 | [1–388] | 14066 | [238–282] | 14123 | [1–481] |
| 13876 | [1–239] | 13930 | [1–221] | 14067 | [1–170] | 14124 | [1–315] |
| 13878 | [1–248] | 13931 | [435–463] | 14068 | [1–242] | 14125 | [1–417] |
| 13879 | [1–480] | 13932 | [1–457] | 14069 | [1–484] | 14126 | [1–503] |
| 13880 | [1–313], [344–481] | 13933 | [1–127] | 14071 | [255–487] | 14127 | [1–493] |
| 13881 | [1–27], [90–131], [354–433] | 13934 | [1–154] | 14072 | [1–243] | 14128 | [1–182] |
| | | | | 14073 | [1–289] | 14129 | [1–385] |
| 13882 | [1–242] | 13935 | [1–173] | 14074 | [1–439] | 14130 | [1–62] |
| 13883 | [1–387] | 13937 | [1–57] | 14075 | [1–468] | 14131 | [1–295] |

TABLE IVa-continued (Novelty:95%)

| Seq Id No. | Positions of preferred fragments | Seq Id No. | Positions of preferred fragments |
|---|---|---|---|
| 14077 | [1–258] | 14132 | [1–496] |
| 14078 | [1–314] | 14133 | [1–452] |
| 14079 | [1–509] | 14134 | [60–372] |
| 14080 | [1–489] | 14135 | [1–449] |
| 14081 | [1–497] | 14136 | [1–438] |
| 14082 | [1–204] | 14137 | [1–181] |
| 14083 | [1–392] | 14138 | [1–472] |
| 14084 | [1–46] | 14139 | [1–444] |
| 14085 | [1–473] | 14141 | [59–87] |
| 14086 | [1–35], [351–414] | 14142 | [1–52] |
| 14087 | [1–445] | 14144 | [1–316] |
| 14089 | [1–441] | 14145 | [1–509] |
| 14090 | [1–394] | 14146 | [1–497] |
| 14092 | [1–501] | 14147 | [1–67] |
| 14093 | [180–326] | 14148 | [155–291] |
| 14094 | [1–514] | 14149 | [1–100] |
| 14095 | [1–504] | 14151 | [67–456] |
| 14096 | [1–186] | 14152 | [1–406] |
| 14098 | [1–225] | 14153 | [1–443] |
| 14100 | [287–432] | 14154 | [1–156] |
| 14102 | [1–354] | 14155 | [187–267] |
| 14103 | [1–454] | 14156 | [1–333] |
| 14104 | [1–607] | 14157 | [1–503] |
| 14105 | [1–69] | 14158 | [1–166], [286–328], [380–460] |
| 14106 | [36–429] | 14159 | [1–354] |
| 14107 | [1–379] | 14160 | [1–147] |
| 14108 | [1–488] | 14162 | [1–69] |
| 14109 | [1–240] | 14163 | [37–472] |
| 14110 | [1–171] | 14164 | [1–461] |
| 14112 | [1–74] | 14165 | [1–543] |
| 14113 | [1–481] | 14166 | [387–424] |
| 14114 | [63–191] | 14167 | [1–538] |
| 14115 | [1–259] | 14168 | [1–372] |
| 14116 | [1–125] | 14171 | [1–448] |
| 14117 | [1–483] | 14172 | [1–106] |
| 14118 | [1–]59], [200–473] | 14173 | [1–487] |
| 14174 | [1–491] | 14235 | [1–458] |
| 14175 | [1–600] | 14236 | [1–88], [364–407] |
| 14176 | [1–77] | 14238 | [1–477] |
| 14177 | [1–529] | 14239 | [1–213] |
| 14179 | [1–498] | 14240 | [1–216], [256–487] |
| 14180 | [1–301] | 14241 | [1–464] |
| 14181 | [1–439] | 14242 | [1–454] |
| 14182 | [1–203] | 14244 | [1–470] |
| 14183 | [1–436] | 14245 | [1–31], [137–367] |
| 14184 | [1–413] | 14246 | [1–81] |
| 14186 | [1–391] | 14247 | [1–262] |
| 14187 | [1–468] | 14248 | [1–227] |
| 14188 | [72–97] | 14249 | [1–410] |
| 14189 | [1–74] | 14250 | [1–27] |
| 14190 | [1–323] | 14251 | [1–272] |
| 14191 | [1–453] | 14252 | [1–462] |
| 14192 | [1–489] | 14253 | [1–431] |
| 14194 | [198–497] | 14254 | [1–100] |
| 14195 | [1–180] | 14255 | [1–391] |
| 14196 | [1–452] | 14257 | [1–171] |
| 14197 | [1–474] | 14258 | [1–364] |
| 14199 | [1–90], [122–156[, [247–444] | 14259 | [1–436] |
| 14200 | [311–390] | 14260 | [1–425] |
| 14203 | [1–275] | 14261 | [1–359] |
| 14204 | [1–200] | 14262 | [1–269] |
| 14205 | [1–52], [84–133], [174–484] | 14263 | [1–138] |
| 14206 | [388–434] | 14264 | [1–491] |
| 14207 | [1–300] | 14265 | [1–345] |
| 14209 | [1–465] | 14266 | [1–394] |
| 14210 | [110–232] | 14267 | [1–467] |
| 14211 | [1–341] | 14268 | [1–185] |
| 14212 | [1–106] | 14270 | [1–232] |
| 14213 | [1–466] | 14271 | [250–318], [434–467] |
| 14214 | [1–327] | 14273 | [1–62] |
| 14215 | [1–458] | 14274 | [1–278] |
| 14216 | [1–494] | 14275 | [1–396] |
| 14217 | [1–203], [278–466] | 14276 | [1–164] |
| 14218 | [1–462] | 14277 | [1–479] |
| 14220 | [1–248], [404–460] | 14278 | [1–523] |
| 14222 | [1–370] | 14280 | [1–316] |
| 14224 | [1–333], [373–475] | 14281 | [1–500] |
| 14225 | [1–312] | 14282 | [1–271] |
| 14226 | [1–457] | 14283 | [1–267] |
| 14227 | [1–457] | 14284 | [1–409] |
| 14229 | [1–455] | 14285 | [1–75] |
| 14232 | [1–334] | 14286 | [1–157] |
| 14234 | [1–118] | 14288 | [1–445] |
| 14289 | [1–434] | 14350 | [1–428] |
| 14291 | [1–339] | 14351 | [1–325] |
| 14292 | [1–418] | 14352 | [1–182] |
| 14293 | [1–85] | 14353 | [1–162] |
| 14294 | [1–491] | 14354 | [1–514] |
| 14295 | [1–433] | 14355 | [1–96] |
| 14297 | [1–445] | 14356 | [1–352] |
| 14299 | [1–379] | 14357 | [401–498] |
| 14300 | [1–454] | 14358 | [1–198] |
| 14301 | [1–363] | 14359 | [1–550] |
| 14303 | [1–431] | 14361 | [1–334] |
| 14304 | [1–453] | 14362 | [1–453] |
| 14305 | [1–425] | 14363 | [1–214], [316–347] |
| 14306 | [1–436] | 14364 | [1–495] |
| 14307 | [311–405] | 14368 | [1–310] |
| 14308 | [1–260] | 14369 | [1–454] |
| 14309 | [1–477] | 14370 | [1–297] |
| 14310 | [1–496] | 14371 | [1–121], [384–430] |
| 14311 | [1–378] | 14372 | [1–462] |
| 14313 | [1–442] | 14373 | [1–512] |
| 14314 | [1–282] | 14374 | [1–73] |
| 14315 | [1–66] | 14376 | [1–449] |
| 14316 | [1–371] | 14377 | [1–193] |
| 14318 | [1–429] | 14378 | [1–307] |
| 14319 | [1–299] | 14379 | [1–477] |
| 14320 | [1–111] | 14381 | [1–269] |
| 14322 | [1–156] | 14383 | [1–126], [338–483] |
| 14323 | [1–392] | 14384 | [1–412] |
| 14324 | [1–277] | 14385 | [1–239] |
| 14326 | [1–461] | 14387 | [49–451] |
| 14327 | [1–452] | 14389 | [1–443] |
| 14328 | [1–423] | 14390 | [1–145] |
| 14329 | [1–218] | 14391 | [1–115] |
| 14331 | [1–277] | 14392 | [1–451] |
| 14333 | [1–82] | 14393 | [1–470] |
| 14334 | [1–420] | 14394 | [1–474] |
| 14335 | [1–410] | 14395 | [1–442] |
| 14336 | [1–266] | 14396 | [1–372] |
| 14337 | [1–434] | 14397 | [1–122] |
| 14339 | [1–448] | 14398 | [1–457] |
| 14342 | [1–373], [412–481] | 14399 | [1–457] |
| 14343 | [1–416] | 14400 | [1–296] |
| 14344 | [1–464] | 14401 | [1–170] |
| 14346 | [1–289] | 14402 | [1–379] |
| 14347 | [1–383] | 14403 | [1–477] |
| 14348 | [1–313] | 14404 | [318–386] |
| 14349 | [1–418] | 14405 | [1–481] |
| 14406 | [1–477] | 14463 | [1–463] |
| 14407 | [1–474] | 14464 | [1–449] |
| 14410 | [1–357] | 14465 | [1–96] |
| 14412 | [1–320] | 14466 | [1–444] |
| 14414 | [1–476] | 14467 | [1–461] |
| 14415 | [1–301] | 14468 | [1–448] |
| 14416 | [1–169] | 14469 | [1–233] |
| 14417 | [1–439] | 14471 | [1–448] |
| 14418 | [1–343] | 14472 | [1–375] |
| 14419 | [1–71], [105–190], [248–302] | 14473 | [1–369] |
| 14420 | [1–171], [200–463] | 14474 | [1–229], [280–451] |
| 14421 | [1–45], [208–402] | 14475 | [1–458] |
| 14422 | [1–455] | 14476 | [1–197] |
| 14423 | [1–447] | 14477 | [1–441] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 14424 | [1–455] | 14479 | [1–151] | 14569 | [1–347] | 14625 | [1–484] |
| 14425 | [1–173] | 14480 | [1–422] | 14570 | [1–324] | 14626 | [1–359] |
| 14426 | [1–373] | 14481 | [1–329] | 14571 | [1–84] | 14627 | [1–52] |
| 14427 | [1–415] | 14482 | [1–93] | 14572 | [1–483] | 14628 | [1–511] |
| 14428 | [1–213] | 14484 | [1–401] | 14573 | [1–311] | 14629 | [1–233] |
| 14429 | [1–442] | 14485 | [1–344] | 14574 | [1–341] | 14630 | [1–129] |
| 14430 | [1–465] | 14488 | [1–441] | 14631 | [1–82] | 14683 | [1–419] |
| 14431 | [1–256] | 14489 | [1–334] | 14632 | [1–475] | 14685 | [1–320] |
| 14432 | [1–295] | 14490 | [1–443] | 14633 | [1–520] | 14687 | [1–314] |
| 14433 | [1–398] | 14491 | [1–386] | 14634 | [1–316] | 14688 | [1–97] |
| 14434 | [1–477] | 14492 | [1–82] | 14635 | [1–308] | 14689 | [1–92] |
| 14436 | [1–119] | 14493 | [141–324] | 14636 | [1–465] | 14690 | [1–340] |
| 14437 | [1–200] | 14494 | [1–408] | 14637 | [1–288] | 14693 | [1–77] |
| 14438 | [1–116] | 14495 | [1–417] | 14638 | [1–222] | 14694 | [1–75] |
| 14439 | [1–470] | 14496 | [1–446] | 14639 | [1–251] | 14697 | [1–368] |
| 14440 | [1–178] | 14497 | [183–217] | 14640 | [413–498] | 14699 | [1–365] |
| 14441 | [1–435] | 14498 | [1–433] | 14641 | [1–397] | 14700 | [1–288] |
| 14443 | [1–482] | 14499 | [1–453] | 14642 | [1–424] | 14701 | [1–124] |
| 14445 | [1–419] | 14500 | [1–171] | 14644 | [1–217] | 14702 | [1–357] |
| 14447 | [1–435] | 14501 | [1–453] | 14645 | [1–501] | 14703 | [1–60] |
| 14448 | [1–310] | 14503 | [1–298] | 14646 | [1–470] | 14704 | [1–195] |
| 14449 | [1–458] | 14504 | [1–475] | 14647 | [1–143], [223–293] | 14705 | [1–74] |
| 14450 | [1–432] | 14505 | [1–416] | 14648 | [1–58] | 14706 | [1–293] |
| 14451 | [72–443] | 14506 | [1–276], [307–432] | 14649 | [1–322] | 14708 | [1–345] |
| 14452 | [51–94], [139–415] | 14508 | [1–342] | 14650 | [1–486] | 14709 | [1–509] |
| 14453 | [1–433] | 14509 | [1–369] | 14651 | [1–478] | 14710 | [1–449] |
| 14454 | [1–215] | 14510 | [1–450] | 14652 | [1–447] | 14711 | [1–335] |
| 14455 | [1–461] | 14511 | [1–89] | 14653 | [1–438] | 14712 | [1–59] |
| 14456 | [59–322] | 14512 | [1–322] | 14654 | [341–388] | 14713 | [1–216] |
| 14457 | [1–473] | 14513 | [1–249] | 14655 | [43–79] | 14714 | [1–217] |
| 14458 | [1–374] | 14514 | [1–418] | 14656 | [1–482] | 14715 | [1–50] |
| 14459 | [1–457] | 14515 | [1–373] | 14657 | [1–508] | 14716 | [1–95] |
| 14460 | [1–70] | 14516 | [164–402] | 14658 | [1–329] | 14717 | [1–80] |
| 14519 | [1–320] | 14577 | [1–84] | 14659 | [1–398] | 14718 | [1–406] |
| 14520 | [1–448] | 14578 | [1–408] | 14661 | [1–194] | 14719 | [1–274] |
| 14522 | [1–333] | 14579 | [1–178] | 14662 | [183–497] | 14720 | [1–492] |
| 14523 | [1–384] | 14580 | [1–413] | 14663 | [1–484] | 14721 | [1–433] |
| 14524 | [1–26] | 14581 | [1–292], [400–488] | 14665 | [1–481] | 14722 | [1–135] |
| 14526 | [1–140] | 14582 | [1–322] | 14666 | [1–126] | 14723 | [1–420] |
| 14527 | [1–129] | 14583 | [1–399] | 14667 | [1–323] | 14724 | [1–94] |
| 14528 | [1–360] | 14584 | [1–482] | 14668 | [1–90] | 14725 | [1–483] |
| 14529 | [1–504] | 14585 | [1–325] | 14669 | [1–425] | 14726 | [1–465] |
| 14530 | [1–457] | 14586 | [1–399] | 14670 | [1–448] | 14728 | [1–217] |
| 14531 | [1–424] | 14587 | [1–332] | 14671 | [1–172] | 14729 | [1–73] |
| 14532 | [1–61] | 14588 | [1–280] | 14672 | [1–59] | 14731 | [45–184] |
| 14534 | [1–284] | 14589 | [1–284] | 14673 | [1–29] | 14732 | [1–433] |
| 14535 | [1–55] | 14590 | [1–357] | 14676 | [1–275] | 14733 | [1–304] |
| 14536 | [1–72] | 14591 | [1–364] | 14677 | [1–111] | 14734 | [1–437] |
| 14537 | [1–321] | 14592 | [1–109] | 14678 | [1–472] | 14735 | [1–461] |
| 14538 | [1–425] | 14593 | [1–478] | 14679 | [1–168] | 14737 | [1–148] |
| 14540 | [1–498] | 14594 | [1–507] | 14680 | [1–61] | 14738 | [1–411] |
| 14541 | [1–480] | 14595 | [1–238] | 14681 | [1–61] | 14739 | [1–517] |
| 14542 | [1–507] | 14596 | [1–433] | 14682 | [1–59] | 14740 | [1–308] |
| 14543 | [1–226] | 14597 | [1–492] | 14741 | [1–85] | 14798 | [61–259] |
| 14544 | [1–541] | 14599 | [1–167] | 14742 | [1–60] | 14799 | [1–61] |
| 14545 | [1–523] | 14600 | [240–483] | 14743 | [1–65] | 14800 | [1–55] |
| 14546 | [246–317], [363–583] | 14601 | [1–374] | 14744 | [1–404] | 14801 | [1–342] |
| 14547 | [1–487] | 14603 | [1–510] | 14745 | [1–498] | 14803 | [1–54] |
| 14548 | [1–367] | 14605 | [1–440] | 14746 | [1–463] | 14804 | [1–102] |
| 14550 | [1–166] | 14606 | [1–416] | 14747 | [1–413] | 14805 | [1–81] |
| 14551 | [1–487] | 14608 | [1–418] | 14748 | [109–195] | 14806 | [1–110] |
| 14552 | [1–451] | 14609 | [1–361] | 14749 | [1–89] | 14807 | [1–430] |
| 14553 | [1–359] | 14610 | [1–335] | 14750 | [1–70] | 14808 | [1–430] |
| 14554 | [1–447] | 14612 | [1–50] | 14751 | [1–83] | 14809 | [1–292] |
| 14555 | [1–498] | 14613 | [1–410] | 14752 | [1–284] | 14811 | [1–441] |
| 14556 | [1–56] | 14614 | [1–224] | 14753 | [1–67] | 14812 | [1–77] |
| 14558 | [1–464] | 14615 | [1–163] | 14754 | [1–61] | 14813 | [1–69] |
| 14559 | [1–471] | 14616 | [1–495] | 14755 | [1–195] | 14814 | [1–456] |
| 14560 | [1–87] | 14617 | [1–430] | 14756 | [1–63] | 14815 | [1–72] |
| 14562 | [222–382] | 14618 | [1–352] | 14757 | [1–90] | 14816 | [1–340] |
| 14563 | [1–424] | 14619 | [1–83] | 14758 | [54–209] | 14818 | [1–195] |
| 14565 | [1–464] | 14620 | [296–321] | 14759 | [1–527] | 14819 | [1–66] |
| 14566 | [1–301] | 14621 | [1–156], [190–491] | 14761 | [1–189] | 14820 | [1–54] |
| 14568 | [47–75] | 14623 | [1–483] | 14763 | [1–317] | 14821 | [1–436] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 14764 | [1–63] | 14822 | [1–343] | 14958 | [1–83] | 15013 | [1–61] |
| 14765 | [1–495] | 14823 | [1–317] | 14959 | [1–83] | 15014 | [37–481] |
| 14766 | [1–508] | 14824 | [1–78] | 14960 | [1–88] | 15016 | [1–434] |
| 14767 | [1–379] | 14825 | [1–62] | 14961 | [1–427] | 15017 | [1–162] |
| 14768 | [199–393] | 14826 | [1–386] | 14963 | [1–73] | 15018 | [1–83], [166–228] |
| 14769 | [1–474] | 14827 | [1–58] | 14964 | [1–30] | 15019 | [1–167] |
| 14770 | [1–263] | 14829 | [1–478] | 14965 | [1–458] | 15020 | [1–500] |
| 14771 | [1–528] | 14830 | [1–103] | 14966 | [1–63] | 15021 | [1–195] |
| 14772 | [450–510] | 14831 | [1–76] | 14967 | [1–118] | 15022 | [1–419] |
| 14773 | [1–514] | 14833 | [1–119], [154–405] | 14968 | [1–58] | 15023 | [1–32] |
| 14774 | [1–298] | 14834 | [1–61] | 14970 | [1–105] | 15024 | [1–81] |
| 14775 | [1–281] | 14835 | [1–86] | 14971 | [1–235] | 15026 | [1–243] |
| 14777 | [1–162] | 14836 | [1–494] | 14972 | [1–48], [259–469] | 15027 | [1–93] |
| 14778 | [1–445] | 14837 | [1–458] | 14973 | [1–180] | 15028 | [1–91] |
| 14781 | [61–269] | 14838 | [1–69] | 14974 | [1–89] | 15029 | [1–216] |
| 14782 | [1–162] | 14839 | [1–344] | 14976 | [1–178] | 15030 | [1–381] |
| 14783 | [1–83] | 14840 | [1–217] | 14979 | [177–214] | 15031 | [1–82] |
| 14784 | [1–417] | 14841 | [1–328] | 14980 | [1–413] | 15032 | [1–432] |
| 14786 | [1–83] | 14842 | [1–72] | 14981 | [1–448] | 15034 | [1–422] |
| 14787 | [1–75] | 14843 | [1–430] | 14982 | [1–380] | 15035 | [1–492] |
| 14788 | [1–442] | 14845 | [1–253] | 14983 | [1–217] | 15036 | [1–284] |
| 14790 | [1–264] | 14846 | [1–66] | 14984 | [1–305] | 15037 | [1–154] |
| 14791 | [1–301] | 14847 | [1–109] | 14985 | [1–507] | 15038 | [1–454] |
| 14795 | [1–356] | 14848 | [1–187], [268–387] | 14986 | [1–470] | 15039 | [1–338] |
| 14796 | [1–278] | 14849 | [1–87] | 14987 | [1–484] | 15040 | [1–119], [155–431] |
| 14797 | [1–328] | 14850 | [1–480] | 14988 | [1–363] | 15041 | [1–90] |
| 14851 | [1–196] | 14907 | [1–370] | 14989 | [1–53] | 15042 | [1–503] |
| 14852 | [1–423] | 14908 | [1–413] | 14991 | [1–433] | 15043 | [1–301] |
| 14853 | [1–65] | 14909 | [1–386] | 14992 | [1–125] | 15044 | [1–248] |
| 14854 | [1–480] | 14910 | [1–119] | 14993 | [1–113] | 15045 | [1–329] |
| 14855 | [1–138] | 14911 | [1–302] | 14994 | [1–54] | 15046 | [1–174] |
| 14856 | [1–309] | 14912 | [1–152] | 14995 | [1–487] | 15047 | [1–134] |
| 14857 | [1–323] | 14913 | [1–52] | 14996 | [1–92] | 15048 | [1–431] |
| 14858 | [1–64] | 14914 | [1–50] | 14997 | [1–447] | 15049 | [1–84] |
| 14859 | [1–85] | 14915 | [1–76] | 14998 | [1–387] | 15050 | [1–465] |
| 14860 | [1–71] | 14916 | [1–78] | 14999 | [1–166] | 15051 | [1–284] |
| 14861 | [1–470] | 14917 | [1–482] | 15000 | [1–156] | 15052 | [37–474] |
| 14862 | [1–103] | 14918 | [1–293] | 15001 | [1–155] | 15053 | [1–548] |
| 14863 | [1–166] | 14919 | [1–496] | 15002 | [1–114] | 15054 | [1–349] |
| 14865 | [1–495] | 14920 | [1–59] | 15003 | [1–169] | 15055 | [1–310] |
| 14866 | [1–217] | 14921 | [1–474] | 15004 | [1–67] | 15056 | [1–113] |
| 14868 | [1–473] | 14922 | [1–195] | 15005 | [115–245] | 15057 | [1–74] |
| 14869 | [1–69] | 14923 | [1–113] | 15006 | [1–217] | 15059 | [1–468] |
| 14870 | [1–276] | 14924 | [1–328] | 15008 | [1–419] | 15060 | [1–91] |
| 14871 | [1–93] | 14925 | [1–91] | 15009 | [1–192] | 15061 | [1–162] |
| 14873 | [1–417] | 14926 | [1–84] | 15010 | [1–446] | 15062 | [1–51] |
| 14874 | [1–197] | 14927 | [1–112] | 15064 | [1–72] | 15121 | [1–483] |
| 14876 | [1–154] | 14928 | [1–122] | 15066 | [1–70] | 15122 | [1–525] |
| 14877 | [1–435] | 14929 | [1–216] | 15067 | [1–445] | 15123 | [1–478] |
| 14879 | [1–323] | 14930 | [1–477] | 15068 | [1–281] | 15124 | [1–309], [350–375] |
| 14880 | [1–302] | 14931 | [1–91] | 15069 | [1–436] | 15127 | [126–165] |
| 14881 | [1–221] | 14932 | [1–234] | 15071 | [1–478] | 15131 | [1–617] |
| 14882 | [1–269] | 14933 | [1–339] | 15072 | [1–425] | 15132 | [1–540] |
| 14884 | [1–60] | 14934 | [1–313] | 15073 | [1–75] | 15133 | [1–232] |
| 14885 | [1–462] | 14935 | [1–449] | 15074 | [1–406] | 15134 | [1–351] |
| 14886 | [1–114] | 14936 | [1–62] | 15075 | [1–177] | 15135 | [1–440] |
| 14887 | [1–481] | 14937 | [1–144] | 15076 | [1–418] | 15136 | [1–189], [219–493] |
| 14888 | [1–389] | 14940 | [1–157] | 15077 | [1–349] | 15138 | [1–207] |
| 14889 | [1–194] | 14941 | [1–431] | 15078 | [1–75] | 15139 | [1–225] |
| 14890 | [1–240] | 14943 | [45–328] | 15079 | [1–177] | 15140 | [1–535] |
| 14891 | [1–301] | 14944 | [1–91] | 15081 | [1–409] | 15142 | [249–289] |
| 14892 | [1–75] | 14945 | [1–62] | 15082 | [1–189] | 15143 | [1–479] |
| 14893 | [1–357] | 14946 | [1–95] | 15086 | [1–255] | 15144 | [1–447] |
| 14894 | [1–386] | 14947 | [1–94] | 15087 | [1–132] | 15145 | [414–457] |
| 14895 | [1–481] | 14948 | [1–61] | 15088 | [1–373] | 15146 | [1–400] |
| 14896 | [1–181] | 14949 | [1–85] | 15089 | [1–162] | 15147 | [1–51] |
| 14897 | [1–485] | 14950 | [1–195] | 15090 | [1–79] | 15149 | [1–437] |
| 14898 | [1–330] | 14951 | [1–224] | 15091 | [1–98] | 15150 | [1–282], [334–570] |
| 14900 | [1–285] | 14952 | [1–486] | 15092 | [1–78] | 15151 | [1–464] |
| 14901 | [1–78] | 14953 | [1–94] | 15093 | [1–342] | 15154 | [1–43], [89–484] |
| 14903 | [1–435] | 14954 | [1–249] | 15094 | [33–64], [290–445] | 15155 | [1–239], [402–651] |
| 14905 | [1–71] | 14955 | [37–491] | 15096 | [1–371] | 15156 | [1–475] |
| 14906 | [1–297] | 14956 | [1–501] | 15098 | [1–520] | 15158 | [1–172] |
| 14957 | [1–124], [155–216] | 15011 | [1–365] | 15099 | [1–450] | 15162 | [1–420] |

TABLE IVa-continued (Novelty:95%)

| Seq Id No. | Positions of preferred fragments | Seq Id No. | Positions of preferred fragments |
|---|---|---|---|
| 15100 | [1–272] | 15163 | [227–436] |
| 15101 | [392–573] | 15164 | [1–533] |
| 15102 | [1–290] | 15166 | [1–484] |
| 15103 | [1–489] | 15167 | [266–291] |
| 15104 | [1–368] | 15168 | [1–294] |
| 15105 | [1–454] | 15169 | [1–85] |
| 15106 | [1–405] | 15170 | [1–478] |
| 15107 | [1–406] | 15171 | [1–50], [278–416] |
| 15108 | [1–337] | 15172 | [1–66] |
| 15109 | [1–163], [451–568] | 15173 | [1–475] |
| 15111 | [48–372] | 15174 | [1–201], [230–425] |
| 15112 | [129–255] | 15175 | [1–122] |
| 15113 | [1–406] | 15176 | [1–445] |
| 15114 | [425–539] | 15177 | [1–64] |
| 15116 | [1–558] | 15178 | [1–35] |
| 15117 | [412–529] | 15179 | [1–473] |
| 15118 | [1–407] | 15180 | [1–34] |
| 15119 | [1–306], [352–495] | 15181 | [1–591] |
| 15120 | [1–478] | 15182 | [1–250] |
| 15183 | [1–377] | 15233 | [1–398] |
| 15184 | [1–454] | 15234 | [1–389] |
| 15185 | [1–376] | 15237 | [1–152], [370–514] |
| 15186 | [1–436] | 15238 | [1–152], [369–442] |
| 15187 | [1–382] | 15239 | [72–112] |
| 15188 | [1–494] | 15240 | [1–475] |
| 15189 | [1–521] | 15241 | [1–435] |
| 15190 | [1–503] | 15242 | [1–394] |
| 15191 | [1–433] | 15244 | [1–601] |
| 15192 | [1–567] | 15245 | [1–506] |
| 15194 | [1–264] | 15246 | [1–521] |
| 15195 | [1–451] | 15247 | [1–468] |
| 15196 | [1–368] | 15248 | [1–345] |
| 15197 | [1–302] | 15249 | [1–293] |
| 15198 | [1–459] | 15251 | [1–577] |
| 15199 | [1–431] | 15252 | [1–425] |
| 15200 | [1–460] | 15253 | [1–185] |
| 15201 | [1–464] | 15254 | [1–434] |
| 15202 | [1–496] | 15256 | [1–501] |
| 15203 | [1–397] | 15257 | [1–493] |
| 15204 | [1–394] | 15258 | [1–454] |
| 15205 | [1–436] | 15259 | [1–466] |
| 15206 | [1–435] | 15261 | [1–402] |
| 15208 | [1–437] | 15262 | [1–448] |
| 15209 | [1–435] | 15263 | [1–492] |
| 15210 | [1–435] | 15264 | [1–381] |
| 15211 | [1–474] | 15268 | [145–201] |
| 15212 | [1–509] | 15269 | [145–201] |
| 15213 | [1–490] | 15270 | [145–180] |
| 15214 | [1–472] | 15273 | [487–512] |
| 15215 | [1–461] | 15274 | [47–187] |
| 15216 | [1–406] | 15279 | [1–533] |
| 15217 | [1–469] | 15280 | [1–459] |
| 15218 | [1–460] | 15281 | [1–460] |
| 15219 | [1–519] | 15282 | [1–506] |
| 15220 | [1–337] | 15283 | [1–641] |
| 15221 | [1–122] | 15284 | [1–295] |
| 15223 | [1–544] | 15286 | [1–292] |
| 15224 | [1–92], [137–494] | 15287 | [1–378] |
| 15225 | [1–59], [104–484] | 15289 | [1–377] |
| 15226 | [1–86] | 15290 | [1–533] |
| 15227 | [1–34] | 15291 | [59–348] |
| 15228 | [1–523] | 15292 | [1–230] |
| 15229 | [1–511] | 15294 | [1–142] |
| 15230 | [1–348] | 15295 | [1–73] |
| 15231 | [1–34] | 15296 | [59–203] |
| 15232 | [1–300] | 15297 | [1–31] |
| 15299 | [1–50], [80–491] | 15352 | [1–390] |
| 15300 | [1–416] | 15353 | [193–258] |
| 15301 | [1–412] | 15354 | [1–208], [322–350], [452–485] |
| 15302 | [1–53] | 15355 | [1–444] |
| 15303 | [1–784] | 15356 | [1–500] |
| 15304 | [1–488] | 15357 | [1–426] |
| 15305 | [1–130], [172–445] | 15358 | [1–415] |
| 15306 | [1–491] | 15359 | [1–413] |
| 15307 | [1–480] | 15360 | [1–416] |
| 15308 | [1–490] | 15361 | [1–412] |
| 15309 | [1–606] | 15362 | [1–416] |
| 15310 | [1–511] | 15363 | [1–433] |
| 15311 | [1–497] | 15364 | [1–414] |
| 15313 | [137–210] | 15365 | [1–454] |
| 15314 | [135–195] | 15366 | [1–425] |
| 15315 | [1–490] | 15367 | [1–413] |
| 15316 | [136–168] | 15368 | [1–442] |
| 15317 | [136–194] | 15369 | [1–549] |
| 15318 | [138–166] | 15371 | [1–501] |
| 15319 | [136–173] | 15372 | [1–495] |
| 15320 | [136–180] | 15374 | [1–420] |
| 15322 | [136–178] | 15375 | [1–526] |
| 15323 | [137–179] | 15376 | [1–496] |
| 15324 | [1–450] | 15377 | [1–569] |
| 15325 | [1–573] | 15379 | [1–125] |
| 15326 | [1–381] | 15380 | [1–506] |
| 15327 | [1–490] | 15383 | [1–39], [128–177], [270–491] |
| 15329 | [1–315] | 15390 | [1–417] |
| 15331 | [1–167] | 15391 | [1–442] |
| 15332 | [1–443] | 15392 | [1–128] |
| 15333 | [91–268], [417–454] | 15394 | [1–162], [420–444] |
| 15334 | [1–457] | 15395 | [1–482] |
| 15335 | [1–278] | 15396 | [1–472] |
| 15336 | [1–94], [140–361] | 15397 | [1–490] |
| 15337 | [70–186] | 15398 | [1–237], [266–431] |
| 15338 | [1–489] | 15399 | [1–486] |
| 15340 | [1–522] | 15400 | [1–575] |
| 15341 | [1–197] | 15401 | [1–490] |
| 15342 | [1–350] | 15402 | [1–483] |
| 15343 | [1–121] | 15403 | [1–486] |
| 15345 | [1–482] | 15404 | [1–49], [166–275] |
| 15346 | [1–499] | 15405 | [1–50] |
| 15347 | [1–447] | 15406 | [1–48] |
| 15348 | [1–395] | 15407 | [1–295] |
| 15349 | [93–263] | 15410 | [102–506] |
| 15350 | [1–392] | 15411 | [1–57] |
| 15351 | [1–517] | 15412 | [95–153] |
| 15414 | [1–445] | 15469 | [1–209] |
| 15415 | [1–362] | 15470 | [1–208] |
| 15416 | [173–221] | 15471 | [1–376] |
| 15417 | [102–201] | 15472 | [1–446] |
| 15418 | [1–472] | 15473 | [1–461] |
| 15419 | [54–83], [134–196], [248–414], [445–504] | 15474 | [1–466] |
| 15420 | [1–96] | 15475 | [1–283], [337–447] |
| 15421 | [1–515] | 15478 | [1–453] |
| 15422 | [1–416] | 15480 | [1–297] |
| 15423 | [1–60] | 15481 | [1–340] |
| 15425 | [1–490] | 15482 | [1–476] |
| 15426 | [1–801] | 15483 | [1–506] |
| 15427 | [1–216] | 15484 | [349–500] |
| 15428 | [1–495] | 15485 | [1–47], [172–257] |
| 15429 | [1–291] | 15486 | [1–185], [339–512] |
| 15431 | [1–69] | 15487 | [1–444] |
| 15432 | [43–314] | 15488 | [1–268] |
| 15433 | [1–488] | 15489 | [1–352] |
| 15434 | [1–212] | 15490 | [1–607] |
| 15435 | [1–410] | 15491 | [1–553] |
| 15436 | [1–179] | 15492 | [1–465] |
| 15439 | [78–164] | 15493 | [1–497] |
| 15442 | [1–297] | 15494 | [1–488] |
| 15443 | [1–200] | 15495 | [1–485] |
| 15445 | [1–568] | 15496 | [1–230] |
| 15446 | [1–477] | 15497 | [1–493] |
| 15447 | [1–148] | 15498 | [1–489] |
| 15448 | [1–205], [250–504] | 15499 | [1–477] |
| 15449 | [1–402] | 15502 | [1–367] |
| 15450 | [315–483] | 15503 | [1–516] |
| 15452 | [1–377] | 15504 | [161–208] |
| 15453 | [1–114] | 15506 | [217–321], [357–401] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 15454 | [1–411] | 15507 | [217–316] | 15657 | [1–467] | 15716 | [1–222] |
| 15455 | [1–153], [189–304], [370–540] | 15508 | [84–118], [163–229] | 15658 | [1–110] | 15717 | [1–409] |
| | | | | 15659 | [1–221] | 15719 | [1–277] |
| 15456 | [1–390] | 15509 | [1–26], [246–360] | 15661 | [1–308] | 15721 | [1–93], [126–420] |
| 15457 | [1–457] | 15510 | [1–25], [172–261] | 15664 | [178–210] | 15723 | [1–26], [181–287] |
| 15458 | [1–313] | 15514 | [1–44] | 15665 | [1–482] | 15724 | [1–36], [191–297] |
| 15459 | [1–492] | 15515 | [1–479] | 15666 | [1–26] | 15726 | [1–340] |
| 15460 | [1–410] | 15516 | [1–343] | 15667 | [1–324] | 15727 | [1–448] |
| 15461 | [1–378] | 15517 | [1–180] | 15668 | [1–374] | 15728 | [1–79] |
| 15462 | [1–468] | 15519 | [1–457] | 15669 | [1–234] | 15731 | [194–423] |
| 15463 | [1–517] | 15520 | [1–111] | 15670 | [1–464] | 15732 | [1–111], [152–246] |
| 15464 | [1–410] | 15521 | [1–442] | 15671 | [1–227] | 15734 | [191–476] |
| 15465 | [1–208] | 15522 | [1–415] | 15672 | [1–300] | 15735 | [1–26], [256–397] |
| 15466 | [1–114] | 15524 | [1–510] | 15673 | [94–560] | 15736 | [1–472] |
| 15467 | [1–209] | 15525 | [1–542] | 15674 | [1–493] | 15737 | [173–271] |
| 15468 | [1–208] | 15526 | [1–287] | 15675 | [1–244], [453–505] | 15739 | [1–423] |
| 15527 | [1–406] | 15578 | [1–821] | 15677 | [1–163] | 15741 | [173–259] |
| 15528 | [278–352] | 15580 | [1–488] | 15678 | [1–402] | 15742 | [1–323] |
| 15529 | [1–447] | 15531 | [1–389] | 15679 | [1–470] | 15743 | [1–370] |
| 15530 | [1–454] | 15583 | [1–519] | 15680 | [339–532] | 15744 | [1–380] |
| 15531 | [112–290] | 15584 | [1–331] | 15681 | [1–471] | 15745 | [1–58] |
| 15532 | [1–399] | 15586 | [1–561] | 15682 | [1–122] | 15746 | [1–64], [205–459] |
| 15533 | [1–272] | 15587 | [1–195] | 15683 | [1–239] | 15748 | [1–623] |
| 15535 | [278–352] | 15588 | [1–311] | 15684 | [1–475] | 15749 | [173–257] |
| 15536 | [1–585] | 15589 | [1–405] | 15685 | [1–428], [459–503] | 15760 | [173–273] |
| 15537 | [1–515] | 15590 | [1–513] | 15686 | [1–419] | 15768 | [1–98] |
| 15538 | [1–50] | 15591 | [1–569] | 15687 | [1–428] | 15791 | [1–483] |
| 15539 | [1–424] | 15592 | [1–368] | 15688 | [1–438] | 15801 | [1–101] |
| 15540 | [1–499] | 15593 | [82–393] | 15691 | [1–497] | 15802 | [1–541] |
| 15541 | [1–72] | 15595 | [1–436] | 15692 | [1–29], [294–386] | 15823 | [1–199] |
| 15542 | [1–188] | 15596 | [1–443] | 15693 | [1–587] | 15844 | [1–448] |
| 15543 | [1–184] | 15597 | [1–504] | 15694 | [1–201] | 15846 | [1–67] |
| 15544 | [1–499] | 15598 | [1–410] | 15695 | [1–296] | 15855 | [1–109] |
| 15545 | [1–476] | 15599 | [1–362] | 15696 | [1–525] | 15921 | [1–53] |
| 15546 | [1–353] | 15603 | [1–544] | 15697 | [1–466] | 15940 | [40–103] |
| 15547 | [1–501] | 15604 | [94–150] | 15698 | [1–250] | 15956 | [1–72] |
| 15548 | [1–490] | 15605 | [87–150] | 15699 | [1–464] | 15968 | [81–108] |
| 15549 | [1–469] | 15606 | [1–487] | 15977 | [1–443] | 16037 | [1–279] |
| 15550 | [1–508] | 15607 | [1–406] | 15990 | [50–439] | 16038 | [1–335] |
| 15551 | [1–231] | 15608 | [1–500] | 15991 | [46–220] | 16039 | [1–276] |
| 15552 | [1–456] | 15609 | [1–251] | 15992 | [1–151] | 16040 | [1–318] |
| 15553 | [1–162] | 15611 | [39–172], [276–317] | 15993 | [1–203] | 16041 | [1–338] |
| 15554 | [1–242] | 15612 | [1–481] | 15994 | [1–151] | 16042 | [1–365] |
| 15555 | [1–406] | 15613 | [1–220] | 15995 | [1–151] | 16043 | [1–280] |
| 15556 | [1–250], [348–418] | 15614 | [1–113], [235–485] | 15996 | [1–446] | 16044 | [1–334] |
| 15557 | [1–583] | 15615 | [1–450] | 15997 | [1–151] | 16045 | [1–333] |
| 15560 | [153–501] | 15617 | [74–372] | 15998 | [1–150] | 16046 | [1–280] |
| 15561 | [1–420] | 15618 | [1–456] | 15999 | [1–151] | 16047 | [1–175] |
| 15562 | [1–387] | 15619 | [1–597] | 16000 | [1–153] | 16048 | [1–371] |
| 15563 | [1–476] | 15620 | [1–162] | 16001 | [1–151] | 16049 | [1–296] |
| 15564 | [1–408] | 15622 | [313–348] | 16003 | [1–424] | 16050 | [1–332] |
| 15565 | [1–281] | 15623 | [1–41] | 16004 | [1–498] | 16051 | [1–336] |
| 15566 | [1–96] | 15625 | [1–47] | 16005 | [1–151] | 16052 | [1–329] |
| 15567 | [1–476] | 15627 | [1–576] | 16006 | [30–125] | 16053 | [1–332] |
| 15568 | [190–217] | 15628 | [54–476] | 16007 | [1–272] | 16054 | [1–281] |
| 15570 | [1–524] | 15629 | [1–381] | 16008 | [1–359] | 16055 | [1–319] |
| 15571 | [49–420] | 15630 | [49–324] | 16009 | [1–292] | 16056 | [1–320] |
| 15572 | [1–577] | 15631 | [1–503] | 16010 | [1–362] | 16057 | [1–306] |
| 15573 | [1–106], [441–580] | 15633 | [1–396] | 16011 | [1–281] | 16058 | [1–357] |
| 15574 | [1–484] | 15634 | [1–403] | 16012 | [1–329] | 16059 | [1–281] |
| 15575 | [1–433] | 15635 | [1–507] | 16013 | [1–336] | 16060 | [1–281] |
| 15576 | [1–43] | 15636 | [1–508] | 16014 | [1–306] | 16061 | [1–335] |
| 15577 | [1–504] | 15638 | [1–419] | 16015 | [1–339] | 16062 | [1–110] |
| 15639 | [1–505] | 15700 | [1–372] | 16016 | [1–282] | 16066 | [1–405] |
| 15641 | [1–510] | 15701 | [1–118] | 16017 | [1–302] | 16067 | [1–516] |
| 15643 | [1–418] | 15702 | [1–502] | 16018 | [1–327] | 16068 | [1–78] |
| 15645 | [1–322] | 15703 | [1–482] | 16019 | [1–359] | 16069 | [1–404] |
| 15646 | [1–316] | 15704 | [1–503] | 16020 | [1–305] | 16070 | [1–399] |
| 15647 | [1–525] | 15705 | [1–503] | 16021 | [1–296] | 16071 | [1–26], [194–482] |
| 15648 | [1–237] | 15706 | [1–401] | 16022 | [1–297] | 16073 | [1–75], [131–500] |
| 15649 | [1–72], [184–241], [283–353] | 15707 | [1–67], [109–211] | 16023 | [1–279] | 16075 | [1–470] |
| | | | | 16024 | [1–326] | 16076 | [1–219], [303–328] |
| 15650 | [1–526] | 15711 | [1–106] | 16025 | [1–102] | 16077 | [1–191] |
| 15651 | [1–43] | 15715 | [1–456] | 16026 | [1–347] | 16078 | [1–357] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16027 | [1–324] | 16079 | [1–430] | 16224 | [1–585] | 16289 | [1–200] |
| 16028 | [1–315] | 16080 | [1–265] | 16225 | [1–112] | 16290 | [1–198] |
| 16029 | [1–282] | 16081 | [1–104], [375–415] | 16226 | [1–184], [220–299] | 16291 | [1–249] |
| 16030 | [1–307] | 16082 | [1–104], [375–415] | 16227 | [1–184], [220–300] | 16292 | [1–249] |
| 16031 | [1–332] | 16084 | [1–52] | 16228 | [1–409] | 16293 | [1–222] |
| 16032 | [1–333] | 16085 | [1–388] | 16229 | [1–416] | 16294 | [1–259] |
| 16033 | [1–297] | 16087 | [1–499] | 16230 | [1–516] | 16295 | [1–217] |
| 16034 | [1–281] | 16088 | [1–314] | 16231 | [1–483] | 16296 | [1–363] |
| 16035 | [1–306] | 16089 | [1–529] | 16232 | [1–385] | 16297 | [1–575] |
| 16036 | [1–526] | 16090 | [1–165] | 16233 | [1–56], [128–161] | 16298 | [1–319] |
| 16093 | [1–109] | 16147 | [1–410] | 16234 | [1–56], [108–182] | 16299 | [1–491] |
| 16094 | [1–572] | 16149 | [1–393] | 16236 | [1–598] | 16300 | [1–474] |
| 16096 | [258–288] | 16150 | [1–434] | 16237 | [1–249] | 16301 | [294–449] |
| 16098 | [1–556] | 16151 | [1–353] | 16238 | [1–124] | 16302 | [1–585] |
| 16099 | [257–304] | 16152 | [1–110] | 16239 | [1–87] | 16303 | [1–348] |
| 16100 | [257–331] | 16153 | [1–559] | 16240 | [1–122] | 16304 | [1–114] |
| 16102 | [1–104] | 16154 | [1–193] | 16241 | [1–317] | 16305 | [1–32], [211–300] |
| 16103 | [1–470] | 16155 | [1–498] | 16242 | [1–97] | 16306 | [1–34] |
| 16104 | [1–569] | 16156 | [1–72] | 16243 | [1–502] | 16307 | [1–275] |
| 16105 | [1–351] | 16157 | [1–512] | 16244 | [164–401] | 16308 | [193–457] |
| 16106 | [1–517] | 16158 | [1–476] | 16245 | [1–496] | 16309 | [1–55], [147–176] |
| 16108 | [1–272] | 16159 | [1–523] | 16246 | [1–337] | 16311 | [1–655] |
| 16109 | [1–255] | 16160 | [1–157] | 16248 | [1–57], [88–153] | 16314 | [1–415] |
| 16110 | [1–233] | 16161 | [1–201] | 16249 | [1–63] | 16317 | [161–231] |
| 16111 | [1–271] | 16162 | [1–202] | 16251 | [1–63] | 16320 | [162–242] |
| 16115 | [82–146] | 16163 | [1–201] | 16252 | [1–111] | 16324 | [161–242] |
| 16116 | [1–485] | 16164 | [1–201] | 16258 | [175–369] | 16327 | [1–141], [527–587] |
| 16117 | [1–528] | 16165 | [1–201] | 16260 | [1–56] | 16328 | [1–142], [528–559] |
| 16118 | [1–530] | 16166 | [1–200] | 16263 | [1–322] | 16329 | [1–489] |
| 16119 | [1–740] | 16167 | [1–202] | 16265 | [1–490] | 16331 | [1–29] |
| 16120 | [1–327] | 16168 | [1–527] | 16332 | [1–231], [290–504] | 16390 | [1–53], [325–440] |
| 16121 | [1–395] | 16170 | [1–409] | 16333 | [1–146] | 16391 | [1–456] |
| 16122 | [1–281] | 16171 | [1–36], [397–492] | 16334 | [1–487] | 16392 | [1–407] |
| 16123 | [1–45] | 16172 | [332–395] | 16335 | [1–204] | 16393 | [1–406] |
| 16124 | [1–120], [270–512] | 16173 | [1–479] | 16336 | [1–442] | 16394 | [1–376] |
| 16125 | [1–313] | 16178 | [1–531] | 16337 | [1–513] | 16395 | [1–449] |
| 16126 | [1–418] | 16180 | [1–404], [439–494] | 16338 | [1–205] | 16398 | [1–419] |
| 16127 | [1–151], [192–293] | 16181 | [1–196] | 16339 | [1–212] | 16399 | [116–508] |
| 16128 | [1–151], [192–326] | 16184 | [1–409] | 16340 | [1–241] | 16400 | [49–95], [132–433] |
| 16129 | [1–151], [192–319] | 16185 | [368–413] | 16341 | [1–216] | 16401 | [1–166], [365–848] |
| 16130 | [1–151], [188–301] | 16186 | [1–431] | 16342 | [1–210] | 16403 | [1–421] |
| 16131 | [1–151], [192–276] | 16188 | [308–405] | 16343 | [1–219] | 16404 | [60–496] |
| 16132 | [1–151], [192–306] | 16191 | [1–477] | 16344 | [1–229] | 16405 | [1–432] |
| 16133 | [1–151], [192–310] | 16192 | [1–488] | 16345 | [1–221] | 16407 | [1–180] |
| 16134 | [1–151], [192–310] | 16193 | [1–211] | 16346 | [1–239] | 16409 | [193–222] |
| 16135 | [1–151], [192–280] | 16194 | [1–112] | 16347 | [1–314] | 16410 | [1–569] |
| 16136 | [1–151], [192–347] | 16195 | [1–447] | 16348 | [1–499] | 16411 | [1–526] |
| 16137 | [1–151], [192–348] | 16196 | [1–493] | 16349 | [1–306] | 16412 | [1–372] |
| 16138 | [1–151], [192–351] | 16197 | [1–369] | 16350 | [1–447] | 16413 | [1–109] |
| 16139 | [1–151], [192–300] | 16198 | [1–441] | 16351 | [1–107], [230–304] | 16414 | [1–423] |
| 16140 | [1–151], [192–351] | 16199 | [1–478] | 16356 | [1–534] | 16415 | [1–402] |
| 16141 | [1–151], [192–273] | 16200 | [1–435] | 16358 | [1–473] | 16416 | [1–442] |
| 16142 | [1–274] | 16201 | [1–451] | 16359 | [1–494] | 16417 | [1–442] |
| 16143 | [1–151], [192–328] | 16202 | [1–492] | 16360 | [1–432] | 16418 | [1–395] |
| 16144 | [1–151], [192–328] | 16203 | [1–364] | 16361 | [1–281] | 16419 | [1–400] |
| 16145 | [1–151], [192–354] | 16204 | [1–146] | 16362 | [1–97] | 16420 | [1–403] |
| 16146 | [1–479] | 16205 | [1–467] | 16363 | [1–506] | 16421 | [1–371] |
| 16206 | [1–463] | 16266 | [1–353] | 16364 | [1–457] | 16422 | [1–392] |
| 16207 | [1–430] | 16267 | [1–461] | 16365 | [144–438] | 16423 | [1–464] |
| 16208 | [1–444] | 16268 | [196–451] | 16366 | [184–260] | 16424 | [1–413] |
| 16209 | [1–453] | 16269 | [1–430] | 16368 | [1–391] | 16425 | [1–193] |
| 16210 | [84–204] | 16273 | [1–450] | 16369 | [116–205] | 16426 | [1–317] |
| 16211 | [1–393] | 16274 | [1–337] | 16370 | [219–478] | 16427 | [183–504] |
| 16212 | [1–343] | 16277 | [1–263], [296–339] | 16371 | [1–406] | 16428 | [1–317] |
| 16213 | [1–404] | 16278 | [1–454] | 16373 | [1–515] | 16429 | [1–295] |
| 16214 | [1–478] | 16279 | [1–459] | 16374 | [1–495] | 16430 | [1–319] |
| 16215 | [1–478] | 16280 | [1–422] | 16375 | [1–436] | 16431 | [1–294] |
| 16216 | [1–363] | 16281 | [1–268] | 16376 | [1–441] | 16432 | [1–293] |
| 16217 | [1–322] | 16282 | [1–506] | 16380 | [1–400] | 16433 | [1–292] |
| 16218 | [1–359] | 16283 | [1–51] | 16381 | [1–167] | 16434 | [1–334] |
| 16219 | [1–348] | 16284 | [80–441] | 16382 | [1–82] | 16435 | [1–298] |
| 16220 | [1–536] | 16285 | [453–492] | 16383 | [1–497] | 16436 | [1–139] |
| 16221 | [1–291] | 16287 | [205–512] | 16385 | [1–41] | 16437 | [1–379] |
| 16222 | [1–493] | 16288 | [1–246] | 16386 | [466–490] | 16438 | [1–384] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16387 | [1–391] | 16439 | [1–301], [330–505] | 16588 | [228–381] | 16639 | [1–367] |
| 16388 | [1–490] | 16440 | [1–374] | 16589 | [1–499] | 16640 | [1–180] |
| 16389 | [80–161] | 16441 | [1–474] | 16590 | [1–421] | 16642 | [1–464] |
| 16442 | [1–61] | 16502 | [1–429] | 16591 | [1–515] | 16643 | [1–67] |
| 16444 | [1–492] | 16503 | [1–61] | 16592 | [1–506] | 16644 | [1–348] |
| 16445 | [349–388] | 16504 | [1–305] | 16593 | [124–187] | 16645 | [1–414] |
| 16446 | [1–485] | 16505 | [1–439] | 16594 | [1–62] | 16646 | [1–293] |
| 16447 | [1–106], [203–240] | 16506 | [267–436] | 16595 | [1–510] | 16647 | [1–29] |
| 16448 | [1–489] | 16507 | [1–555] | 16596 | [1–422] | 16648 | [1–466] |
| 16449 | [1–122] | 16508 | [1–477] | 16597 | [1–574] | 16649 | [1–359] |
| 16450 | [47–71], [122–274] | 16509 | [1–362] | 16598 | [1–355] | 16650 | [1–381] |
| 16459 | [1–166], [251–374] | 16510 | [1–169] | 16599 | [1–404] | 16651 | [1–516] |
| 16460 | [1–198], [332–384] | 16511 | [58–509] | 16602 | [1–275] | 16652 | [1–436] |
| 16461 | [1–270], [390–467] | 16514 | [1–193] | 16603 | [1–343] | 16653 | [1–518] |
| 16462 | [1–495] | 16515 | [1–198] | 16604 | [1–468] | 16655 | [1–367] |
| 16464 | [1–473] | 16516 | [1–197] | 16605 | [1–72] | 16656 | [1–430] |
| 16465 | [1–441] | 16517 | [1–403] | 16606 | [1–399] | 16657 | [1–405], [805–837] |
| 16466 | [1–489] | 16519 | [1–382] | 16607 | [1–352] | 16659 | [1–457] |
| 16468 | [49–131] | 16520 | [1–465] | 16608 | [1–348] | 16660 | [1–188] |
| 16470 | [1–392] | 16521 | [197–287] | 16609 | [1–377] | 16661 | [1–475] |
| 16472 | [1–113] | 16522 | [47–76] | 16610 | [1–224] | 16662 | [1–250] |
| 16473 | [1–462] | 16524 | [1–110] | 16611 | [1–276] | 16663 | [1–187] |
| 16474 | [1–252] | 16525 | [1–413] | 16612 | [1–440] | 16664 | [1–130] |
| 16475 | [226–448] | 16526 | [1–358] | 16665 | [1–347] | 16725 | [1–373] |
| 16476 | [1–82] | 16528 | [1–59], [250–439] | 16666 | [1–488] | 16726 | [1–481] |
| 16477 | [1–98], [129–162] | 16529 | [1–430] | 16667 | [1–528] | 16727 | [1–339] |
| 16478 | [1–119] | 16530 | [1–59], [250–470] | 16668 | [1–472] | 16728 | [1–492] |
| 16479 | [1–95] | 16531 | [1–59], [250–466] | 16669 | [1–435] | 16729 | [1–37], [291–381] |
| 16480 | [1–104] | 16533 | [1–422] | 16672 | [455–479] | 16731 | [1–46] |
| 16481 | [1–134] | 16534 | [1–159] | 16674 | [1–527] | 16732 | [1–48] |
| 16482 | [1–93] | 16535 | [1–193] | 16675 | [1–395] | 16733 | [1–166], [202–316] |
| 16483 | [1–94], [125–154] | 16536 | [1–213] | 16676 | [1–398], [440–609] | 16734 | [1–110] |
| 16484 | [1–441] | 16537 | [1–194] | 16677 | [1–387] | 16736 | [1–298] |
| 16485 | [1–108] | 16538 | [1–185] | 16678 | [1–394] | 16737 | [1–527] |
| 16486 | [1–94], [125–154] | 16539 | [1–187] | 16679 | [1–216] | 16738 | [103–128] |
| 16487 | [1–92] | 16540 | [1–190] | 16680 | [1–113] | 16740 | [119–146] |
| 16488 | [1–568] | 16541 | [1–165] | 16681 | [1–531] | 16741 | [1–292] |
| 16489 | [1–297] | 16542 | [1–188] | 16682 | [1–571] | 16742 | [1–565] |
| 16490 | [1–419] | 16543 | [1–168] | 16685 | [85–112] | 16744 | [1–432] |
| 16491 | [1–297] | 16544 | [1–410] | 16686 | [85–146] | 16745 | [1–536] |
| 16492 | [1–298] | 16545 | [1–173] | 16688 | [85–145] | 16746 | [1–157] |
| 16493 | [1–189] | 16546 | [1–191] | 16689 | [85–120] | 16747 | [1–461] |
| 16494 | [1–296] | 16547 | [1–168] | 16690 | [86–118] | 16748 | [1–474] |
| 16495 | [1–297] | 16548 | [1–170] | 16691 | [85–145] | 16749 | [1–503] |
| 16496 | [1–298] | 16549 | [1–442] | 16692 | [85–164] | 16750 | [1–530] |
| 16497 | [1–513] | 16550 | [1–96], [179–235] | 16694 | [85–111] | 16751 | [446–625], [753–794] |
| 16498 | [1–513] | 16551 | [1–96] | 16695 | [85–146] | 16753 | [1–260] |
| 16499 | [1–503] | 16552 | [1–95] | 16696 | [86–127] | 16754 | [1–137], [359–488] |
| 16500 | [1–503] | 16553 | [1–95] | 16698 | [1–472] | 16755 | [49–431] |
| 16501 | [1–503] | 16554 | [1–44], [189–539] | 16699 | [357–498] | 16757 | [1–248] |
| 16555 | [1–96] | 16613 | [1–467] | 16700 | [1–513] | 16759 | [102–180] |
| 16556 | [1–95], [178–231] | 16614 | [466–523] | 16701 | [1–155] | 16760 | [1–112], [154–191] |
| 16557 | [1–96], [179–234] | 16615 | [1–55], [410–439] | 16702 | [1–498] | 16761 | [1–525] |
| 16558 | [1–95] | 16616 | [1–434] | 16703 | [1–39], [84–241] | 16762 | [1–514] |
| 16559 | [1–95], [178–233] | 16617 | [1–298] | 16704 | [1–481] | 16763 | [1–474] |
| 16560 | [1–472] | 16618 | [1–469] | 16706 | [379–408] | 16764 | [1–247], [325–498] |
| 16561 | [1–903] | 16619 | [1–111] | 16707 | [1–48] | 16770 | [1–358] |
| 16562 | [41–436] | 16620 | [1–116] | 16710 | [377–413] | 16771 | [1–412] |
| 16563 | [37–75] | 16621 | [1–96] | 16711 | [377–430] | 16772 | [1–542] |
| 16564 | [1–79] | 16622 | [248–431] | 16712 | [379–425] | 16774 | [1–256] |
| 16565 | [1–222] | 16623 | [1–60] | 16714 | [378–407] | 16775 | [1–115], [184–237] |
| 16567 | [1–112] | 16624 | [1–458] | 16715 | [1–443] | 16776 | [1–33] |
| 16569 | [1–161] | 16625 | [1–488] | 16716 | [155–260] | 16777 | [1–114], [183–253] |
| 16570 | [1–186] | 16626 | [1–90], [178–225] | 16717 | [146–176] | 16778 | [1–30], [109–135] |
| 16571 | [134–333], [393–445] | 16628 | [81–334] | 16718 | [1–527] | 16779 | [1–30], [110–185] |
| 16572 | [1–461] | 16629 | [209–325] | 16719 | [94–303] | 16780 | [1–30], [109–134] |
| 16573 | [178–222] | 16630 | [1–381] | 16720 | [1–488] | 16781 | [1–30], [109–157] |
| 16574 | [1–410] | 16631 | [1–340] | 16722 | [1–36], [98–214] | 16782 | [1–129] |
| 16575 | [1–471] | 16632 | [192–239] | 16723 | [1–485] | 16783 | [1–30], [109–140] |
| 16581 | [1–256], [295–356] | 16633 | [1–99], [164–194] | 16724 | [1–458] | 16784 | [1–30], [109–190] |
| 16582 | [1–382] | 16634 | [1–182] | 16785 | [1–30], [109–139] | 16840 | [1–515] |
| 16584 | [1–110] | 16635 | [1–399] | 16786 | [1–30], [109–140] | 16841 | [1–343] |
| 16585 | [1–447] | 16636 | [1–109] | 16787 | [1–26] | 16842 | [1–460] |
| 16586 | [57–157] | 16637 | [1–443] | 16788 | [1–26] | 16843 | [1–109] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16789 | [1–111] | 16844 | [1–262] | 16954 | [215–253] | 17076 | [1–487] |
| 16790 | [106–480] | 16845 | [1–501] | 16958 | [216–242] | 17077 | [215–253] |
| 16792 | [1–52] | 16846 | [1–471] | 16965 | [208–293] | 17084 | [1–418] |
| 16794 | [1–482] | 16848 | [1–432] | 16972 | [216–243] | 17085 | [1–249] |
| 16795 | [1–429] | 16849 | [1–495] | 16973 | [215–241] | 17086 | [1–513] |
| 16796 | [1–44] | 16851 | [1–843] | 16974 | [215–244] | 17088 | [1–308] |
| 16797 | [1–51] | 16852 | [1–449] | 16975 | [216–243] | 17089 | [1–487] |
| 16798 | [1–108] | 16855 | [1–181], [234–517] | 16978 | [215–253] | 17090 | [1–370] |
| 16799 | [1–176] | 16856 | [1–275] | 16981 | [215–242] | 17091 | [1–30] |
| 16800 | [1–134] | 16857 | [1–66], [211–478] | 16983 | [213–277] | 17093 | [1–508] |
| 16801 | [1–175] | 16859 | [1–436] | 16986 | [216–242] | 17094 | [1–54] |
| 16802 | [1–175] | 16860 | [1–419] | 16987 | [215–253] | 17095 | [185–235] |
| 16803 | [1–174] | 16861 | [287–445] | 16988 | [213–256] | 17096 | [185–261] |
| 16804 | [1–175] | 16862 | [182–236] | 16989 | [215–283] | 17098 | [1–72] |
| 16805 | [1–214] | 16863 | [1–430] | 16990 | [216–241] | 17099 | [1–449] |
| 16806 | [1–241] | 16864 | [1–57], [329–436] | 16991 | [215–254] | 17100 | [1–710] |
| 16807 | [1–175] | 16865 | [1–400] | 17101 | [1–482] | 17158 | [1–478], [534–576] |
| 16808 | [1–207], [241–447] | 16866 | [1–302] | 17103 | [1–434] | 17159 | [72–441] |
| 16811 | [1–528] | 16868 | [1–122] | 17104 | [1–442] | 17160 | [75–502] |
| 16812 | [1–190] | 16869 | [1–156] | 17106 | [1–92] | 17162 | [1–416] |
| 16813 | [1–266] | 16870 | [1–168] | 17107 | [1–246], [326–477] | 17163 | [1–520] |
| 16814 | [1–214] | 16871 | [1–182] | 17108 | [1–411] | 17165 | [1–59] |
| 16815 | [1–55], [196–574] | 16872 | [1–179] | 17109 | [1–332] | 17168 | [1–473] |
| 16816 | [1–34], [351–506] | 16873 | [1–233] | 17110 | [1–139] | 17169 | [1–396] |
| 16817 | [1–455] | 16874 | [1–461] | 17112 | [1–184] | 17170 | [1–506] |
| 16820 | [1–524] | 16878 | [1–583] | 17113 | [1–510] | 17171 | [1–564] |
| 16821 | [1–559] | 16879 | [1–209] | 17116 | [1–136] | 17172 | [1–431] |
| 16822 | [1–504] | 16880 | [1–25] | 17117 | [1–91] | 17173 | [1–407] |
| 16823 | [310–498] | 16881 | [1–602] | 17118 | [1–59] | 17174 | [1–347] |
| 16824 | [1–35], [207–238] | 16882 | [1–424] | 17119 | [1–426] | 17175 | [223–477] |
| 16825 | [1–307] | 16883 | [1–313] | 17120 | [1–374] | 17176 | [1–853] |
| 16826 | [1–296], [351–448] | 16885 | [1–514] | 17121 | [1–255], [370–471] | 17177 | [41–68] |
| 16827 | [1–319] | 16886 | [1–268], [439–470] | 17122 | [1–452] | 17179 | [1–571] |
| 16828 | [325–499] | 16887 | [1–566] | 17124 | [1–426] | 17180 | [1–165] |
| 16829 | [1–476] | 16890 | [381–431] | 17125 | [1–562] | 17181 | [1–433] |
| 16831 | [1–310] | 16891 | [1–69] | 17126 | [120–173] | 17182 | [1–159] |
| 16832 | [1–349] | 16894 | [1–513] | 17127 | [1–505] | 17183 | [1–109] |
| 16833 | [1–140] | 16895 | [43–496] | 17128 | [1–379] | 17184 | [1–137] |
| 16834 | [1–141] | 16896 | [1–370] | 17129 | [1–415] | 17185 | [1–110] |
| 16835 | [1–291] | 16898 | [63–120], [203–540] | 17130 | [1–547] | 17186 | [1–354] |
| 16836 | [1–267] | 16899 | [33–337], [368–473] | 17133 | [1–371] | 17187 | [1–339] |
| 16837 | [1–459] | 16900 | [1–681] | 17134 | [1–510] | 17188 | [1–323] |
| 16839 | [1–526] | 16901 | [1–368] | 17135 | [1–476] | 17189 | [1–491] |
| 16902 | [1–50], [89–576] | 16993 | [216–242] | 17136 | [1–474] | 17190 | [278–375] |
| 16903 | [1–366] | 16997 | [216–242] | 17137 | [1–447] | 17191 | [1–450] |
| 16904 | [1–73] | 17000 | [70–372] | 17138 | [1–346] | 17192 | [1–460], [492–527] |
| 16905 | [1–527] | 17005 | [216–241] | 17139 | [1–503] | 17193 | [1–443] |
| 16906 | [1–431] | 17008 | [216–243] | 17140 | [1–374] | 17194 | [1–519] |
| 16907 | [1–451] | 17010 | [213–241] | 17142 | [1–30] | 17195 | [1–261] |
| 16908 | [1–449] | 17011 | [93–474] | 17143 | [1–169] | 17196 | [1–348] |
| 16909 | [1–349] | 17015 | [216–242] | 17144 | [1–101] | 17197 | [1–565] |
| 16910 | [1–40] | 17016 | [215–240] | 17145 | [1–144] | 17199 | [1–430] |
| 16911 | [1–435] | 17019 | [215–254] | 17146 | [1–149] | 17201 | [1–401] |
| 16912 | [1–98], [141–472] | 17022 | [215–253] | 17147 | [1–147] | 17202 | [1–364] |
| 16913 | [1–96], [139–439] | 17030 | [216–242] | 17148 | [1–144] | 17203 | [1–414] |
| 16914 | [1–449] | 17032 | [1–491} | 17149 | [1–146] | 17204 | [1–398] |
| 16915 | [1–510] | 17033 | [215–254] | 17150 | [1–505] | 17205 | [1–78], [235–369] |
| 16916 | [1–193] | 17039 | [216–247] | 17151 | [1–149] | 17206 | [1–225], [258–465] |
| 16917 | [106–503] | 17042 | [216–242] | 17152 | [1–26] | 17207 | [1–580] |
| 16918 | [1–445] | 17043 | [1–75], [158–487] | 17154 | [1–498] | 17208 | [1–450] |
| 16919 | [1–505] | 17046 | [216–242] | 17155 | [1–449] | 17209 | [1–510] |
| 16921 | [1–491] | 17047 | [215–241] | 17156 | [1–43] | 17210 | [1–478] |
| 16922 | [1–526] | 17048 | [214–253] | 17157 | [1–515] | 17211 | [1–54] |
| 16923 | [1–531] | 17049 | [215–270] | 17212 | [103–447] | 17278 | [1–486] |
| 16924 | [1–154] | 17053 | [216–245] | 17213 | [1–373] | 17279 | [1–421] |
| 16932 | [215–272] | 17054 | [1–500] | 17214 | [1–423] | 17280 | [1–524] |
| 16933 | [214–266] | 17056 | [215–253] | 17215 | [1–129], [251–404] | 17281 | [1–448] |
| 16936 | [213–269] | 17063 | [215–253] | 17216 | [1–246], [389–439] | 17283 | [68–111] |
| 16940 | [1–51] | 17064 | [217–256] | 17217 | [1–38], [264–432] | 17284 | [1–499] |
| 16942 | [216–243] | 17066 | [216–242] | 17219 | [1–400] | 17285 | [62–512] |
| 16946 | [215–253] | 17067 | [217–261] | 17220 | [1–136] | 17286 | [1–53] |
| 16947 | [1–528] | 17071 | [217–241] | 17221 | [1–112], [173–565] | 17287 | [1–246], [298–369] |
| 16950 | [215–250] | 17073 | [216–242] | 17222 | [1–112], [173–571] | 17288 | [1–510] |
| 16952 | [216–242] | 17074 | [215–253] | 17223 | [1–94], [154–362] | 17289 | [1–460] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 17225 | [1–285] | 17290 | [1–559] | 17366 | [1–87] | 17425 | [507–578] |
| 17226 | [1–462] | 17291 | [1–450] | 17367 | [1–76], [105–287], [331–437] | 17429 | [1–249] |
| 17227 | [1–126] | 17292 | [1–415] | 17368 | [1–460] | 17431 | [89–391] |
| 17228 | [1–377] | 17293 | [1–471] | 17370 | [1–443] | 17432 | [1–427] |
| 17229 | [318–382] | 17294 | [1–403] | 17371 | [162–250] | 17433 | [1–391] |
| 17232 | [1–391] | 17295 | [1–217] | 17372 | [1–50] | 17435 | [1–448] |
| 17233 | [1–387] | 17296 | [1–344] | 17373 | [1–502] | 17436 | [1–128], [239–353] |
| 17236 | [1–76] | 17297 | [1–330] | 17375 | [1–501] | 17437 | [1–81] |
| 17239 | [1–276] | 17298 | [1–488] | 17376 | [1–52], [407–434] | 17438 | [1–507] |
| 17240 | [1–324] | 17299 | [1–438] | 17377 | [1–441] | 17439 | [1–43], [212–447] |
| 17241 | [103–229], [272–455], [493–523] | 17301 | [61–93] | 17378 | [1–208], [420–504] | 17440 | [1–383] |
| 17242 | [1–329] | 17302 | [1–209] | 17379 | [1–111] | 17441 | [193–404] |
| 17243 | [1–510] | 17303 | [1–235] | 17382 | [1–148], [440–488] | 17442 | [1–131] |
| 17244 | [1–468] | 17304 | [1–348] | 17383 | [1–317] | 17443 | [1–349] |
| 17246 | [1–198], [236–318] | 17305 | [1–456] | 17384 | [1–316] | 17444 | [1–118] |
| 17247 | [261–311] | 17306 | [1–442] | 17445 | [1–471] | 17497 | [1–281] |
| 17248 | [1–199] | 17307 | [129–223] | 17446 | [1–141] | 17498 | [1–521] |
| 17249 | [254–457] | 17308 | [1–137] | 17447 | [1–148] | 17499 | [1–403] |
| 17251 | [1–37], [68–274] | 17309 | [51–149] | 17448 | [1–159] | 17502 | [67–137] |
| 17253 | [1–560] | 17313 | [101–181] | 17449 | [1–140] | 17503 | [67–126] |
| 17254 | [1–433] | 17314 | [1–471] | 17450 | [1–148] | 17504 | [1–492] |
| 17256 | [1–26], [143–722] | 17315 | [188–412] | 17451 | [1–153] | 17506 | [1–92] |
| 17257 | [379–447] | 17316 | [1–520] | 17452 | [1–144] | 17507 | [1–530] |
| 17260 | [1–480] | 17318 | [1–84] | 17453 | [1–131] | 17508 | [1–47], [402–446] |
| 17262 | [1–536] | 17319 | [1–173], [203–526] | 17454 | [1–129] | 17509 | [1–514] |
| 17263 | [1–466] | 17320 | [1–250] | 17455 | [1–130] | 17510 | [1–120] |
| 17265 | [1–489] | 17321 | [90–490] | 17456 | [1–346] | 17511 | [1–522] |
| 17266 | [1–472] | 17322 | [90–222] | 17457 | [1–140] | 17512 | [1–546] |
| 17267 | [1–334], [366–544] | 17323 | [1–425] | 17458 | [1–596] | 17513 | [181–483] |
| 17268 | [1–25], [84–199], [237–287], [415–443], [478–555] | 17324 | [1–498] | 17459 | [1–478] | 17515 | [144–490] |
| 17269 | [1–25], [84–394], [434–586] | 17325 | [1–517] | 17460 | [1–434] | 17516 | [1–444] |
| | | 17326 | [1–396] | 17461 | [1–454] | 17517 | [1–492] |
| 17272 | [173–264] | 17327 | [1–542] | 17462 | [1–364] | 17518 | [1–578] |
| 17274 | [1–321] | 17328 | [1–77], [111–207], [247–441] | 17463 | [1–477] | 17519 | [1–512] |
| | | | | 17464 | [1–874] | 17520 | [1–104] |
| 17275 | [1–473] | 17329 | [1–541] | 17465 | [80–147], [323–424] | 17521 | [1–567] |
| 17277 | [1–28] | 17330 | [1–334], [1375–1425] | 17467 | [144–176] | 17522 | [1–561] |
| | | | | 17468 | [1–521] | 17524 | [109–160] |
| | | | | 17469 | [1–29] | 17525 | [1–580] |
| | | | | 17470 | [1–73] | 17526 | [1–514] |
| 17331 | [1–346] | 17385 | [52–149] | 17472 | [1–113] | 17527 | [1–487] |
| 17332 | [1–492] | 17386 | [80–355], [400–481] | 17474 | [1–440] | 17528 | [1–209] |
| 17333 | [1–447] | 17388 | [1–318] | 17475 | [1–339], [368–460] | 17530 | [1–425] |
| 17334 | [1–499] | 17389 | [1–304] | 17476 | [1–318] | 17532 | [1–236] |
| 17335 | [1–437] | 17390 | [1–232] | 17477 | [1–67] | 17533 | [1–349] |
| 17336 | [1–275], [304–411] | 17391 | [1–28] | 17478 | [1–55] | 17534 | [1–485] |
| 17337 | [1–447] | 17392 | [1–27] | 17479 | [1–135], [333–536] | 17535 | [1–243] |
| 17338 | [1–169] | 17394 | [1–579] | 17480 | [1–132], [278–416] | 17536 | [1–352] |
| 17339 | [1–354], [384–481] | 17395 | [1–48] | 17481 | [461–523] | 17539 | [1–544] |
| 17340 | [1–536] | 17396 | [113–464] | 17483 | [1–33] | 17540 | [1–394] |
| 17343 | [1–301] | 17398 | [1–457] | 17484 | [1–491] | 17542 | [1–97], [172–481] |
| 17344 | [1–249] | 17399 | [157–532] | 17485 | [1–470] | 17543 | [1–400] |
| 17345 | [1–341] | 17400 | [1–493] | 17486 | [1–490] | 17544 | [1–468] |
| 17346 | [1–417] | 17401 | [1–35], [64–560] | 17487 | [1–415] | 17546 | [1–502] |
| 17347 | [1–347] | 17402 | [1–33], [213–620] | 17488 | [1–508], [538–612] | 17547 | [1–293] |
| 17348 | [1–116], [224–251], [427–672] | 17403 | [1–412] | 17489 | [1–432] | 17548 | [412–437] |
| | | | | 17491 | [1–362] | 17549 | [37–405] |
| | | | | 17492 | [1–250] | 17550 | [1–460] |
| 17349 | [1–333], [447–543] | 17407 | [1–26] | 17493 | [1–115], [144–382] | 17551 | [1–393] |
| 17350 | [233–257] | 17408 | [1–375] | 17494 | [1–467] | 17553 | [1–432] |
| 17352 | [1–476] | 17410 | [1–321] | 17495 | [1–407] | 17555 | [1–378] |
| 17353 | [313–414] | 17411 | [1–398] | 17496 | [1–483] | 17558 | [1–126], [316–369] |
| 17354 | [1–502] | 17412 | [1–240] | 17559 | [1–250] | 17619 | [1–192] |
| 17355 | [1–402] | 17413 | [1–223] | 17560 | [1–822] | 17620 | [1–462] |
| 17356 | [142–507] | 17414 | [1–225] | 17561 | [1–424] | 17621 | [1–597] |
| 17357 | [1–291] | 17415 | [1–228] | 17562 | [1–433] | 17622 | [1–33] |
| 17358 | [1–503] | 17416 | [1–225] | 17563 | [1–40], [82–260] | 17624 | [1–81], [219–243] |
| 17359 | [1–482] | 17417 | [1–225] | 17564 | [1–435] | 17625 | [1–81] |
| 17360 | [1–94], [126–483] | 17418 | [1–224] | 17565 | [1–284] | 17626 | [1–81], [219–279] |
| 17361 | [1–468] | 17419 | [1–225] | 17566 | [1–224], [321–390] | 17627 | [1–367] |
| 17362 | [1–136] | 17420 | [1–225] | 17567 | [1–325] | 17629 | [1–388] |
| 17363 | [1–535] | 17421 | [1–225] | 17568 | [1–442] | 17630 | [1–381] |
| 17364 | [1–416] | 17422 | [1–225] | 17569 | [1–111], [141–247] | 17631 | [1–443] |
| 17365 | [1–472] | 17423 | [1–224] | | | | |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 17571 | [1–283] | 17632 | [1–145] | 17723 | [1–35] | 17783 | [1–469] |
| 17572 | [1–213] | 17633 | [65–510] | 17725 | [1–497] | 17784 | [1–146] |
| 17573 | [1–70] | 17634 | [1–471] | 17726 | [1–60] | 17785 | [1–481] |
| 17574 | [1–1157] | 17635 | [1–226] | 17727 | [1–406] | 17787 | [1–483] |
| 17576 | [1–421] | 17636 | [162–461] | 17731 | [1–438] | 17788 | [1–433] |
| 17577 | [1–554] | 17637 | [1–340] | 17732 | [1–33] | 17789 | [282–343] |
| 17578 | [130–183] | 17638 | [215–518] | 17734 | [1–486] | 17791 | [73–501] |
| 17579 | [105–253] | 17639 | [1–534] | 17735 | [1–499] | 17792 | [177–383] |
| 17581 | [1–556] | 17640 | [1–667] | 17736 | [1–68] | 17793 | [86–517] |
| 17582 | [1–146], [176–224] | 17641 | [284–351] | 17794 | [1–253] | 17845 | [1–257] |
| 17586 | [1–379] | 17642 | [1–459] | 17795 | [1–419] | 17847 | [202–343] |
| 17587 | [1–472] | 17643 | [1–515] | 17796 | [1–364] | 17848 | [1–86] |
| 17588 | [1–480] | 17645 | [1–64] | 17797 | [32–504] | 17850 | [1–347] |
| 17589 | [1–194] | 17646 | [1–537] | 17798 | [1–50] | 17851 | [1–355] |
| 17590 | [1–364] | 17647 | [1–501] | 17799 | [1–525] | 17853 | [1–562] |
| 17592 | [1–475] | 17648 | [1–159] | 17800 | [1–448] | 17854 | [1–711] |
| 17593 | [341–472] | 17649 | [1–140] | 17801 | [1–506] | 17855 | [1–182] |
| 17594 | [80–116], [287–344] | 17650 | [1–593] | 17802 | [1–459] | 17856 | [399–436] |
| 17595 | [1–503] | 17651 | [1–604] | 17803 | [1–413] | 17857 | [1–405] |
| 17597 | [1–412] | 17652 | [1–333] | 17804 | [1–477] | 17859 | [1–397] |
| 17598 | [1–385] | 17653 | [1–98] | 17805 | [1–426] | 17860 | [1–307] |
| 17599 | [1–639] | 17654 | [1–322] | 17806 | [1–365] | 17861 | [1–344] |
| 17600 | [1–487] | 17655 | [1–396] | 17807 | [1–314] | 17862 | [1–209] |
| 17601 | [1–41], [278–425] | 17656 | [1–487] | 17809 | [1–441] | 17863 | [1–127] |
| 17602 | [1–329] | 17657 | [100–170] | 17810 | [1–66], [297–374] | 17864 | [1–395] |
| 17604 | [1–352] | 17659 | [1–475] | 17811 | [318–435] | 17866 | [1–361] |
| 17605 | [65–435] | 17660 | [1–314] | 17812 | [1–203] | 17867 | [1–408] |
| 17606 | [1–504] | 17663 | [1–399] | 17813 | [1–434] | 17868 | [1–33] |
| 17608 | [223–261] | 17664 | [1–214], [245–404] | 17814 | [1–481] | 17871 | [1–283] |
| 17610 | [223–269] | 17665 | [1–200] | 17815 | [1–573] | 17872 | [1–275] |
| 17611 | [1–345] | 17666 | [1–509] | 17816 | [1–384] | 17873 | [1–470] |
| 17612 | [1–204] | 17667 | [1–483] | 17817 | [93–123] | 17874 | [1–379] |
| 17614 | [1–442] | 17668 | [1–227] | 17819 | [1–355] | 17875 | [1–357] |
| 17615 | [50–99] | 17669 | [1–255] | 17821 | [1–269] | 17876 | [1–442] |
| 17616 | [232–458] | 17670 | [1–286] | 17822 | [160–204] | 17877 | [1–201] |
| 17618 | [1–476] | 17671 | [1–493] | 17823 | [30–81] | 17878 | [1–512] |
| 17672 | [195–382] | 17737 | [1–382] | 17824 | [169–211] | 17879 | [1–420] |
| 17673 | [1–500] | 17738 | [1–512] | 17825 | [1–246] | 17880 | [1–114] |
| 17674 | [1–495] | 17739 | [1–516] | 17826 | [168–193] | 17881 | [1–504] |
| 17675 | [1–435] | 17740 | [1–491] | 17827 | [1–444] | 17882 | [1–636] |
| 17676 | [1–475] | 17741 | [1–362] | 17828 | [1–140], [178–248] | 17883 | [1–472] |
| 17681 | [64–497] | 17742 | [1–502] | 17829 | [1–464] | 17884 | [1–386] |
| 17682 | [64–510] | 17744 | [1–149] | 17831 | [1–388] | 17885 | [1–432] |
| 17683 | [1–160] | 17745 | [1–432] | 17832 | [1–396] | 17886 | [1–508] |
| 17684 | [1–139] | 17746 | [1–459] | 17833 | [211–279], [353–445] | 17888 | [317–429] |
| 17685 | [1–48] | 17747 | [1–97] | 17834 | [1–515] | 17889 | [1–478] |
| 17686 | [1–56] | 17748 | [1–401] | 17835 | [1–364] | 17890 | [1–462] |
| 17688 | [1–491] | 17749 | [1–30] | 17836 | [1–377] | 17891 | [1–183] |
| 17689 | [1–476] | 17750 | [1–206] | 17837 | [1–308] | 17892 | [1–55] |
| 17690 | [1–140], [172–439] | 17751 | [1–495] | 17838 | [1–451] | 17893 | [1–399] |
| 17691 | [1–104], [143–348] | 17753 | [1–163], [280–477] | 17839 | [1–179] | 17897 | [332–448] |
| 17692 | [1–447] | 17756 | [1–211], [332–380] | 17840 | [383–421] | 17898 | [1–484] |
| 17693 | [1–446] | 17757 | [1–286] | 17841 | [1–416] | 17899 | [1–501] |
| 17694 | [1–32] | 17758 | [1–216], [402–517] | 17842 | [1–428] | 17900 | [1–288] |
| 17695 | [1–428] | 17759 | [1–236] | 17843 | [1–186] | 17901 | [1–402] |
| 17696 | [1–59] | 17760 | [1–495] | 17844 | [1–432] | 17902 | [1–380] |
| 17697 | [1–249] | 17761 | [1–522] | 17903 | [1–483] | 17951 | [1–444] |
| 17698 | [1–245] | 17762 | [1–384] | 17904 | [1–258] | 17952 | [44–127], [156–489] |
| 17699 | [1–153] | 17763 | [1–490] | 17905 | [1–453] | 17953 | [1–495] |
| 17700 | [1–531] | 17765 | [1–123], [311–353] | 17906 | [1–435] | 17954 | [1–437] |
| 17701 | [1–203] | 17766 | [1–44], [232–274] | 17907 | [1–299] | 17956 | [1–219] |
| 17703 | [235–387] | 17767 | [1–298] | 17908 | [1–464] | 17957 | [90–487] |
| 17705 | [1–354], [390–474] | 17768 | [1–210] | 17909 | [1–295] | 17958 | [1–400] |
| 17706 | [1–143] | 17769 | [1–510] | 17910 | [1–447] | 17959 | [1–440] |
| 17707 | [1–536] | 17770 | [1–491] | 17912 | [1–500] | 17960 | [437–478] |
| 17708 | [1–449] | 17771 | [1–455] | 17913 | [1–117] | 17961 | [1–427] |
| 17709 | [1–404] | 17772 | [1–418] | 17914 | [1–107] | 17962 | [1–43] |
| 17711 | [1–489] | 17773 | [1–486] | 17915 | [1–481] | 17963 | [1–43], [108–364] |
| 17712 | [1–566] | 17775 | [1–79] | 17916 | [1–546] | 17964 | [1–43], [108–360] |
| 17713 | [1–220] | 17776 | [1–285] | 17917 | [1–512] | 17965 | [1–43], [108–378] |
| 17714 | [1–483] | 17777 | [1–44] | 17918 | [1–293] | 17966 | [1–43], [108–233] |
| 17717 | [1–32] | 17778 | [1–458] | 17919 | [1–207] | 17967 | [1–468] |
| 17719 | [1–33] | 17781 | [1–348] | 17920 | [1–215] | 17969 | [1–412] |
| 17720 | [1–93] | 17782 | [1–392] | 17921 | [1–246] | 17970 | [1–232] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 17922 | [1–218] | 17971 | [1–68] | 18054 | [1–179] | 18109 | [1–96] |
| 17923 | [1–266] | 17972 | [1–336] | 18055 | [1–74] | 18110 | [1–553] |
| 17924 | [1–241] | 17973 | [1–503] | 18111 | [1–482] | 18185 | [1–203] |
| 17925 | [1–262] | 17974 | [1–472] | 18112 | [1–106], [300–424] | 18189 | [1–249] |
| 17926 | [1–259] | 17975 | [1–324] | 18113 | [1–507] | 18190 | [1–492] |
| 17927 | [1–270] | 17976 | [1–480] | 18115 | [1–497] | 18191 | [1–493] |
| 17928 | [1–217] | 17977 | [1–435] | 18116 | [1–106] | 18192 | [1–296] |
| 17929 | [1–235] | 17978 | [1–387] | 18117 | [1–149] | 18193 | [1–495] |
| 17930 | [1–225] | 17979 | [1–508] | 18119 | [1–346] | 18194 | [1–420] |
| 17931 | [1–248] | 17980 | [1–510] | 18120 | [1–403] | 18195 | [1–266] |
| 17932 | [1–225] | 17981 | [1–464] | 18121 | [1–493] | 18196 | [508–537] |
| 17933 | [1–226] | 17982 | [1–36], [94–442] | 18122 | [1–62] | 18198 | [1–436] |
| 17934 | [1–218] | 17983 | [1–178] | 18123 | [1–101], [182–366] | 18199 | [142–243] |
| 17935 | [1–228] | 17984 | [1–532] | 18124 | [1–69] | 18210 | [1–487] |
| 17936 | [1–241] | 17985 | [1–156], [185–456] | 18125 | [1–372] | 18212 | [1–442] |
| 17937 | [1–242] | 17986 | [1–63] | 18127 | [1–142], [327–488] | 18213 | [1–263] |
| 17938 | [1–247] | 17987 | [1–138] | 18128 | [1–169], [252–292] | 18214 | [33–419] |
| 17939 | [1–243] | 17989 | [1–381] | 18129 | [1–486] | 18218 | [1–555] |
| 17940 | [1–243] | 17991 | [1–387] | 18130 | [1–192] | 18219 | [1–466] |
| 17941 | [1–237] | 17993 | [1–155], [184–439] | 18131 | [1–314] | 18221 | [1–254] |
| 17942 | [1–236] | 17995 | [1–461] | 18132 | [1–191] | 18222 | [1–430] |
| 17943 | [1–248] | 17996 | [1–352] | 18133 | [1–394] | 18223 | [1–505] |
| 17944 | [1–214] | 17997 | [214–287] | 18134 | [42–68] | 18224 | [1–343] |
| 17945 | [1–245] | 17998 | [1–147] | 18135 | [1–174], [301–387] | 18226 | [1–538] |
| 17946 | [1–216] | 17999 | [1–317] | 18136 | [102–143] | 18227 | [1–546] |
| 17947 | [1–225] | 18000 | [1–268] | 18137 | [69–445] | 18228 | [1–409] |
| 17948 | [1–229] | 18001 | [1–372] | 18138 | [1–410] | 18229 | [1–461] |
| 17949 | [1–219] | 18002 | [1–514] | 18139 | [331–356] | 18231 | [211–395] |
| 17950 | [1–520] | 18003 | [1–293] | 18140 | [1–72] | 18232 | [1–71] |
| 18004 | [1–27], [187–510] | 18056 | [98–125] | 18143 | [332–375] | 18235 | [1–418] |
| 18005 | [1–302] | 18058 | [1–153] | 18149 | [330–362] | 18236 | [1–337] |
| 18006 | [107–322] | 18060 | [1–552] | 18151 | [330–365] | 18237 | [1–427] |
| 18007 | [1–431] | 18062 | [1–195] | 18153 | [330–357] | 18238 | [1–457] |
| 18008 | [1–484] | 18063 | [1–174] | 18155 | [330–360] | 18239 | [1–453] |
| 18009 | [1–472] | 18064 | [1–443] | 18160 | [333–361] | 18241 | [1–402] |
| 18010 | [1–198] | 18065 | [1–109] | 18168 | [330–356] | 18242 | [1–413] |
| 18011 | [1–497] | 18066 | [1–160] | 18170 | [397–423] | 18243 | [1–396] |
| 18012 | [1–189] | 18067 | [91–393] | 18171 | [1–46], [328–357] | 18244 | [1–509] |
| 18013 | [1–375] | 18068 | [1–162] | 18172 | [1–86] | 18246 | [1–380], [441–482] |
| 18015 | [1–484] | 18069 | [1–54] | 18173 | [1–331] | 18248 | [1–148] |
| 18016 | [1–442] | 18070 | [1–427] | 18175 | [1–178] | 18249 | [1–383] |
| 18017 | [1–71] | 18071 | [1–160] | 18177 | [1–325] | 18250 | [1–472] |
| 18018 | [1–167] | 18072 | [130–250] | 18178 | [337–498] | 18251 | [1–581] |
| 18019 | [1–174] | 18073 | [1–72], [361–518] | 18179 | [1–353] | 18252 | [1–414] |
| 18020 | [1–278] | 18074 | [1–49] | 18180 | [1–364] | 18253 | [1–429] |
| 18021 | [1–502] | 18075 | [1–120] | 18181 | [1–494] | 18254 | [1–513] |
| 18022 | [1–59] | 18076 | [1–209] | 18182 | [1–363] | 18255 | [1–407] |
| 18025 | [1–341] | 18077 | [144–304] | 18183 | [1–333] | 18256 | [1–153] |
| 18026 | [1–451] | 18078 | [1–422] | 18184 | [1–196] | 18257 | [1–438] |
| 18027 | [1–59], [89–181] | 18079 | [1–33] | 18258 | [1–341] | 18309 | [1–426] |
| 18028 | [1–59], [89–155] | 18080 | [1–458] | 18259 | [1–496] | 18310 | [261–380] |
| 18029 | [1–425] | 18081 | [1–512] | 18260 | [1–467] | 18311 | [1–168] |
| 18031 | [1–521] | 18083 | [63–379], [408–475] | 18261 | [1–577] | 18312 | [1–444] |
| 18032 | [1–424] | 18084 | [1–114] | 18262 | [1–430] | 18313 | [1–452] |
| 18033 | [1–474] | 18085 | [1–41], [87–135] | 18263 | [1–445] | 18314 | [1–422] |
| 18034 | [1–191] | 18086 | [63–273], [307–456] | 18264 | [1–551] | 18315 | [1–362] |
| 18035 | [1–206] | 18088 | [1–407] | 18265 | [1–513] | 18316 | [1–472] |
| 18036 | [1–381] | 18089 | [1–259] | 18266 | [1–546] | 18318 | [1–301] |
| 18037 | [1–208] | 18090 | [1–87] | 18267 | [105–476] | 18319 | [1–590] |
| 18038 | [1–67] | 18091 | [63–270] | 18268 | [76–106] | 18320 | [1–58], [115–478] |
| 18039 | [1–145] | 18092 | [1–480] | 18269 | [1–93] | 18321 | [1–154] |
| 18040 | [1–389] | 18094 | [1–473] | 18270 | [1–270] | 18322 | [1–436] |
| 18041 | [1–245] | 18095 | [1–98] | 18271 | [1–385] | 18323 | [1–517] |
| 18042 | [1–406] | 18096 | [148–193] | 18272 | [1–318] | 18325 | [1–402] |
| 18043 | [1–462] | 18097 | [1–189] | 18273 | [1–387] | 18327 | [1–139] |
| 18045 | [1–86] | 18098 | [1–160], [283–411] | 18274 | [1–108] | 18328 | [1–242] |
| 18046 | [1–433] | 18100 | [1–312] | 18275 | [1–496], [528–557] | 18329 | [1–276] |
| 18047 | [206–400] | 18101 | [41–412] | 18276 | [1–453] | 18330 | [1–261] |
| 18048 | [1–106] | 18102 | [1–63] | 18277 | [1–204] | 18332 | [1–191] |
| 18049 | [1–318] | 18103 | [64–98] | 18278 | [65–371] | 18333 | [1–173] |
| 18050 | [1–363] | 18104 | [1–64] | 18279 | [1–365] | 18334 | [1–98] |
| 18051 | [1–235] | 18105 | [1–104] | 18280 | [1–397] | 18335 | [196–473] |
| 18052 | [1–454] | 18107 | [1–620] | 18282 | [1–438] | 18337 | [1–552] |
| 18053 | [1–477] | 18108 | [1–825] | 18283 | [1–250], [534–559] | 18338 | [1–237] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 18285 | [1–64] | 18340 | [1–161], [562–592] | 18492 | [1–553] | 18542 | [1–400] |
| 18286 | [1–53] | 18341 | [1–413] | 18493 | [164–216] | 18543 | [1–409] |
| 18287 | [78–151] | 18342 | [1–72] | 18494 | [55–101], [290–407] | 18544 | [1–416] |
| 18288 | [1–433] | 18343 | [1–60] | 18495 | [346–384] | 18545 | [1–401] |
| 18289 | [1–219] | 18344 | [1–115] | 18496 | [46–92] | 18546 | [1–402] |
| 18290 | [1–166], [326–368] | 18345 | [1–33], [453–478] | 18497 | [1–469] | 18547 | [1–434] |
| 18291 | [1–184] | 18347 | [1–53] | 18498 | [1–250] | 18548 | [1–509] |
| 18292 | [1–354] | 18348 | [1–51], [370–440] | 18500 | [1–508] | 18549 | [36–61], [255–563] |
| 18293 | [39–159] | 18349 | [1–71] | 18501 | [1–476] | 18550 | [164–457] |
| 18294 | [1–400] | 18350 | [1–544] | 18502 | [1–473] | 18552 | [1–472] |
| 18295 | [162–340] | 18351 | [1–465] | 18503 | [1–445] | 18553 | [1–274] |
| 18296 | [1–465] | 18352 | [1–464] | 18504 | [1–289] | 18554 | [1–121] |
| 18297 | [1–426] | 18353 | [1–238] | 18505 | [1–554] | 18555 | [1–509] |
| 18298 | [1–128] | 18354 | [1–495] | 18506 | [165–446] | 18556 | [1–329], [484–567] |
| 18299 | [1–73], [399–425] | 18355 | [1–503] | 18507 | [448–563] | 18557 | [1–467] |
| 18300 | [1–494] | 18356 | [1–518] | 18509 | [449–505] | 18558 | [1–513] |
| 18302 | [1–108], [161–200] | 18359 | [1–424] | 18510 | [447–510] | 18559 | [1–515] |
| 18303 | [1–519] | 18360 | [1–404] | 18512 | [1–564] | 18560 | [1–511] |
| 18304 | [1–535] | 18364 | [325–389] | 18513 | [1–450] | 18561 | [1–377] |
| 18305 | [1–512] | 18367 | [168–203] | 18514 | [1–523] | 18562 | [1–541] |
| 18306 | [1–438] | 18372 | [1–285] | 18515 | [1–190] | 18563 | [1–378] |
| 18308 | [1–100], [457–503] | 18373 | [1–279] | 18516 | [1–541] | 18564 | [1–427] |
| 18374 | [1–58] | 18430 | [1–427] | 18517 | [1–259] | 18567 | [1–495] |
| 18375 | [103–172] | 18431 | [1–93] | 18518 | [1–513] | 18568 | [1–414] |
| 18376 | [105–202] | 18432 | [78–115] | 18519 | [1–259], [371–416] | 18569 | [1–352] |
| 18378 | [1–460] | 18433 | [78–134] | 18520 | [1–401], [463–487] | 18570 | [1–359] |
| 18379 | [1–55], [173–437] | 18434 | [78–137] | 18521 | [1–401] | 18571 | [1–397] |
| 18380 | [1–492] | 18438 | [1–61] | 18522 | [1–400] | 18572 | [1–359] |
| 18381 | [1–498] | 18440 | [1–230] | 18523 | [1–403] | 18573 | [1–388] |
| 18382 | [149–250] | 18441 | [54–464] | 18524 | [1–406] | 18575 | [1–242] |
| 18384 | [1–103], [134–159] | 18442 | [1–61], [92–142], [181–518] | 18525 | [1–399] | 18576 | [39–160] |
| | | | | 18526 | [1–402] | 18577 | [1–464] |
| 18385 | [1–97] | 18443 | [43–377] | 18527 | [1–404] | 18578 | [1–494] |
| 18388 | [1–450] | 18444 | [38–169], [210–387] | 18528 | [1–400] | 18580 | [53–266] |
| 18389 | [1–485] | 18445 | [1–275] | 18529 | [1–432] | 18581 | [38–507] |
| 18390 | [1–166] | 18446 | [1–278] | 18530 | [1–393] | 18582 | [118–364] |
| 18391 | [1–95] | 18447 | [101–216] | 18531 | [1–400] | 18583 | [1–231], [274–434] |
| 18392 | [1–427] | 18448 | [1–396] | 18532 | [1–407], [469–493] | 18585 | [80–209] |
| 18393 | [1–388] | 18449 | [1–425] | 18533 | [1–404], [466–492] | 18586 | [1–67] |
| 18395 | [1–392] | 18450 | [159–353] | 18534 | [1–401] | 18587 | [1–180] |
| 18396 | [1–348] | 18451 | [159–353] | 18535 | [1–59] | 18588 | [1–193] |
| 18397 | [137–258] | 18452 | [159–260] | 18536 | [1–401] | 18590 | [1–498] |
| 18398 | [199–448] | 18453 | [1–215] | 18537 | [1–403] | 18593 | [1–288] |
| 18399 | [1–439] | 18455 | [1–215] | 18594 | [1–450] | 18657 | [1–727] |
| 18401 | [1–96] | 18456 | [1–215] | 18595 | [52–510] | 18658 | [1–180] |
| 18402 | [1–356] | 18458 | [1–148] | 18596 | [1–422] | 18659 | [1–431] |
| 18403 | [1–137] | 18460 | [1–338] | 18597 | [1–437] | 18661 | [1–209] |
| 18404 | [1–391] | 18461 | [1–107] | 18598 | [1–406] | 18662 | [1–501] |
| 18405 | [1–533] | 18462 | [1–56] | 18599 | [1–64], [125–531] | 18663 | [1–225] |
| 18406 | [1–113] | 18463 | [1–462] | 18600 | [1–516] | 18664 | [37–389] |
| 18407 | [1–187] | 18465 | [1–62], [220–287] | 18601 | [1–249], [279–496] | 18665 | [1–348] |
| 18408 | [1–503] | 18466 | [1–97], [166–398] | 18602 | [1–314] | 18666 | [1–83] |
| 18409 | [1–315] | 18467 | [1–392] | 18603 | [1–433] | 18667 | [1–83] |
| 18410 | [1–44] | 18469 | [1–439] | 18604 | [1–419] | 18668 | [1–512] |
| 18411 | [1–369] | 18470 | [1–412] | 18605 | [1–176] | 18670 | [1–463] |
| 18412 | [1–50] | 18472 | [1–440] | 18606 | [1–79] | 18671 | [394–421] |
| 18413 | [159–232] | 18473 | [1–163] | 18608 | [1–469] | 18674 | [168–270] |
| 18415 | [1–227], [273–367] | 18474 | [1–426] | 18612 | [1–346] | 18675 | [1–493] |
| 18416 | [1–377] | 18476 | [1–324] | 18613 | [354–480] | 18676 | [1–179] |
| 18417 | [1–522] | 18477 | [1–237] | 18614 | [1–410] | 18677 | [1–405] |
| 18418 | [1–36], [69–483] | 18478 | [85–478] | 18615 | [1–269] | 18678 | [104–357] |
| 18419 | [1–547] | 18479 | [1–46] | 18616 | [1–517] | 18679 | [1–474] |
| 18421 | [1–228] | 18480 | [1–46] | 18617 | [1–500] | 18680 | [1–498] |
| 18422 | [1–102] | 18481 | [1–49] | 18618 | [1–508] | 18681 | [1–501] |
| 18423 | [1–80] | 18482 | [1–437] | 18619 | [1–483] | 18682 | [1–458] |
| 18424 | [1–412] | 18483 | [1–353] | 18620 | [1–63] | 18683 | [1–377] |
| 18425 | [387–478] | 18484 | [1–102] | 18621 | [1–492] | 18684 | [1–354] |
| 18427 | [1–64] | 18485 | [1–472] | 18622 | [1–470] | 18685 | [309–475] |
| 18428 | [1–186] | 18486 | [1–577] | 18623 | [1–354] | 18686 | [1–360] |
| 18429 | [1–509] | 18487 | [1–54], [143–493] | 18624 | [1–28] | 18687 | [1–510] |
| 18488 | [1–199] | 18538 | [1–360] | 18625 | [1–28] | 18688 | [1–503] |
| 18489 | [1–200], [230–435] | 18539 | [1–400] | 18628 | [1–474] | 18689 | [1–399] |
| 18490 | [1–405] | 18540 | [1–401] | 18630 | [1–144] | 18690 | [1–368] |
| 18491 | [1–680] | 18541 | [1–425] | 18631 | [118–222] | 18691 | [1–70] |

TABLE IVa-continued (Novelty:95%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 18633 | [369–442] | 18692 | [1–373] | 18919 | [1–485] | 18974 | [1–474] |
| 18635 | [37–104] | 18701 | [56–99] | 18920 | [1–52] | 18975 | [1–449] |
| 18636 | [1–433] | 18706 | [1–525] | 18921 | [1–411] | 18977 | [1–146], [228–280] |
| 18637 | [1–489] | 18718 | [1–62] | 18922 | [1–52] | 18978 | [1–659] |
| 18638 | [279–332] | 18720 | [146–235] | 18923 | [1–52] | 18979 | [1–451] |
| 18639 | [274–405] | 18721 | [1–341] | 18925 | [1–51] | 18980 | [1–485] |
| 18641 | [1–540] | 18726 | [1–486] | 18926 | [1–52] | 18982 | [1–493] |
| 18642 | [151–176], [283–313] | 18733 | [1–28] | 18928 | [1–51] | 18983 | [1–378] |
| 18643 | [1–459] | 18735 | [31–374] | 18929 | [1–53] | 18984 | [1–77] |
| 18645 | [105–145], [188–241] | 18740 | [31–406] | 18930 | [1–128] | 18985 | [168–327] |
| 18647 | [72–335] | 18747 | [1–51] | 18931 | [1–355] | 18986 | [1–433] |
| 18648 | [171–282] | 18749 | [1–89] | 18932 | [1–330] | 18987 | [57–308] |
| 18649 | [1–516] | 18750 | [63–93] | 18934 | [1–395] | 18988 | [1–129] |
| 18650 | [1–263] | 18752 | [124–365] | 18935 | [226–281] | 18989 | [1–478] |
| 18651 | [1–229], [452–479] | 18753 | [1–50] | 18936 | [60–133] | 18990 | [1–460] |
| 18652 | [57–507] | 18759 | [278–312], [389–426] | 18938 | [1–197] | 18991 | [1–79] |
| 18765 | [255–376] | 18849 | [1–489] | 18939 | [179–351] | 18992 | [1–506] |
| 18773 | [432–457] | 18851 | [1–357] | 18940 | [1–424] | 18993 | [1–377] |
| 18779 | [1–390] | 18852 | [1–360] | 18941 | [75–469] | 18994 | [1–367] |
| 18791 | [1–527] | 18853 | [1–360] | 18942 | [67–325] | 18995 | [1–188] |
| 18792 | [1–466] | 18854 | [1–377] | 18943 | [1–149] | 18996 | [1–543] |
| 18793 | [1–510] | 18855 | [1–382] | 18944 | [1–438] | 18997 | [1–347] |
| 18794 | [1–453] | 18856 | [1–383] | 18945 | [133–444], [488–524] | 18998 | [1–272] |
| 18795 | [1–348] | 18857 | [1–427] | 18948 | [1–519] | 19000 | [1–190] |
| 18796 | [1–348] | 18858 | [1–391] | 18949 | [1–469] | 19001 | [1–199] |
| 18797 | [120–444] | 18859 | [1–485] | 18950 | [1–468] | 19002 | [1–463], [502–687] |
| 18798 | [1–482] | 18860 | [1–335] | 18951 | [1–519] | 19003 | [1–314] |
| 18799 | [1–403] | 18861 | [1–453] | 18952 | [1–150] | 19004 | [1–74] |
| 18800 | [1–506] | 18862 | [1–501] | 18953 | [1–73] | 19005 | [1–407] |
| 18801 | [1–600] | 18863 | [1–353] | 18954 | [445–470] | 19006 | [1–701] |
| 18805 | [1–490] | 18866 | [1–177] | 18956 | [1–790] | 19007 | [1–508] |
| 18806 | [1–447] | 18867 | [1–446] | 18957 | [1–88], [415–517] | 19008 | [1–478] |
| 18807 | [1–447] | 18869 | [1–716] | 18958 | [1–124], [452–1030] | 19009 | [1–508] |
| 18810 | [1–74] | 18870 | [1–250] | 18959 | [1–38] | 19010 | [1–436] |
| 18811 | [1–87] | 18871 | [1–238] | 18960 | [1–324] | 19011 | [1–481] |
| 18812 | [1–506] | 18872 | [1–269] | 18961 | [1–311], [340–379] | 19017 | [1–484] |
| 18813 | [1–484] | 18873 | [1–300] | 18962 | [1–311], [340–403] | 19019 | [1–428] |
| 18814 | [208–250] | 18874 | [1–490] | 19021 | [1–325] | 19086 | [1–192] |
| 18815 | [1–509] | 18875 | [1–482] | 19022 | [1–490] | 19087 | [1–94] |
| 18816 | [1–561] | 18876 | [119–425] | 19025 | [1–501] | 19088 | [1–471] |
| 18817 | [1–46], [78–487] | 18877 | [1–501] | 19026 | [1–293] | 19089 | [1–550] |
| 18818 | [1–504] | 18878 | [1–476] | 19027 | [82–470] | 19090 | [1–469] |
| 18819 | [1–533] | 18879 | [1–319] | 19028 | [1–66], [111–440] | 19091 | [1–415] |
| 18820 | [1–440] | 18880 | [1–463], [498–563] | 19029 | [1–550] | 19092 | [1–839] |
| 18821 | [1–593] | 18881 | [1–460] | 19030 | [57–98], [214–470] | 19093 | [1–463] |
| 18825 | [1–490] | 18882 | [1–461] | 19033 | [1–30] | 19094 | [1–516] |
| 18827 | [1–433] | 18883 | [1–485] | 19040 | [1–106] | 19095 | [1–484] |
| 18830 | [1–282] | 18884 | [1–170], [209–239], [301–395] | 19041 | [1–70] | 19096 | [1–356] |
| 18831 | [1–275], [486–522] | 18885 | [253–308], [909–936] | 19042 | [1–325], [357–392] | 19097 | [1–203] |
| 18832 | [1–54], [453–522] | 18887 | [1–49], [110–138] | 19045 | [1–301] | 19098 | [1–348] |
| 18835 | [1–532] | 18889 | [1–449] | 19046 | [1–462] | 19099 | [1–351] |
| 18836 | [1–464] | 18890 | [1–467] | 19047 | [1–326] | 19100 | [1–184] |
| 18837 | [1–188] | 18891 | [1–170] | 19048 | [1–417] | 19102 | [1–444] |
| 18838 | [1–75] | 18892 | [1–524] | 19049 | [1–537] | 19103 | [1–439] |
| 18839 | [1–374] | 18893 | [183–250] | 19050 | [1–518] | 19104 | [1–556] |
| 18840 | [1–439] | 18894 | [1–409] | 19051 | [1–508] | 19105 | [1–422] |
| 18841 | [1–452] | 18895 | [1–426] | 19052 | [1–497] | 19106 | [1–503] |
| 18842 | [1–225] | 18898 | [1–147] | 19053 | [1–378], [417–450] | 19107 | [1–168] |
| 18843 | [1–438] | 18899 | [1–35] | 19054 | [76–482] | 19108 | [1–548] |
| 18844 | [97–141] | 18900 | [1–47] | 19056 | [1–337] | 19109 | [427–515] |
| 18845 | [1–374] | 18901 | [1–507] | 19057 | [203–465] | 19110 | [1–473] |
| 18846 | [1–401] | 18903 | [1–479] | 19058 | [1–478] | 19111 | [1–452] |
| 18848 | [1–416] | 18904 | [256–304] | 19059 | [1–468] | 19112 | [1–480] |
| 18905 | [1–51] | 18963 | [1–311], [340–384] | 19060 | [170–384] | 19113 | [1–394] |
| 18906 | [1–155] | 18964 | [1–527] | 19061 | [195–403] | 19114 | [1–354] |
| 18907 | [1–155] | 18965 | [1–458] | 19062 | [1–500] | 19117 | [1–493] |
| 18909 | [1–51] | 18966 | [1–516] | 19063 | [1–472] | 19118 | [1–387] |
| 18910 | [1–91] | 18968 | [1–496] | 19064 | [1–515] | 19119 | [1–449] |
| 18912 | [1–52] | 18969 | [1–569] | 19065 | [1–396] | 19120 | [268–456] |
| 18914 | [1–51] | 18970 | [1–477] | 19066 | [1–362] | 19121 | [1–203] |
| 18916 | [1–117] | 18971 | [1–566] | 19067 | [1–381] | 19122 | [1–439] |
| 18917 | [1–506] | 18972 | [1–457] | 19068 | [1–37] | 19123 | [1–369] |
| 18918 | [1–215] | 18973 | [1–415] | 19070 | [1–501] | 19124 | [1–427] |
|  |  |  |  | 19071 | [1–436] | 19125 | [279–448] |

TABLE IVa-continued (Novelty:95%)

| Seq Id No. | Positions of preferred fragments | Seq Id No. | Positions of preferred fragments |
|---|---|---|---|
| 19072 | [1–412] | 19126 | [1–84], [270–406] |
| 19073 | [1–426] | 19127 | [1–514] |
| 19074 | [1–78], [207–454] | 19128 | [1–469] |
| 19077 | [1–518] | 19130 | [1–517] |
| 19078 | [112–423] | 19132 | [1–136] |
| 19079 | [1–387] | 19133 | [1–500] |
| 19080 | [1–586] | 19134 | [1–429] |
| 19083 | [1–481] | 19135 | [1–682] |
| 19084 | [1–429] | 19136 | [32–484] |
| 19085 | [1–474] | 19137 | [1–142] |
| 19138 | [1–554] | 19199 | [1–315] |
| 19139 | [32–466] | 19201 | [1–424] |
| 19141 | [1–355] | 19203 | [1–467] |
| 19142 | [1–400] | 19204 | [1–420] |
| 19143 | [1–196] | 19205 | [1–468] |
| 19144 | [1–249] | 19206 | [1–236] |
| 19146 | [372–465] | 19208 | [1–72] |
| 19147 | [1–480] | 19209 | [1–299] |
| 19150 | [1–515] | 19211 | [1–208] |
| 19153 | [1–419] | 19212 | [1–260] |
| 19159 | [1–453] | 19214 | [1–164] |
| 19160 | [314–373] | 19215 | [1–146] |
| 19161 | [1–495] | 19216 | [1–58] |
| 19162 | [1–432], [533–623] | 19217 | [1–103] |
| 19163 | [1–505] | 19218 | [1–352] |
| 19164 | [1–435] | 19220 | [52–541] |
| 19165 | [1–497] | 19221 | [1–467] |
| 19166 | [1–150] | 19222 | [1–464] |
| 19167 | [1–369] | 19223 | [328–371] |
| 19168 | [1–207] | 19224 | [1–84] |
| 19169 | [1–144] | 19225 | [1–321] |
| 19170 | [1–361], [391–434] | 19226 | [1–221] |
| 19171 | [1–151] | 19228 | [1–469] |
| 19172 | [1–170] | 19230 | [1–444] |
| 19173 | [1–162] | 19231 | [339–419] |
| 19174 | [1–532] | 19232 | [1–338] |
| 19175 | [1–519] | 19233 | [1–334] |
| 19176 | [1–658] | 19234 | [113–196] |
| 19177 | [1–303] | 19235 | [1–505] |
| 19178 | [1–369] | 19236 | [1–401], [442–513] |
| 19179 | [1–500] | 19238 | [1–467] |
| 19180 | [1–293] | 19239 | [38–401] |
| 19181 | [118–558] | 19240 | [1–317] |
| 19182 | [1–471] | 19241 | [1–369] |
| 19183 | [1–563] | 19244 | [1–453] |
| 19186 | [1–513] | 19245 | [1–136] |
| 19187 | [1–464] | 19247 | [1–522] |
| 19188 | [1–68], [108–472] | 19248 | [1–492] |
| 19189 | [1–473] | 19249 | [1–490] |
| 19190 | [1–518] | 19250 | [1–44], [294–477] |
| 19191 | [1–255] | 19252 | [241–347] |
| 19192 | [1–449] | 19253 | [1–480] |
| 19193 | [1–214] | 19255 | [1–419] |
| 19194 | [1–550] | 19256 | [1–375] |
| 19195 | [1–165] | 19257 | [1–177] |
| 19196 | [1–444] | 19258 | [1–287] |
| 19197 | [1–130] | 19259 | [1–266] |
| 19260 | [1–58] | 19315 | [1–101] |
| 19261 | [1–113] | 19316 | [1–108] |
| 19262 | [1–329] | 19317 | [1–169] |
| 19263 | [1–72] | 19318 | [1–63] |
| 19264 | [1–348] | 19319 | [1–133] |
| 19266 | [1–330] | 19321 | [1–108] |
| 19267 | [1–319] | 19322 | [1–119] |
| 19268 | [1–313] | 19325 | [1–390] |
| 19269 | [1–160] | 19326 | [1–168] |
| 19270 | [1–90] | 19327 | [1–387] |
| 19271 | [1–110] | 19328 | [1–169] |
| 19272 | [1–132] | 19329 | [1–169] |
| 19273 | [1–101] | 19330 | [1–108] |
| 19274 | [1–265] | 19331 | [1–101] |
| 19275 | [1–325] | 19332 | [1–404] |
| 19276 | [1–171] | 19334 | [1–499] |
| 19277 | [1–90] | 19335 | [1–63] |
| 19278 | [1–182] | | |
| 19279 | [1–59] | | |
| 19280 | [1–353] | | |
| 19281 | [1–107] | | |
| 19282 | [1–200], [261–377] | | |
| 19283 | [1–270] | | |
| 19284 | [1–348] | | |
| 19285 | [1–338] | | |
| 19286 | [1–63] | | |
| 19288 | [1–101] | | |
| 19289 | [1–108] | | |
| 19290 | [1–101] | | |
| 19291 | [1–108] | | |
| 19292 | [96–496] | | |
| 19293 | [1–108] | | |
| 19294 | [1–63] | | |
| 19295 | [1–108] | | |
| 19296 | [1–108] | | |
| 19298 | [1–108] | | |
| 19299 | [1–108] | | |
| 19300 | [1–108] | | |
| 19303 | [1–489] | | |
| 19304 | [1–108] | | |
| 19306 | [1–29] | | |
| 19308 | [1–205] | | |
| 19309 | [1–102] | | |
| 19311 | [1–108] | | |
| 19312 | [1–108] | | |
| 19313 | [1–109] | | |
| 19314 | [1–385] | | |

TABLE IVb (Novelty: 100%)

| Seq Id No. | Positions of preferred fragments | Seq Id No. | Positions of preferred fragments |
|---|---|---|---|
| 24 | [1–342] | 75 | [1–420] |
| 25 | [1–365] | 76 | [1–486] |
| 26 | [1–557] | 77 | [1–436] |
| 27 | [1–514] | 78 | [1–793] |
| 29 | [1–167] | 79 | [1–443] |
| 30 | [1–368] | 80 | [1–308] |
| 31 | [1–506] | 81 | [210–323] |
| 32 | [1–44] | 82 | [1–570] |
| 33 | [1–479] | 83 | [156–393] |
| 34 | [65–397] | 84 | [1–461] |
| 35 | [1–126],[298–386] | 85 | [1–244],[358–468] |
| 36 | [1–454] | 86 | [1–516] |
| 37 | [1–172],[319–482] | 87 | [1–674] |
| 38 | [1–491] | 88 | [1–402] |
| 39 | [1–678] | 89 | [1–473] |
| 41 | [1–442] | 90 | [1–474] |
| 42 | [1–425] | 91 | [1–97],[411–490] |
| 43 | [1–512] | 92 | [1–586] |
| 44 | [1–339] | 93 | [1–311] |
| 45 | [1–544] | 94 | [1–452] |
| 46 | [1–484] | 95 | [1–326] |
| 47 | [1–495] | 96 | [1–383] |
| 48 | [1–535] | 97 | [1–672] |
| 49 | [1–432] | 98 | [1–451] |
| 50 | [1–410] | 99 | [1–30] |
| 51 | [1–465] | 100 | [1–498] |
| 52 | [1–547] | 101 | [1–504] |
| 54 | [1–505] | 102 | [1–248] |
| 55 | [1–546] | 103 | [1–351] |
| 56 | [1–507] | 104 | [1–356] |
| 57 | [1–480] | 105 | [1–278] |
| 58 | [1–392] | 106 | [1–487] |
| 59 | [1–273] | 107 | [1–492] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 60 | [1–273] | 108 | [1–376] | 226 | [85–430] | 275 | [1–27],[65–213],[251–542] |
| 61 | [33–273] | 109 | [1–500] | 227 | [1–524] | 276 | [59–469] |
| 62 | [1–256] | 110 | [1–570] | 228 | [1–190] | 277 | [394–484] |
| 63 | [1–343] | 111 | [1–584] | 229 | [1–199],[233–450] | 278 | [1–472] |
| 65 | [1–174] | 112 | [1–417] | 230 | [1–306] | 279 | [1–511] |
| 66 | [1–481] | 113 | [1–402] | 231 | [1–351] | 280 | [1–499] |
| 67 | [1–478] | 114 | [1–525] | 232 | [1–260] | 281 | [1–221],[442–472] |
| 68 | [1–323] | 115 | [1–480] | 233 | [1–253] | 282 | [1–490] |
| 69 | [1–443] | 116 | [1–496] | 234 | [1–405] | 283 | [1–479] |
| 70 | [1–473] | 117 | [1–623] | 235 | [1–594] | 284 | [1–489] |
| 71 | [1–329] | 118 | [1–497] | 236 | [1–400] | 285 | [1–466] |
| 72 | [1–488] | 119 | [1–542] | 237 | [1–481] | 286 | [1–451] |
| 73 | [169–268] | 120 | [1–453] | 238 | [1–663] | 287 | [1–609] |
| 74 | [1–417] | 121 | [1–466] | 239 | [1–540] | 288 | [1–296] |
| 122 | [1–213] | 169 | [1–148],[229–490] | 240 | [1–559] | 289 | [1–503] |
| 123 | [1–465] | 170 | [1–542] | 241 | [1–479] | 290 | [1–386] |
| 124 | [1–488] | 171 | [1–528] | 242 | [1–516] | 291 | [1–499] |
| 125 | [1–493] | 172 | [1–450] | 243 | [1–558] | 292 | [1–671] |
| 126 | [1–489] | 173 | [1–599] | 244 | [1–478] | 293 | [1–112],[384–512] |
| 127 | [1–463] | 174 | [1–514] | 245 | [1–470] | 294 | [1–288],[326–490] |
| 128 | [1–554] | 175 | [1–286] | 246 | [1–451] | 295 | [1–322] |
| 129 | [1–180],[421–467] | 176 | [1–501] | 247 | [1–458] | 296 | [1–40] |
| 130 | [1–457] | 177 | [1–31] | 248 | [1–473] | 297 | [1–496] |
| 131 | [1–392] | 178 | [1–542] | 249 | [1–322] | 298 | [1–492] |
| 132 | [1–477] | 179 | [1–303] | 250 | [1–548] | 299 | [1–478] |
| 133 | [1–252] | 180 | [1–504] | 251 | [1–453] | 300 | [1–248] |
| 134 | [1–422] | 181 | [1–35],[146–320],[444–542] | 252 | [1–578] | 301 | [1–455] |
| 135 | [1–462],[498–570] | 182 | [1–509] | 253 | [1–672] | 302 | [1–483] |
| 136 | [1–282] | 183 | [1–501] | 254 | [1–368],[437–479] | 303 | [1–496] |
| 137 | [1–502] | 184 | [1–466] | 255 | [1–115],[158–327] | 304 | [1–477],[509–622] |
| 138 | [1–495] | 185 | [51–267] | 256 | [158–476] | 305 | [1–522] |
| 139 | [1–646] | 186 | [1–485] | 257 | [1–506] | 306 | [1–500] |
| 140 | [1–36],[411–497] | 187 | [1–521] | 258 | [1–447] | 307 | [1–25] |
| 141 | [1–456] | 188 | [1–332] | 259 | [1–433] | 308 | [1–495] |
| 142 | [1–488] | 189 | [1–262] | 260 | [1–467] | 309 | [1–483] |
| 143 | [1–219] | 190 | [1–552] | 261 | [1–508] | 310 | [1–467] |
| 144 | [1–524] | 191 | [30–164] | 262 | [1–477] | 311 | [1–156],[219–272],[332–435] |
| 145 | [1–514] | 192 | [1–249] | 312 | [1–90],[332–493] | 360 | [158–413] |
| 146 | [1–525] | 193 | [1–324] | 313 | [1–570] | 361 | [1–737] |
| 147 | [1–438] | 194 | [1–334] | 314 | [1–386] | 362 | [1–470] |
| 148 | [1–265] | 195 | [1–337] | 315 | [1–482] | 363 | [1–451] |
| 149 | [1–256] | 196 | [1–296],[462–491] | 316 | [55–478] | 364 | [1–488] |
| 150 | [1–320] | 197 | [1–56] | 317 | [1–460] | 365 | [1–299],[476–597] |
| 151 | [1–512] | 198 | [1–471] | 318 | [1–557] | 366 | [1–455] |
| 152 | [1–497] | 199 | [1–523] | 319 | [1–587] | 367 | [1–494] |
| 153 | [1–501] | 200 | [1–465],[523–829] | 320 | [1–32],[177–260],[422–489] | 368 | [1–412] |
| 154 | [1–225] | 201 | [143–477] | 321 | [50–475] | 369 | [1–482] |
| 155 | [1–542] | 202 | [33–523] | 322 | [53–462] | 370 | [1–513] |
| 156 | [1–211] | 203 | [1–451] | 323 | [50–474] | 371 | [1–437] |
| 157 | [50–475] | 204 | [1–505] | 324 | [1–496] | 372 | [1–394] |
| 158 | [1–587] | 205 | [1–277] | 325 | [1–520] | 373 | [1–474] |
| 159 | [1–533] | 206 | [1–701] | 326 | [50–480] | 374 | [1–319] |
| 160 | [1–479] | 207 | [125–162],[191–499] | 327 | [1–292] | 375 | [1–429] |
| 161 | [1–307] | 208 | [1–485] | 328 | [1–515] | 376 | [1–524] |
| 162 | [1–721] | 209 | [1–458] | 329 | [32–513] | 377 | [1–459] |
| 163 | [1–495] | 210 | [1–559] | 330 | [1–543] | 378 | [1–284] |
| 164 | [143–213],[338–493] | 211 | [1–481] | 331 | [50–475] | 379 | [1–496] |
| 165 | [1–594] | 212 | [1–452] | 332 | [32–495] | 380 | [1–54],[83–495] |
| 166 | [1–501] | 213 | [1–472] | 333 | [1–496] | 381 | [36–530] |
| 167 | [1–481] | 214 | [1–444] | 334 | [1–461] | 382 | [1–300] |
| 168 | [141–351],[469–562] | 215 | [1–321] | 335 | [50–475] | 383 | [1–569] |
| 216 | [1–472] | 263 | [1–503] | 337 | [1–638] | 384 | [1–480] |
| 217 | [1–461] | 264 | [1–571] | 338 | [1–519] | 385 | [1–421] |
| 218 | [36–469] | 265 | [1–497] | 339 | [68–252] | 386 | [1–498] |
| 219 | [36–468] | 267 | [1–483] | 340 | [1–286],[346–511] | 387 | [1–497] |
| 220 | [91–480] | 268 | [1–114],[153–350],[442–599] | 341 | [1–487] | 388 | [1–474] |
| 221 | [54–364] | 269 | [1–467] | 342 | [1–460] | 389 | [127–320] |
| 222 | [1–46],[107–483] | 270 | [1–173] | 343 | [1–452] | 390 | [1–490] |
| 223 | [1–76],[174–490] | 271 | [37–251],[317–376],[518–630] | 344 | [1–478] | 391 | [1–457] |
| | | | | 345 | [1–472] | 392 | [1–309] |
| 224 | [1–492] | 272 | [207–291],[344–479] | 346 | [1–537] | 393 | [1–349] |
| | | | | 347 | [1–488] | 394 | [1–146] |
| 225 | [1–564] | 274 | [1–473] | 348 | [1–470] | 395 | [1–409] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 349 | [1–564] | 396 | [1–146],[175–223] | 517 | [1–478] | 564 | [1–481] |
| 350 | [1–494] | 397 | [1–443] | 518 | [1–458] | 565 | [1–492] |
| 351 | [1–520] | 398 | [1–574] | 519 | [1–560] | 566 | [1–509] |
| 352 | [1–490] | 399 | [1–370] | 520 | [1–465] | 567 | [1–479] |
| 353 | [1–491] | 400 | [1–456] | 521 | [1–361] | 568 | [31–468] |
| 354 | [1–363] | 401 | [1–482] | 522 | [1–278] | 569 | [1–375] |
| 355 | [1–234] | 402 | [1–287] | 523 | [1–417] | 570 | [1–486] |
| 356 | [1–522] | 403 | [121–216] | 524 | [1–466] | 571 | [1–601] |
| 357 | [1–485] | 404 | [1–417] | 525 | [1–469] | 572 | [1–253] |
| 358 | [1–470] | 405 | [1–436] | 526 | [1–352],[394–460] | 573 | [1–496] |
| 359 | [1–332] | 406 | [1–450] | 527 | [1–483] | 574 | [1–115],[277–432] |
| 407 | [1–510] | 454 | [1–493] | 528 | [1–457] | 575 | [1–449] |
| 408 | [1–435] | 455 | [1–256],[314–593] | 529 | [1–495] | 576 | [1–300],[413–451] |
| 409 | [1–485] | 456 | [1–483] | 530 | [1–63],[135–219],[295–474] | 577 | [1–507] |
| 410 | [1–237] | 457 | [1–368] | 531 | [1–467] | 578 | [1–409] |
| 411 | [1–482] | 458 | [1–378] | 532 | [1–487] | 579 | [1–510] |
| 412 | [1–482] | 459 | [1–517] | 533 | [1–491] | 580 | [1–112],[263–412] |
| 413 | [1–419] | 460 | [1–475] | 534 | [1–193] | 581 | [1–480] |
| 414 | [1–463] | 461 | [1–528] | 535 | [1–395] | 582 | [1–509] |
| 415 | [1–219] | 462 | [1–285] | 536 | [1–504] | 583 | [1–458] |
| 416 | [1–460] | 463 | [1–457] | 537 | [1–501] | 584 | [1–538] |
| 417 | [1–474] | 464 | [1–188] | 538 | [1–225] | 585 | [1–513] |
| 418 | [158–300],[389–507] | 465 | [227–382] | 539 | [1–401] | 586 | [1–531] |
| 419 | [1–172] | 466 | [1–497] | 540 | [39–472] | 587 | [1–329] |
| 420 | [1–505] | 467 | [48–183],[439–480] | 541 | [1–180],[355–452] | 588 | [1–491] |
| 421 | [1–504] | 468 | [1–492] | 542 | [1–506] | 589 | [1–736] |
| 422 | [1–271] | 469 | [1–388] | 543 | [1–469] | 590 | [1–452] |
| 423 | [1–239] | 470 | [1–478] | 544 | [77–490] | 591 | [1–523] |
| 424 | [1–213] | 471 | [1–467] | 545 | [1–467] | 592 | [1–470] |
| 425 | [1–407] | 472 | [1–527] | 546 | [1–454] | 593 | [1–95[,[129–233] |
| 426 | [1–324] | 473 | [1–550] | 547 | [1–485] | 594 | [1–238] |
| 427 | [1–377] | 474 | [1–303] | 595 | [1–374] | 642 | [1–497] |
| 428 | [1–498] | 475 | [1–169] | 596 | [1–460] | 643 | [1–272] |
| 429 | [1–274] | 476 | [1–471] | 597 | [1–461] | 644 | [255–353] |
| 430 | [1–83],[411–469] | 477 | [1–252] | 598 | [88–263],[372–434] | 645 | [1–546] |
| 431 | [1–464] | 478 | [1–472] | 599 | [1–521] | 646 | [1–336] |
| 432 | [1–494] | 479 | [1–510] | 600 | [1–505] | 647 | [1–368] |
| 433 | [1–413] | 480 | [1–505] | 601 | [1–169] | 648 | [1–483] |
| 434 | [1–323] | 481 | [1–352] | 602 | [1–247] | 649 | [1–511] |
| 435 | [1–548] | 482 | [1–286] | 603 | [33–101],[417–530] | 650 | [1–489] |
| 436 | [1–493] | 483 | [1–451] | 604 | [1–61],[184–416] | 651 | [1–511] |
| 437 | [1–457] | 484 | [1–244] | 605 | [1–454] | 652 | [1–489] |
| 438 | [1–343] | 485 | [1–482] | 606 | [33–328] | 653 | [1–519] |
| 439 | [1–428] | 486 | [1–81],[156–383] | 607 | [1–448] | 654 | [1–343] |
| 440 | [1–537] | 487 | [1–370] | 608 | [1–383] | 655 | [40–81],[154–198], [275–309],[414–508] |
| 441 | [1–28],[113–360] | 488 | [1–160] | | | | |
| 442 | [1–502] | 489 | [1–234] | 609 | [1–246],[383–419] | 656 | [1–486] |
| 443 | [1–467] | 490 | [1–458] | 610 | [1–416] | 657 | [1–510] |
| 444 | [1–464] | 491 | [1–457] | 611 | [1–459] | 658 | [1–553] |
| 445 | [1–504] | 492 | [1–486] | 612 | [1–340] | 659 | [37–78],[177–265] |
| 446 | [1–476] | 493 | [1–452] | 613 | [1–473] | 660 | [1–460] |
| 447 | [1–505] | 494 | [1–295] | 614 | [1–506] | 661 | [1–451] |
| 448 | [1–495] | 495 | [1–286],[353–487] | 615 | [1–488] | 662 | [1–487] |
| 449 | [1–503] | 496 | [1–468] | 616 | [1–481] | 663 | [1–458] |
| 450 | [1–461] | 497 | [1–481] | 617 | [1–494] | 664 | [1–535] |
| 451 | [1–507] | 498 | [1–296] | 618 | [1–358] | 665 | [1–488] |
| 452 | [1–480] | 499 | [1–422] | 619 | [1–208] | 666 | [1–539] |
| 453 | [1–511] | 500 | [1–461] | 620 | [1–309] | 667 | [54–490] |
| 501 | [1–506] | 548 | [1–526] | 621 | [1–278] | 668 | [1–498] |
| 502 | [1–427] | 549 | [1–484] | 622 | [1–476] | 669 | [1–540] |
| 503 | [154–481] | 550 | [1–457] | 623 | [1–412] | 670 | [1–497] |
| 504 | [1–489] | 551 | [1–527] | 624 | [1–448] | 671 | [1–506] |
| 505 | [1–237],[287–502] | 552 | [1–459] | 625 | [179–552] | 672 | [1–32],[225–259], [421–492] |
| 506 | [1–458] | 553 | [1–513] | | | | |
| 507 | [1–288],[368–502] | 554 | [1–463] | 626 | [1–463] | 673 | [1–218],[278–465] |
| 508 | [1–473] | 555 | [1–232] | 627 | [1–487] | 674 | [1–469] |
| 509 | [1–469] | 556 | [1–149] | 628 | [1–479] | 675 | [1–491] |
| 510 | [1–486] | 557 | [1–474] | 629 | [1–478] | 676 | [1–429] |
| 511 | [1–51],[159–205] | 558 | [1–471] | 630 | [1–607] | 677 | [1–497] |
| 512 | [1–318] | 559 | [1–384] | 631 | [1–458] | 678 | [1–473] |
| 513 | [1–470] | 560 | [1–470] | 632 | [1–502] | 679 | [1–366] |
| 514 | [1–453] | 561 | [137–504] | 633 | [1–485] | 680 | [1–401] |
| 515 | [1–480] | 562 | [1–488] | 634 | [1–464] | 681 | [1–399] |
| 516 | [1–496] | 563 | [1–469] | 635 | [1–494] | 682 | [1–508] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 636 | [1–480] | 683 | [1–535] | 804 | [1–448] | 852 | [1–474] |
| 637 | [175–246] | 684 | [1–308] | 805 | [1–484] | 853 | [1–546] |
| 638 | [1–177],[210–344] | 685 | [1–452] | 806 | [1–510] | 854 | [1–499] |
| 639 | [1–469] | 686 | [1–495] | 807 | [1–474] | 855 | [1–484] |
| 640 | [1–426] | 687 | [1–497] | 808 | [1–221] | 856 | [195–473] |
| 641 | [1–458] | 688 | [1–499] | 809 | [1–96] | 857 | [1–502] |
| 689 | [1–467] | 737 | [1–474] | 810 | [1–389] | 858 | [1–514] |
| 690 | [179–523] | 738 | [1–498] | 811 | [1–451] | 859 | [1–481] |
| 691 | [1–473] | 739 | [30–195],[448–516] | 812 | [1–258] | 860 | [1–508] |
| 692 | [1–503] | 740 | [1–454] | 813 | [1–191] | 861 | [1–535] |
| 693 | [1–457] | 741 | [1–463] | 814 | [1–484] | 862 | [1–504] |
| 694 | [1–541] | 742 | [1–503] | 815 | [1–543] | 863 | [1–403] |
| 695 | [1–339] | 743 | [1–327] | 816 | [1–480] | 864 | [1–56] |
| 696 | [1–172] | 744 | [1–65] | 817 | [1–507] | 865 | [1–557] |
| 697 | [1–558] | 745 | [1–473] | 818 | [1–69],[156–307],[415–477] | 866 | [1–537] |
| 698 | [1–435] | 746 | [1–519] | 819 | [156–307],[415–477] | 867 | [1–496] |
| 699 | [1–518] | 747 | [1–442] | 820 | [1–332] | 868 | [1–491] |
| 700 | [1–387] | 748 | [1–442] | 821 | [1–409] | 869 | [1–353] |
| 701 | [1–487] | 749 | [1–454] | 822 | [1–212],[254–376] | 870 | [1–516] |
| 702 | [1–480] | 750 | [1–459] | 824 | [1–351] | 871 | [1–374] |
| 703 | [1–496] | 751 | [1–442] | 825 | [1–326] | 872 | [1–348] |
| 704 | [1–262],[462–492] | 752 | [1–120],[156–377] | 826 | [1–466] | 873 | [1–365],[510–542] |
| 705 | [1–479] | 753 | [97–146] | 827 | [1–420] | 874 | [1–339] |
| 706 | [1–369],[407–672] | 754 | [1–487] | 828 | [1–316] | 875 | [1–211],[253–369] |
| 707 | [1–401] | 755 | [138–499] | 829 | [1–482] | 876 | [199–426] |
| 708 | [1–501] | 756 | [1–131],[199–307] | 830 | [1–501] | 877 | [1–246] |
| 709 | [1–213],[255–400] | 757 | [1–494] | 831 | [1–175] | 878 | [1–473] |
| 710 | [1–318],[359–472] | 758 | [1–392] | 879 | [1–486] | 926 | [1–522] |
| 711 | [1–211],[253–370] | 759 | [1–211],[253–368] | 880 | [1–464] | 927 | [1–358] |
| 712 | [1–484] | 760 | [1–467] | 881 | [1–711] | 928 | [32–512] |
| 713 | [1–490] | 761 | [1–311] | 882 | [1–489] | 929 | [1–247] |
| 714 | [1–534] | 762 | [1–326] | 883 | [1–504] | 930 | [1–486] |
| 715 | [1–525] | 763 | [1–386] | 884 | [1–348] | 931 | [1–458] |
| 716 | [1–454] | 764 | [1–472] | 885 | [1–484] | 932 | [1–529] |
| 717 | [1–452] | 765 | [1–457] | 886 | [1–499] | 934 | [34–233] |
| 718 | [1–495] | 766 | [1–492] | 887 | [1–455] | 935 | [1–404] |
| 719 | [1–223] | 767 | [1–39],[225–520] | 888 | [1–452] | 936 | [1–504] |
| 720 | [1–469] | 768 | [1–42],[181–262] | 889 | [1–489] | 937 | [1–602] |
| 721 | [1–485] | 769 | [65–538] | 890 | [1–525] | 938 | [1–495] |
| 722 | [1–560] | 770 | [1–477] | 891 | [1–408] | 939 | [1–521] |
| 723 | [1–32],[237–280],[451–499] | 771 | [1–506] | 892 | [1–517] | 940 | [1–539] |
| 724 | [36–242],[374–427] | 772 | [1–376] | 893 | [1–479] | 941 | [1–557] |
| 725 | [97–148],[448–531] | 773 | [1–321],[392–499] | 894 | [1–257],[477–548] | 942 | [1–479] |
| 726 | [34–270] | 774 | [1–498] | 895 | [1–499] | 943 | [1–476] |
| 727 | [1–396] | 775 | [1–498] | 896 | [1–323] | 944 | [1–529] |
| 728 | [1–167],[249–478] | 776 | [1–487] | 897 | [1–467] | 945 | [1–605] |
| 729 | [1–470] | 777 | [1–479],[629–748] | 898 | [1–453] | 946 | [1–488] |
| 730 | [1–406] | 778 | [1–589] | 899 | [1–497] | 947 | [1–285] |
| 732 | [1–380] | 779 | [1–471] | 900 | [1–422] | 948 | [1–345] |
| 733 | [1–381] | 780 | [1–169],[223–704] | 901 | [1–359] | 949 | [1–557] |
| 734 | [1–280] | 781 | [1–133] | 902 | [1–498] | 950 | [269–353] |
| 735 | [1–490] | 782 | [1–487] | 903 | [1–363] | 951 | [1–515] |
| 736 | [70–134],[187–270],[448–497] | 783 | [1–42],[134–516] | 904 | [1–539] | 952 | [1–131] |
| 784 | [1–468] | 832 | [1–494] | 905 | [1–213],[255–369] | 953 | [1–466] |
| 785 | [1–515] | 833 | [1–497] | 906 | [1–485] | 954 | [1–283],[432–476] |
| 786 | [1–516] | 834 | [1–650] | 907 | [1–464] | 955 | [1–506] |
| 787 | [1–476] | 835 | [1–259] | 908 | [1–469] | 956 | [1–440] |
| 788 | [1–618] | 836 | [1–486] | 909 | [1–707] | 957 | [155–628] |
| 789 | [1–212],[294–378] | 837 | [1–301] | 910 | [1–604] | 958 | [1–525] |
| 790 | [57–264],[439–494] | 838 | [1–225] | 911 | [1–452] | 959 | [116–497] |
| 791 | [1–464] | 839 | [142–537] | 912 | [1–173] | 960 | [1–502] |
| 792 | [1–484] | 840 | [1–510] | 913 | [1–413] | 961 | [1–525] |
| 793 | [1–130],[169–492] | 841 | [1–344] | 914 | [1–402] | 962 | [1–444] |
| 794 | [1–235],[410–453] | 842 | [1–513] | 915 | [85–245] | 963 | [70–109] |
| 795 | [177–547] | 843 | [1–536] | 916 | [1–492] | 964 | [1–457] |
| 796 | [1–489] | 844 | [1–526] | 917 | [54–274] | 965 | [1–498] |
| 797 | [1–280] | 845 | [1–345] | 918 | [1–462] | 966 | [1–311] |
| 798 | [1–478] | 846 | [1–170],[273–503] | 919 | [1–517] | 967 | [1–182] |
| 799 | [1–235],[410–453] | 847 | [1–471] | 920 | [1–356] | 968 | [1–549] |
| 800 | [1–577] | 848 | [1–274] | 921 | [1–526] | 969 | [1–120],[277–495] |
| 801 | [1–194] | 849 | [1–518] | 922 | [1–478] | 970 | [1–459] |
| 802 | [1–444] | 850 | [1–475] | 923 | [1–474] | 971 | [1–492] |
| 803 | [1–466] | 851 | [1–492] | 924 | [1–434] | 972 | [1–471] |
|  |  |  |  | 925 | [1–900] | 973 | [35–224] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 974 | [1–282] | 1022 | [1–487] | 1098 | [1–517] | 1147 | [1–528] |
| 975 | [1–322] | 1023 | [1–480] | 1099 | [1–485] | 1148 | [1–56] |
| 976 | [1–479] | 1024 | [1–443] | 1100 | [33–465] | 1149 | [1–505] |
| 977 | [1–514] | 1025 | [1–440] | 1101 | [33–482] | 1150 | [1–518] |
| 978 | [39–266] | 1026 | [1–464] | 1102 | [1–235] | 1151 | [1–529] |
| 979 | [1–260] | 1027 | [1–524] | 1104 | [1–487] | 1152 | [1–371] |
| 980 | [1–481] | 1028 | [1–381] | 1105 | [33–514] | 1153 | [1–452] |
| 981 | [1–503] | 1029 | [1–479] | 1106 | [33–493] | 1154 | [1–455] |
| 982 | [1–388] | 1030 | [1–474] | 1107 | [1–361] | 1155 | [1–459] |
| 983 | [1–414] | 1031 | [1–556] | 1108 | [1–526] | 1156 | [1–494] |
| 984 | [1–540] | 1032 | [1–537] | 1109 | [1–438] | 1157 | [1–557] |
| 985 | [1–482] | 1033 | [1–425] | 1110 | [1–523] | 1158 | [1–458] |
| 986 | [1–488] | 1034 | [1–462] | 1111 | [1–351] | 1159 | [1–482] |
| 987 | [1–429] | 1035 | [1–455] | 1112 | [1–257] | 1160 | [1–536] |
| 988 | [1–492] | 1036 | [1–447] | 1113 | [1–484] | 1161 | [1–402],[464–507] |
| 989 | [1–509] | 1037 | [144–450] | 1114 | [1–331] | 1162 | [1–401] |
| 990 | [1–132],[283–383] | 1038 | [1–65],[141–418] | 1115 | [1–261] | 1163 | [1–488] |
| 991 | [1–551] | 1039 | [1–291] | 1116 | [1–367] | 1164 | [1–405],[467–491] |
| 992 | [1–72],[105–549] | 1040 | [1–483] | 1117 | [1–523] | 1165 | [1–362],[424–476] |
| 993 | [1–565] | 1041 | [1–454] | 1118 | [1–406] | 1166 | [1–402],[464–488] |
| 994 | [45–189],[425–502] | 1042 | [1–479] | 1167 | [1–400] | 1215 | [1–524] |
| 995 | [1–229] | 1043 | [1–532] | 1168 | [1–94],[137–196],[257–322] | 1216 | [1–505] |
| 996 | [1–327] | 1044 | [1–516] | 1169 | [1–388] | 1217 | [1–254] |
| 997 | [1–220] | 1045 | [1–236] | 1171 | [1–139] | 1218 | [1–455] |
| 999 | [1–357] | 1046 | [1–236] | 1172 | [1–564] | 1219 | [1–453] |
| 1000 | [1–319] | 1047 | [1–177] | 1173 | [1–469] | 1220 | [1–453] |
| 1001 | [1–490] | 1048 | [1–496] | 1174 | [1–498] | 1221 | [1–486] |
| 1002 | [1–584] | 1049 | [1–470] | 1175 | [1–261] | 1222 | [1–460] |
| 1003 | [1–520] | 1050 | [1–531] | 1176 | [1–216],[258–442] | 1223 | [1–94],[222–387] |
| 1004 | [1–490] | 1051 | [1–516] | 1177 | [1–531] | 1224 | [1–218],[292–386] |
| 1005 | [1–452] | 1052 | [1–274] | 1178 | [1–394] | 1225 | [1–348] |
| 1006 | [1–348] | 1053 | [1–515] | 1179 | [1–915] | 1226 | [1–202] |
| 1007 | [1–460] | 1054 | [1–175],[229–457] | 1180 | [58–557] | 1227 | [293–387] |
| 1008 | [1–443] | 1056 | [1–486] | 1181 | [1–235] | 1228 | [1–594] |
| 1009 | [1–425] | 1057 | [1–422] | 1182 | [1–70],[254–567] | 1229 | [1–579] |
| 1010 | [1–508] | 1058 | [1–450] | 1183 | [1–436] | 1230 | [1–163],[302–504] |
| 1011 | [1–468] | 1059 | [1–567] | 1184 | [1–486] | 1231 | [1–517] |
| 1012 | [1–429] | 1060 | [1–452] | 1185 | [1–599] | 1232 | [1–318] |
| 1013 | [1–494] | 1061 | [1–228] | 1186 | [75–189],[269–338],[426–548] | 1233 | [1–43],[137–252] |
| 1014 | [1–533] | 1062 | [1–402] | 1187 | [1–510] | 1234 | [1–489] |
| 1015 | [1–429] | 1063 | [1–468] | 1188 | [1–472] | 1235 | [1–317] |
| 1016 | [1–413] | 1064 | [1–557] | 1189 | [1–116],[192–472] | 1236 | [1–485] |
| 1017 | [1–430] | 1065 | [1–486] | 1190 | [1–536] | 1237 | [1–455] |
| 1018 | [1–509] | 1066 | [1–315] | 1191 | [1–476] | 1238 | [1–93],[280–536] |
| 1019 | [1–516] | 1067 | [1–483] | 1192 | [1–553] | 1239 | [1–468] |
| 1020 | [1–507] | 1068 | [1–379] | 1193 | [1–574] | 1240 | [1–567] |
| 1021 | [1–411] | 1069 | [1–506] | 1194 | [1–469] | 1241 | [78–248] |
| 1070 | [1–493] | 1119 | [1–248] | 1195 | [1–479] | 1242 | [1–409] |
| 1071 | [1–529] | 1120 | [1–616] | 1196 | [1–554] | 1243 | [1–232] |
| 1072 | [1–396] | 1121 | [1–284] | 1197 | [1–482] | 1244 | [1–563] |
| 1073 | [1–327] | 1122 | [1–559] | 1198 | [1–461] | 1245 | [1–241] |
| 1074 | [1–564] | 1123 | [1–399] | 1199 | [1–467] | 1246 | [1–478] |
| 1075 | [1–492] | 1124 | [1–ss1] | 1200 | [1–486] | 1247 | [1–504] |
| 1076 | [1–480] | 1125 | [1–484] | 1201 | [1–208] | 1248 | [1–527] |
| 1077 | [1–521] | 1126 | [1–533] | 1202 | [1–512] | 1249 | [1–468] |
| 1078 | [1–480] | 1127 | [1–223] | 1203 | [1–42],[123–750] | 1250 | [1–537] |
| 1079 | [1–538] | 1128 | [1–502] | 1204 | [1–57],[138–534] | 1251 | [1–568] |
| 1080 | [1–287],[347–509] | 1129 | [1–427] | 1205 | [1–42],[123–452] | 1252 | [1–492] |
| 1081 | [1–190],[220–444] | 1130 | [57–258] | 1206 | [1–186],[411–465] | 1253 | [1–528] |
| 1082 | [1–480] | 1131 | [1–471] | 1207 | [127–469] | 1254 | [1–515] |
| 1083 | [1–490] | 1132 | [1–528] | 1208 | [1–457] | 1255 | [1–512] |
| 1084 | [56–418] | 1133 | [1–349] | 1209 | [1–487] | 1256 | [1–481] |
| 1085 | [165–491] | 1134 | [112–506] | 1210 | [1–601] | 1257 | [1–484] |
| 1086 | [93–415] | 1135 | [1–564] | 1211 | [1–561] | 1258 | [1–360] |
| 1087 | [1–482] | 1136 | [1–522] | 1212 | [1–454] | 1259 | [1–525] |
| 1088 | [1–33],[150–254] | 1137 | [1–524] | 1213 | [1–402] | 1260 | [1–371],[450–554] |
| 1089 | [1–133] | 1138 | [1–356] | 1214 | [48–268],[480–519] | 1261 | [1–651] |
| 1091 | [1–625] | 1139 | [1–609] | 1262 | [1–491] | 1312 | [1–516] |
| 1092 | [1–484] | 1140 | [1–479] | 1263 | [1–508] | 1313 | [1–471] |
| 1093 | [1–495] | 1141 | [1–494] | 1264 | [1–490] | 1314 | [1–504] |
| 1094 | [1–513] | 1142 | [1–94],[49–393] | 1265 | [1–540] | 1315 | [1–492] |
| 1095 | [1–101],[195–294],[385–519] | 1143 | [1–510] | 1266 | [1–308] | 1316 | [1–333] |
| 1096 | [1–353],[386–439] | 1144 | [1–468] | 1267 | [1–516] | 1317 | [159–471] |
| 1097 | [1–550] | 1145 | [1–239] | | | | |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 1268 | [1–612] | 1318 | [1–505] | 1392 | [1–540] | 1440 | [1–203],[293–587] |
| 1269 | [499–544] | 1319 | [1–562] | 1393 | [1–137],[194–498] | 1441 | [1–343] |
| 1270 | [1–497] | 1320 | [1–369] | 1394 | [1–174] | 1442 | [1–523] |
| 1271 | [1–530] | 1321 | [1–375],[414–470] | 1395 | [1–340] | 1443 | [1–466] |
| 1272 | [1–474] | 1322 | [1–249] | 1396 | [1–510] | 1444 | [1–510] |
| 1273 | [1–435] | 1323 | [1–204] | 1398 | [1–490] | 1445 | [1–239] |
| 1274 | [1–227] | 1324 | [1–240] | 1399 | [1–227],[311–477] | 1446 | [1–484] |
| 1275 | [113–519] | 1325 | [1–212] | 1400 | [1–428] | 1447 | [1–26],[318–364] |
| 1276 | [1–540] | 1326 | [1–511] | 1401 | [1–426] | 1448 | [1–461] |
| 1277 | [1–496] | 1327 | [1–480] | 1402 | [1–496] | 1449 | [1–240] |
| 1278 | [1–487] | 1328 | [1–472] | 1403 | [1–524] | 1450 | [1–239] |
| 1279 | [1–482] | 1329 | [1–453] | 1404 | [1–484] | 1451 | [1–240] |
| 1280 | [1–603] | 1330 | [1–498] | 1405 | [1–481] | 1452 | [1–239] |
| 1281 | [1–75] | 1331 | [1–86],[177–527] | 1406 | [1–769] | 1453 | [1–686] |
| 1282 | [1–512] | 1332 | [1–477] | 1407 | [1–568] | 1454 | [1–98],[344–421] |
| 1283 | [1–519] | 1333 | [1–349] | 1408 | [1–241] | 1455 | [1–506] |
| 1284 | [1–476] | 1334 | [1–394] | 1456 | [1–491] | 1503 | [1–372] |
| 1285 | [1–304],[361–478] | 1335 | [1–341] | 1457 | [1–487] | 1504 | [1–374] |
| 1286 | [226–518] | 1336 | [1–318] | 1458 | [318–437] | 1505 | [1–559] |
| 1287 | [1–490] | 1337 | [1–480] | 1459 | [1–522] | 1506 | [1–524] |
| 1288 | [1–301],[358–490] | 1338 | [1–212] | 1460 | [1–379] | 1508 | [1–692] |
| 1289 | [1–420] | 1339 | [1–409] | 1461 | [1–474] | 1509 | [1–459] |
| 1290 | [1–512] | 1340 | [255–358],[465–509] | 1462 | [425–469] | 1510 | [1–433] |
| 1291 | [1–527] | 1341 | [168–279] | 1463 | [1–830] | 1511 | [1–537] |
| 1292 | [1–160] | 1342 | [1–464] | 1464 | [354–496] | 1512 | [100–456] |
| 1293 | [1–484] | 1343 | [328–602] | 1465 | [573–623] | 1513 | [1–484] |
| 1294 | [1–366] | 1345 | [1–83],[121–225],[255–645] | 1466 | [1–82],[211–411] | 1514 | [1–509] |
| 1295 | [1–467] | 1346 | [1–83],[121–225],[255–422],[455–648] | 1467 | [1–360],[402–510] | 1515 | [1–124] |
| 1296 | [1–493] | 1347 | [1–169],[522–582] | 1468 | [1–487] | 1516 | [1–543] |
| 1297 | [1–27] | 1348 | [1–442] | 1469 | [1–481] | 1517 | [1–752] |
| 1298 | [150–472] | 1349 | [204–489] | 1470 | [1–505] | 1518 | [37–101],[154–453] |
| 1300 | [1–562] | 1350 | [177–201],[240–509] | 1471 | [1–603] | 1519 | [1–358] |
| 1301 | [170–502] | 1351 | [1–262] | 1472 | [1–113],[361–486] | 1520 | [1–426] |
| 1302 | [1–639] | 1352 | [1–452] | 1473 | [1–387] | 1521 | [1–461] |
| 1305 | [1–375] | 1353 | [1–477] | 1474 | [101–219],[254–520] | 1522 | [1–501] |
| 1306 | [1–265],[370–484] | 1354 | [1–511] | 1475 | [1–472] | 1523 | [1–498] |
| 1307 | [1–485] | 1355 | [1–619] | 1476 | [1–486] | 1524 | [1–444] |
| 1308 | [1–339] | 1356 | [1–1108] | 1477 | [1–1111] | 1525 | [1–512] |
| 1309 | [1–450] | 1357 | [1–380] | 1478 | [1–113],[361–414],[450–516] | 1526 | [1–589] |
| 1310 | [1–459] | 1358 | [1–523] | 1479 | [1–532] | 1527 | [1–566] |
| 1311 | [1–487] | 1359 | [58–389],[447–518] | 1480 | [1–468] | 1528 | [1–349] |
| 1360 | [1–486] | 1409 | [1–475] | 1481 | [244–444] | 1529 | [1–511] |
| 1361 | [212–822] | 1410 | [1–552] | 1482 | [1–415] | 1530 | [1–547] |
| 1362 | [1–642] | 1411 | [1–470] | 1483 | [1–573] | 1532 | [1–459] |
| 1363 | [1–469] | 1412 | [1–475] | 1484 | [1–450] | 1533 | [1–327],[436–509] |
| 1364 | [1–489] | 1413 | [1–273] | 1485 | [1–512] | 1534 | [1–502] |
| 1365 | [1–567] | 1414 | [1–504] | 1486 | [1–480] | 1535 | [1–597] |
| 1366 | [1–106],[526–639] | 1415 | [1–80],[114–583] | 1487 | [104–485] | 1536 | [1–492] |
| 1367 | [39–148] | 1416 | [1–65],[132–404] | 1488 | [1–520] | 1537 | [1–452] |
| 1368 | [1–498] | 1417 | [1–420] | 1489 | [1–436] | 1538 | [1–496] |
| 1369 | [1–617] | 1418 | [1–498] | 1490 | [1–678] | 1539 | [1–501] |
| 1370 | [1–452] | 1419 | [1–525] | 1491 | [1–453] | 1540 | [1–524] |
| 1371 | [1–511] | 1420 | [1–490] | 1492 | [1–483] | 1541 | [1–536] |
| 1372 | [1–514] | 1421 | [1–539] | 1493 | [1–496] | 1542 | [1–451] |
| 1373 | [1–453] | 1422 | [1–520] | 1494 | [172–229],[262–370] | 1543 | [1–923] |
| 1374 | [1–514] | 1423 | [1–476] | 1495 | [1–427] | 1544 | [1–463] |
| 1375 | [1–490] | 1424 | [90–430] | 1496 | [1–510] | 1545 | [1–480] |
| 1376 | [1–25],[266–476] | 1425 | [1–544] | 1497 | [1–86],[494–540] | 1546 | [1–213] |
| 1377 | [1–41],[159–434] | 1426 | [1–386],[469–596] | 1498 | [1–776] | 1547 | [1–465] |
| 1378 | [112–476] | 1427 | [1–356] | 1499 | [1–334] | 1548 | [1–496] |
| 1379 | [1–503] | 1428 | [1–325] | 1500 | [1–454] | 1549 | [1–468] |
| 1380 | [1–475] | 1429 | [1–540] | 1501 | [1–435] | 1550 | [1–544] |
| 1381 | [271–470] | 1430 | [1–495] | 1502 | [1–270] | 1551 | [1–508] |
| 1382 | [1–579] | 1431 | [1–494] | 1552 | [1–124],[244–375],[415–440] | 1599 | [176–207],[317–682] |
| 1383 | [1–362] | 1432 | [39–553] | 1553 | [1–679] | 1600 | [1–292] |
| 1384 | [1–902] | 1433 | [59–389] | 1554 | [1–357] | 1601 | [1–465] |
| 1385 | [1–504] | 1434 | [1–500] | 1555 | [1–546] | 1602 | [79–561] |
| 1387 | [1–337] | 1435 | [1–510] | 1556 | [1–430] | 1603 | [1–555] |
| 1388 | [1–337],[451–492] | 1436 | [1–255],[322–433] | 1557 | [1–492] | 1604 | [1–678] |
| 1389 | [1–40] | 1437 | [1–497] | 1558 | [1–540] | 1605 | [1–200] |
| 1390 | [1–412] | 1438 | [1–336] | 1559 | [1–490] | 1606 | [1–583] |
| 1391 | [1–803] | 1439 | [198–352] | 1560 | [152–584] | 1607 | [1–67],[153–433],[482–506] |
| | | | | 1561 | [1–466] | 1608 | [1–355] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 1562 | [1–525] | 1609 | [1–453] | 1680 | [1–686] | 1727 | [1–567] |
| 1563 | [1–515] | 1610 | [1–491] | 1681 | [1–412] | 1728 | ]104–507] |
| 1564 | [1–522] | 1611 | [193–354] | 1682 | [1–517] | 1729 | [1–482] |
| 1565 | [1–478] | 1612 | [1–427] | 1683 | [1–166],[455–486] | 1730 | [1–470] |
| 1566 | [1–474] | 1613 | [1–425] | 1684 | [1–523] | 1731 | [1–483] |
| 1567 | [1–521] | 1614 | [245–464] | 1685 | [1–691] | 1732 | [1–491] |
| 1568 | [1–499] | 1615 | [1–513] | 1686 | [1–448] | 1733 | [1–568] |
| 1569 | [1–673] | 1616 | [1–954] | 1687 | [1–517] | 1734 | [1–540] |
| 1570 | [69–509] | 1617 | [1–483] | 1688 | [1–456] | 1735 | [41–440] |
| 1571 | [1–482] | 1618 | [1–461] | 1689 | [1–506] | 1736 | [1–505] |
| 1572 | [1–322] | 1619 | [1–468] | 1690 | [1–464] | 1737 | [1–712] |
| 1573 | [1–502] | 1620 | [82–113],[336–397] | 1691 | [1–415] | 1738 | [1–649] |
| 1574 | [1–566] | 1621 | [284–499] | 1692 | [1–472] | 1739 | [122–231],[421–451] |
| 1575 | [213–503] | 1622 | [1–526] | 1740 | [1–296] | 1787 | [1–308] |
| 1576 | [1–529] | 1623 | [1–513] | 1741 | [1–478] | 1788 | [60–327] |
| 1577 | [1–187],[241–468] | 1624 | [1–477] | 1742 | [1–454] | 1789 | [1–462] |
| 1578 | [1–267],[303–404] | 1625 | [1–521] | 1743 | [1–630] | 1790 | [1–480] |
| 1579 | [1–494] | 1626 | [1–463] | 1744 | [1–512] | 1791 | [1–549] |
| 1580 | [1–510] | 1627 | [1–508] | 1745 | [1–767] | 1792 | [1–558] |
| 1581 | [125–435] | 1628 | [1–321] | 1746 | [1–363] | 1793 | [1–498] |
| 1582 | [1–487] | 1629 | [1–348] | 1747 | [1–380],[409–478] | 1794 | [1–477] |
| 1583 | [1–455] | 1630 | [1–486] | 1748 | [1–404] | 1795 | [1–513] |
| 1584 | [1–501] | 1631 | [1–472] | 1749 | [1–394] | 1796 | [1–41],[281–341], [383–554] |
| 1585 | [1–492] | 1632 | [1–545] | | | | |
| 1586 | [64–499] | 1633 | [1–453] | 1750 | [1–237],[311–587] | 1797 | [1–497] |
| 1587 | [90–258] | 1634 | [1–485] | 1751 | [1–380],[491–582] | 1798 | [1–513] |
| 1588 | [1–484] | 1635 | [1–342],[413–457], [493–570] | 1752 | [1–475] | 1799 | [1–503] |
| | | | | 1753 | [1–513] | 1800 | [1–489] |
| 1589 | [1–428] | 1636 | [1–476] | 1754 | [1–475] | 1801 | [1–428] |
| 1590 | [1–360] | 1637 | [1–183] | 1755 | [1–487] | 1802 | [1–509] |
| 1591 | [1–486] | 1638 | [1–437] | 1756 | [1–450] | 1803 | [1–55],[85–285], [314–361],[441–565] |
| 1592 | [1–36],[471–518] | 1639 | [1–478] | | | | |
| 1593 | [1–611] | 1640 | [1–183],[213–484] | 1757 | [1–700] | 1804 | [1–463] |
| 1594 | [1–362] | 1641 | [1–379] | 1758 | [1–517] | 1805 | [1–477] |
| 1595 | [1–467] | 1642 | [1–456] | 1759 | [1–253] | 1806 | [1–405] |
| 1596 | [1–28],[70–112], [164–254],[305–541] | 1643 | [1–600] | 1760 | [1–288] | 1807 | [1–485] |
| | | | | 1761 | [1–475] | 1808 | [1–526] |
| 1597 | [1–232],[398–435] | 1644 | [1–352] | 1762 | [1–458] | 1809 | [1–483] |
| 1598 | [1–502] | 1645 | [1–468] | 1763 | [1–420] | 1810 | [1–519] |
| 1646 | [1–488] | 1693 | [1–454] | 1764 | [1–493] | 1811 | [1–544] |
| 1647 | [1–370] | 1694 | [1–469] | 1765 | [1–544] | 1812 | [1–490] |
| 1648 | [1–414] | 1695 | [1–293] | 1766 | [1–468] | 1813 | [172–464] |
| 1649 | [1–167],[241–316], [348–398],[428–548] | 1696 | [1–577] | 1767 | [1–495] | 1814 | [1–712] |
| | | | | 1768 | [1–492] | 1815 | [128–165],[268–364], [435–516] |
| 1650 | [1–413] | 1697 | [1–465] | | | | |
| 1651 | [1–437] | 1698 | [1–433] | 1769 | [1–265] | 1816 | [1–475] |
| 1652 | [1–473] | 1699 | [1–354] | 1770 | [1–460] | 1817 | [1–534] |
| 1653 | [1–517] | 1700 | [1–782] | 1771 | [1–664] | 1818 | [1–214],[289–519] |
| 1654 | [1–505] | 1701 | [1–85] | 1772 | [1–581] | 1819 | [84–197],[353–495] |
| 1655 | [1–474] | 1702 | [1–320],[378–456] | 1773 | [51–472] | 1820 | [1–580] |
| 1656 | [1–459] | 1703 | [1–42],[127–457] | 1774 | [195–451] | 1821 | [1–493] |
| 1657 | [1–482] | 1704 | [1–130],[583–621] | 1775 | [1–394],[437–556] | 1822 | [1–579] |
| 1658 | [1–637] | 1705 | [1–544] | 1776 | [446–513] | 1823 | [1–494] |
| 1659 | [1–205],[271–381],[456–552] | 1706 | [1–489] | 1777 | [1–426] | 1824 | [1–482] |
| 1660 | [1–451] | 1707 | [1–542] | 1778 | [1–460] | 1825 | [1–292] |
| 1661 | [1–489] | 1708 | [1–457] | 1779 | [1–434] | 1826 | [1–551] |
| 1662 | [1–396] | 1709 | [1–509] | 1780 | [1–424] | 1827 | [1–547] |
| 1663 | [1–581] | 1710 | [1–494] | 1781 | [1–525] | 1828 | [1–433],[493–642] |
| 1664 | [1–737] | 1711 | [1–511] | 1782 | [295–512] | 1829 | [1–352] |
| 1665 | [37–377] | 1712 | [1–57],[177–529] | 1783 | [1–714] | 1830 | [1–462] |
| 1666 | [1–641] | 1713 | [1–356] | 1784 | [1–175],[280–456] | 1831 | [1–476] |
| 1667 | [1–474] | 1714 | [1–481] | 1785 | [1–477] | 1832 | [1–465] |
| 1668 | [36–377],[429–491] | 1715 | [1–475] | 1786 | [1–622] | 1833 | [249–429],[466–517] |
| 1669 | [1–585] | 1716 | [73–497] | 1834 | [1–454] | 1883 | [1–515] |
| 1670 | [79–267] | 1717 | [1–496] | 1835 | [1–615] | 1884 | [146],[385–491] |
| 1671 | [1–531] | 1718 | [1–476] | 1836 | [1–271],[305–458] | 1885 | [1–392] |
| 1672 | [221–471] | 1719 | [1–506] | 1837 | [1–486] | 1886 | [1–646] |
| 1673 | [1–416] | 1720 | [1–511] | 1838 | [1–470] | 1887 | [1–515] |
| 1674 | [1–476] | 1721 | [1–1062] | 1839 | [1–564] | 1888 | [1–455] |
| 1675 | [1–357] | 1722 | [1–552] | 1840 | [1–473] | 1889 | [1–457] |
| 1676 | [1–406] | 1723 | [301–498] | 1841 | [1–438] | 1890 | [1–465] |
| 1677 | [1–602] | 1724 | [1–444] | 1842 | [1–127],[43 1–476] | 1891 | [1–364],[572–640] |
| 1678 | [1–418] | 1725 | [1–527] | 1843 | [1–29],[119–363] | 1892 | [1–443] |
| 1679 | [1–459] | 1726 | [1–494] | 1844 | [1–466] | 1893 | [1–66] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 1845 | [1–570] | 1894 | [1–741] | 1968 | [1–609] | 2015 | [1–41],[205–354] |
| 1847 | [1–462] | 1895 | [1–542] | 1969 | [1–708] | 2016 | [205–479] |
| 1848 | [1–462] | 1896 | [1–482] | 1970 | [1–496] | 2017 | [1–635] |
| 1849 | [1–459] | 1897 | [1–467] | 1971 | [1–488] | 2018 | [1–502] |
| 1850 | [1–526] | 1898 | [1–480] | 1972 | [1–380],[425–570] | 2019 | [1–603] |
| 1851 | [1–480] | 1899 | [1–484] | 1973 | [328–368],[442–467] | 2020 | [1–473] |
| 1852 | [1–98],[204–517] | 1900 | [1–422] | 1974 | [1–116],[232–426] | 2021 | [1–33],[161–246],[327–515] |
| 1853 | [1–500] | 1902 | [1–25],[365–494] | | | | |
| 1854 | [1–671] | 1903 | [1–481] | 1975 | [98–470] | 2022 | [1–436] |
| 1855 | [1–402] | 1904 | [1–501] | 1976 | [105–398] | 2023 | [1–229] |
| 1856 | [1–510] | 1905 | [1–540] | 1977 | [1–478] | 2024 | [1–594] |
| 1857 | [1–465] | 1906 | [1–144],[452–486] | 2025 | [1–465] | 2072 | [1–461] |
| 1858 | [1–755] | 1907 | [1–474] | 2026 | [144–466] | 2073 | [1–351] |
| 1859 | [1–465] | 1908 | [1–485] | 2027 | [1–525] | 2074 | [1–460] |
| 1860 | [1–420],[462–487] | 1909 | [1–499] | 2028 | [1–345] | 2075 | [1–558] |
| 1861 | [1–270] | 1910 | [1–460] | 2029 | [1–470] | 2076 | [1–384] |
| 1862 | [1–613] | 1911 | [1–462] | 2030 | [140–534] | 2077 | [1–456] |
| 1863 | [175–377],[466–596] | 1912 | [1–503] | 2031 | [1–291] | 2078 | [1–453] |
| 1864 | [1–468] | 1913 | [393–509] | 2032 | [1–450] | 2079 | [1–527] |
| 1865 | [1–492] | 1914 | [1–456] | 2033 | [1–558] | 2080 | [1–469] |
| 1866 | [1–503] | 1915 | [1–506] | 2034 | [1–506] | 2081 | [1–506] |
| 1867 | [1–545],[576–934] | 1916 | [1–234],[284–399],[440–469] | 2035 | [1–492] | 2082 | [1–685] |
| | | | | 2036 | [1–587] | 2083 | [1–504] |
| 1868 | [1–475] | 1917 | [63–484] | 2037 | [1–507] | 2084 | [1–463] |
| 1869 | [1–476] | 1918 | [97–453] | 2038 | [1–99],[128–466] | 2085 | [1–54],[244–419] |
| 1870 | [1–440],[482–509] | 1919 | [1–471] | 2039 | [1–480] | 2086 | [1–504] |
| 1871 | [1–448] | 1920 | [1–663] | 2040 | [1–501] | 2087 | [1–496] |
| 1872 | [1–505] | 1921 | [1–488] | 2041 | [1–395] | 2088 | [1–40],[73–432] |
| 1873 | [1–935] | 1922 | [32–492] | 2042 | [1–494] | 2089 | [1–483] |
| 1874 | [1–514] | 1923 | [1–42],[123–388] | 2043 | [1–483] | 2090 | [1–480] |
| 1876 | [1–436] | 1924 | [1–473] | 2044 | [1–481] | 2091 | [1–488] |
| 1877 | [1–667] | 1925 | [1–487] | 2045 | [1–471] | 2092 | [1–483] |
| 1878 | [1–787] | 1926 | [1–464] | 2046 | [1–462] | 2093 | [1–311] |
| 1879 | [1–493] | 1927 | [1–475] | 2047 | [1–594] | 2094 | [1–159],[284–452] |
| 1880 | [1–466] | 1928 | [47–496] | 2048 | [1–526] | 2095 | [1–446] |
| 1881 | [1–319] | 1929 | [1–471] | 2049 | [1–421] | 2096 | [1–495] |
| 1882 | [1–501] | 1930 | [1–488] | 2050 | [1–483] | 2097 | [1–478] |
| 1931 | [1–36],[248–475] | 1978 | [1–491] | 2051 | [1–539] | 2098 | [1–460] |
| 1932 | [1–232],[272–509] | 1979 | [30–212] | 2052 | [1–399] | 2099 | [1–223],[278–346],[437–477] |
| 1933 | [1–451] | 1980 | [1–370] | | | | |
| 1934 | [1–530] | 1981 | [1–334] | 2053 | [414–532],[731–820) | 2100 | [1–160],[285–505] |
| 1935 | [1–63],[239–320],[421–542] | 1982 | [1–471] | 2054 | [1–402] | 2101 | [1–459] |
| 1936 | [1–650] | 1983 | [1–142] | 2055 | [1–662] | 2102 | [1–374] |
| 1937 | [1–302] | 1984 | [1–834] | 2056 | [1–154] | 2103 | [1–384] |
| 1938 | [1–471] | 1985 | [1–507] | 2057 | [1–262] | 2104 | [1–554] |
| 1939 | [1–294] | 1986 | [1–491] | 2058 | [144–475] | 2105 | [1–476] |
| 1940 | [1–294] | 1987 | [1–413] | 2059 | [1–483] | 2106 | [1–71],[113–491] |
| 1941 | [262–315] | 1988 | [1–350] | 2060 | [1–483] | 2107 | [1–461] |
| 1942 | [1–302] | 1989 | [1–458] | 2061 | [1–466] | 2108 | [1–544] |
| 1943 | [1–310] | 1990 | [1–487] | 2062 | [1–422] | 2109 | [1–515] |
| 1944 | [1–281] | 1991 | [1–538] | 2063 | [1–490] | 2110 | [1–352] |
| 1945 | [1–654] | 1992 | [1–453] | 2064 | [1–341] | 2111 | [92–178] |
| 1946 | [1–521] | 1993 | [1–486] | 2065 | [1–448] | 2112 | [1–443] |
| 1947 | [1–1013] | 1994 | [1–482] | 2066 | [1–222] | 2113 | [1–342] |
| 1948 | [1–510] | 1995 | [1–621] | 2067 | [1–461] | 2114 | [62–479] |
| 1949 | [1–472] | 1996 | [1–511] | 2068 | [1–174),[207–617] | 2115 | [[1–470] |
| 1950 | [1–533] | 1997 | [1–477] | 2069 | [1–503] | 2116 | [1–403] |
| 1951 | [1–427] | 1998 | [1–543] | 2070 | [1–499] | 2117 | [1–478] |
| 1952 | [1–449] | 1999 | [1–355] | 2071 | [1–343] | 2118 | [1–485] |
| 1953 | [1–515] | 2000 | [1–497] | 2119 | [1–302],[337–434] | 2166 | [1–520] |
| 1954 | [1–509] | 2001 | [1–486] | 2120 | [1–375] | 2167 | [1–512] |
| 1955 | [1–449] | 2002 | [1–453] | 2121 | [1–407] | 2168 | [1–398] |
| 1956 | [1–482] | 2003 | [85–567] | 2122 | [1–395] | 2169 | [1–493] |
| 1957 | [1–486] | 2004 | [95–490] | 2123 | [1–533] | 2170 | [1–532] |
| 1958 | [1–449] | 2005 | [1–626] | 2124 | [1–448] | 2171 | [1–419] |
| 1959 | [1–450] | 2006 | [319–800] | 2125 | [1–437] | 2172 | [1–506] |
| 1960 | [1–552] | 2007 | [1–432] | 2126 | [1–455] | 2173 | [1–491] |
| 1961 | [1–191],[252–333] | 2008 | [1–495] | 2127 | [1–428] | 2174 | [1–564] |
| 1962 | [1–508] | 2009 | [1–34],[20–216],[245–522] | 2128 | [1–359] | 2175 | [1–474] |
| 1963 | [1–482] | 2010 | [51–421] | 2129 | [1–546] | 2176 | [1–520] |
| 1964 | [1–534] | 2011 | [1–514] | 2130 | [1–501] | 2177 | [1–452] |
| 1965 | [1–491] | 2012 | [1–461] | 2131 | [1–513] | 2178 | [1–456] |
| 1966 | [1–497] | 2013 | [1–42],[206–355] | 2132 | [1–388] | 2179 | [1–482] |
| 1967 | [1–549] | 2014 | [1–518] | 2133 | [1–432] | 2180 | [87–323] |

TABLE IVb-continued (Novelty: 100%)

| Seq Id No | Positions of preferred fragments | Seq Id No | Positions of preferred fragments | Seq Id No | Positions of preferred fragments | Seq Id No | Positions of preferred fragments |
|---|---|---|---|---|---|---|---|
| 2134 | [1–277] | 2181 | [1–467] | 2254 | [1–468] | 2301 | [1–369] |
| 2135 | [1–503] | 2182 | [1–474] | 2255 | [1–535] | 2302 | [1–428] |
| 2136 | [209–458] | 2183 | [1–469] | 2256 | [1–553] | 2303 | [1–507] |
| 2137 | [1–508] | 2184 | [1–379] | 2257 | [1–469] | 2304 | [164–471] |
| 2138 | [1–476] | 2185 | [1–413] | 2258 | [1–508] | 2305 | [1–374] |
| 2139 | [1–479] | 2186 | [1–483] | 2259 | [139–420] | 2306 | [1–457] |
| 2140 | [1–428] | 2187 | [1–451] | 2307 | [67–469] | 2354 | [1–494] |
| 2141 | [1–463] | 2188 | [1–476] | 2308 | [1–499] | 2355 | [1–479] |
| 2142 | [1–497] | 2189 | [1–43] | 2309 | [1–507] | 2356 | [1–79] |
| 2143 | [236–459] | 2190 | [1–379],[419–453] | 2310 | [1–472] | 2357 | [1–456] |
| 2144 | [1–533] | 2191 | [256–569] | 2311 | [1–478] | 2358 | [1–473] |
| 2145 | [149–217] | 2192 | [1–482] | 2312 | [1–468] | 2359 | [1–473] |
| 2146 | [1–431] | 2193 | [34–462] | 2313 | [45–329] | 2360 | [1–540] |
| 2147 | [1–408] | 2194 | [1–487] | 2314 | [1–302] | 2361 | [1–470] |
| 2148 | [1–564] | 2195 | [1–568] | 2315 | [1–372] | 2362 | [1–485] |
| 2149 | [1–295] | 2196 | [1–306] | 2316 | [1–423] | 2363 | [1–495] |
| 2150 | [1–336] | 2197 | [1–462] | 2317 | [1–476] | 2364 | [1–358] |
| 2151 | [1–449] | 2198 | [1–439] | 2318 | [1–238] | 2365 | [154–482] |
| 2152 | [1–572] | 2199 | [1–489] | 2319 | [1–499] | 2366 | [1–355] |
| 2153 | [1–223] | 2200 | [1–544] | 2320 | [1–473] | 2367 | [1–88],[150–469] |
| 2154 | [1–523] | 2201 | [1–485] | 2321 | [1–67],[215–466] | 2368 | [88–218],[269–333],[379–472] |
| 2155 | [1–499] | 2202 | [1–492] | | | | |
| 2156 | [1–600] | 2203 | [1–474] | 2322 | [234–424] | 2369 | [93–262],[326–489] |
| 2157 | [400–510] | 2204 | [1–361] | 2323 | [1–489] | 2370 | [1–248],[307–454] |
| 2158 | [1–486] | 2205 | [1–513] | 2324 | [1–182] | 2371 | [1–388] |
| 2159 | [1–488] | 2206 | [1–481] | 2325 | [1–460] | 2372 | [1–556] |
| 2160 | [1–503] | 2207 | [1–31] | 2326 | [1–269] | 2373 | [1–523] |
| 2161 | [1–470] | 2208 | [1–73],[399–463] | 2327 | [1–493] | 2374 | [1–446] |
| 2162 | [1–169],[332–391] | 2209 | [1–892] | 2328 | [1–496] | 2375 | [1–585] |
| 2163 | [1–458] | 2210 | [1–54],[180–499] | 2329 | [1–493] | 2376 | [1–520] |
| 2164 | [1–495] | 2211 | [1–455] | 2330 | [1–413] | 2377 | [1–487] |
| 2165 | [1–145] | 2212 | [1–474] | 2331 | [1–492] | 2378 | [1–459] |
| 2213 | [1–499] | 2260 | [1–472] | 2332 | [1–452] | 2379 | [1–65],[471–535] |
| 2214 | [1–457] | 2261 | [1–460] | 2333 | [1–456] | 2380 | [1–65],[200–485] |
| 2215 | [1–479] | 2262 | [1–599] | 2334 | [1–443] | 2381 | [37–269] |
| 2216 | [1–481] | 2263 | [59–489] | 2335 | [1–413] | 2382 | [1–155],[184–437] |
| 2217 | [1–239] | 2264 | [1–460] | 2336 | [1–479] | 2383 | [1–489] |
| 2218 | [1–162],[358–510] | 2265 | [105–460] | 2337 | [1–311] | 2384 | [1–660] |
| 2219 | [1–471] | 2266 | [1–386] | 2338 | [1–450] | 2385 | [1–491] |
| 2220 | [1–473] | 2267 | [1–472] | 2339 | [45–378] | 2386 | [1–459] |
| 2221 | [1–286] | 2268 | [1–484] | 2340 | [1–445] | 2387 | [1–517] |
| 2222 | [127–197] | 2269 | [1–502] | 2341 | [1–339] | 2388 | [1–516] |
| 2223 | [77–459] | 2270 | [1–503] | 2342 | [1–295] | 2389 | [1–499] |
| 2224 | [1–102],[185–383] | 2271 | [1–563] | 2343 | [67–478] | 2390 | [199–277],[318–386],[423–523] |
| 2225 | [1–422] | 2272 | [1–486] | | | | |
| 2226 | [1–93],[225–333],[390–526] | 2273 | [1–459] | 2344 | [1–516] | 2391 | [1–45],[282–458] |
| | | | | 2345 | [1–498] | 2392 | [1–856] |
| 2227 | [130–464] | 2274 | [1–330] | 2346 | [1–466] | 2393 | [58–457] |
| 2228 | [1–489] | 2275 | [111–153],[487–514] | 2347 | [1–480] | 2394 | [1–468] |
| 2229 | [1–296] | 2276 | [1–467] | 2348 | [1–202],[236–415] | 2395 | [1–475] |
| 2230 | [1–440] | 2277 | [1–451] | 2349 | [1–317] | 2396 | [1–497] |
| 2231 | [48–457] | 2278 | [1–462] | 2350 | [1–503] | 2397 | [1–584] |
| 2232 | [1–423] | 2279 | [1–372] | 2351 | [1–616] | 2398 | [1–479] |
| 2233 | [1–475] | 2280 | [1–457] | 2352 | [1–115] | 2399 | [1–559] |
| 2234 | [1–459] | 2281 | [1–484] | 2353 | [1–469] | 2400 | [1–459] |
| 2235 | [1–481] | 2282 | [1–537] | 2401 | [189–487] | 2448 | [1–546] |
| 2236 | [1–452] | 2283 | [1–370] | 2402 | [1–306] | 2449 | [1–517] |
| 2237 | [1–415] | 2284 | [1–559] | 2403 | [1–468] | 2450 | [1–463] |
| 2238 | [1–456] | 2285 | [1–464] | 2404 | [1–341] | 2451 | [1–349] |
| 2239 | [1–508] | 2286 | [1–460] | 2405 | [1–467] | 2452 | [1–467] |
| 2240 | [44–471] | 2287 | [1–511] | 2406 | [1–358] | 2453 | [1–571] |
| 2241 | [1–213],[409–467] | 2288 | [1–274],[330–439] | 2407 | [1–438] | 2454 | [1–551] |
| 2242 | [1–473] | 2289 | [34–478] | 2408 | [1–181],[279–374] | 2455 | [1–461] |
| 2243 | [1–333] | 2290 | [1–505] | 2409 | [1–516] | 2456 | [1–481] |
| 2244 | [1–511] | 2291 | [85–502] | 2410 | [1–468] | 2457 | [1–468] |
| 2245 | [1–472] | 2292 | [1–478] | 2411 | [1–325],[394–857] | 2458 | [1–492] |
| 2246 | [1–463] | 2293 | [295–477] | 2412 | [1–506] | 2459 | [1–492] |
| 2247 | [1–494] | 2294 | [1–461] | 2413 | [43–512] | 2460 | [1–511] |
| 2248 | [1–467] | 2295 | [1–311] | 2414 | [1–62],[98–129],[220–548] | 2461 | [1–675] |
| 2249 | [1–419] | 2296 | [1–346] | 2415 | [1–268] | 2462 | [249–498] |
| 2250 | [1–474] | 2297 | [1–476] | 2416 | [1–490] | 2463 | [1–482] |
| 2251 | [1–42],[113–305],[368–499] | 2298 | [1–386] | 2417 | [1–930] | 2464 | [1–499] |
| 2252 | [1–529] | 2299 | [1–181],[216–274] | 2418 | [1–489] | 2465 | [59–498] |
| 2253 | [1–381] | 2300 | [1–433] | 2419 | [1–32],[188–302] | 2466 | [322–489] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 2420 | [1–531] | 2467 | [1–511] | 2542 | [1–484] | 2590 | [1–314],[407–497] |
| 2421 | [1–476] | 2468 | [378–493] | 2591 | [1–541] | 2638 | [80–388] |
| 2422 | [37–360] | 2469 | [1–452] | 2592 | [1–575] | 2639 | [1–444] |
| 2423 | [1–501] | 2470 | [1–556] | 2593 | [179–490] | 2640 | [69–404] |
| 2424 | [1–347] | 2471 | [1–287] | 2594 | [1–522] | 2641 | [66–394] |
| 2425 | [1–488] | 2472 | [1–295] | 2595 | [1–627] | 2642 | [1–444] |
| 2426 | [1–506] | 2473 | [1–465] | 2596 | [1–176],[207–506] | 2643 | [1–439] |
| 2427 | [1–413] | 2474 | [1–451] | 2597 | [1–588] | 2644 | [1–493] |
| 2428 | [1–392] | 2475 | [1–527] | 2598 | [1–504] | 2645 | [1–444] |
| 2429 | [1–391] | 2476 | [91–397] | 2599 | [1–97],[169–465] | 2646 | [1–448] |
| 2430 | [1–510] | 2477 | [1–364] | 2600 | [1–627] | 2647 | [1–522] |
| 2431 | [1–542] | 2478 | [1–467] | 2601 | [1–542] | 2648 | [1–481] |
| 2432 | [1–490] | 2479 | [1–360] | 2602 | [1–451] | 2649 | [1–600] |
| 2433 | [1–537] | 2480 | [1–502] | 2603 | [1–453] | 2650 | [1–492] |
| 2434 | [1–458] | 2481 | [1–537] | 2604 | [148–455] | 2651 | [1–357] |
| 2435 | [1–557] | 2482 | [1–479] | 2605 | [1–538] | 2652 | [1–386] |
| 2436 | [67–493] | 2483 | [91–397] | 2606 | [1–270] | 2653 | [1–361],[509–540] |
| 2437 | [1–363] | 2484 | [1–514] | 2607 | [1–235] | 2654 | [1–440] |
| 2438 | [1–433] | 2485 | [1–582] | 2608 | [1–471] | 2655 | [1–512] |
| 2439 | [1–500],[557–581] | 2486 | [1–420] | 2609 | [1–530] | 2657 | [1–461] |
| 2440 | [1–522] | 2487 | [1–554] | 2610 | [1–489] | 2658 | [1–414] |
| 2441 | [1–319],[352–473] | 2488 | [1–465] | 2611 | [1–468] | 2659 | [1–336] |
| 2442 | [1–444] | 2489 | [1–410] | 2612 | [1–720] | 2660 | [1–341],[379–444] |
| 2443 | [49–451] | 2490 | [1–493] | 2613 | [1–251],[315–556] | 2661 | [1–337] |
| 2444 | [1–451] | 2491 | [1–461] | 2614 | [1–803] | 2662 | [1–465] |
| 2445 | [1–504] | 2492 | [69–533] | 2615 | [1–491] | 2663 | [1–489] |
| 2446 | [1–430] | 2493 | [1–895] | 2616 | [1–478] | 2664 | [1–490] |
| 2447 | [1–485] | 2494 | [1–561] | 2617 | [1–578] | 2665 | [1–470] |
| 2495 | [1–451] | 2543 | [1–544] | 2618 | [1–154],[291–407] | 2666 | [1–396] |
| 2496 | [1–354] | 2544 | [1–25],[56–165],[279–450] | 2619 | [1–276],[313–356],[401–460] | 2667 | [1–368] |
| 2497 | [1–793] | 2545 | [1–584] | 2620 | [1–488] | 2668 | [1–42],[82–553] |
| 2498 | [1–491] | 2546 | [1–438] | 2621 | [1–547] | 2669 | [1–485] |
| 2499 | [1–780] | 2547 | [1–578] | 2622 | [1–429] | 2670 | [1–455] |
| 2500 | [1–300] | 2548 | [159–497] | 2623 | [1–437] | 2671 | [11–117],[508–607] |
| 2501 | [1–466] | 2549 | [1–459] | 2624 | [1–452] | 2672 | [213–479] |
| 2502 | [1–405] | 2550 | [1–478] | 2625 | [1–445] | 2673 | [367–452] |
| 2503 | [1–476] | 2551 | [1–424] | 2626 | [1–442] | 2674 | [1–330] |
| 2504 | [1–219],[327–456] | 2552 | [44–484] | 2627 | [1–446] | 2675 | [1–748] |
| 2505 | [1–180],[509–543] | 2553 | [1–51],[249–390] | 2628 | [1–448] | 2676 | [1–502] |
| 2506 | [1–507] | 2554 | [1–488] | 2629 | [1–441] | 2677 | [1–497] |
| 2507 | [1–311],[388–513] | 2555 | [1–263],[316–477] | 2630 | [1–475] | 2678 | [1–468] |
| 2508 | [1–488] | 2556 | [1–502] | 2631 | [1–443] | 2679 | [1–322],[397–482] |
| 2509 | [1–482] | 2557 | [1–528] | 2632 | [1–469] | 2680 | [1–520] |
| 2510 | [1–489] | 2558 | [1–513] | 2633 | [1–452] | 2681 | [1–484] |
| 2511 | [1–508] | 2559 | [1–346] | 2634 | [1–439] | 2682 | [1–481] |
| 2512 | [1–471] | 2560 | [1–505] | 2635 | [1–488] | 2683 | [1–69],[250–496] |
| 2513 | [1–47],[95–478] | 2561 | [1–473] | 2636 | [1–447] | 2684 | [1–470] |
| 2514 | [1–498] | 2562 | [1–589] | 2637 | [1–484] | 2685 | [1–478] |
| 2515 | [48–152],[198–446] | 2563 | [1–502] | 2686 | [48–350] | 2733 | [1–606] |
| 2516 | [1–553] | 2564 | [1–513] | 2687 | [1–451] | 2734 | [121–554] |
| 2517 | [1–468] | 2566 | [64–510] | 2688 | [1–488] | 2735 | [54–142] |
| 2518 | [1–484] | 2567 | [1–361] | 2689 | [1–505] | 2736 | [1–485] |
| 2519 | [1–488] | 2568 | [1–70],[342–483] | 2690 | [1–491] | 2737 | [1–552] |
| 2520 | [443–525] | 2569 | [1–500] | 2691 | [1–507] | 2738 | [1–451] |
| 2521 | [1–457] | 2570 | [1–624] | 2692 | [1–526] | 2739 | [1–492] |
| 2522 | [1–49],[125–452] | 2571 | [1–483] | 2693 | [1–523] | 2740 | [1–549] |
| 2523 | [1–538] | 2572 | [1–70],[184–345] | 2694 | [1–572] | 2741 | [1–493] |
| 2524 | [1–600] | 2573 | [37–78],[177–363] | 2695 | [1–544] | 2742 | [1–35],[64–182],[251–453] |
| 2525 | [1–390] | 2574 | [1–834] | | | | |
| 2526 | [1–469] | 2575 | [1–530] | 2696 | [1–494] | 2743 | [1–546] |
| 2527 | [1–521] | 2576 | [1–456] | 2697 | [1–100] | 2744 | [1–484] |
| 2528 | [1–513] | 2577 | [1–43],[98–534] | 2698 | [1–292],[328–461] | 2745 | [1–534] |
| 2530 | [274–500] | 2578 | [1–43],[98–534] | 2699 | [1–499] | 2746 | [1–491] |
| 2531 | [190–484] | 2579 | [1–556] | 2700 | [1–552] | 2747 | [132–330] |
| 2532 | [1–481] | 2580 | [1–622] | 2701 | [1–466] | 2748 | [1–472] |
| 2533 | [1–429],[459–487] | 2581 | [1–231] | 2702 | [1–224],[253–308],[385–409] | 2749 | [1–407] |
| 2534 | [1–465] | 2582 | [1–211] | 2703 | [1–511] | 2750 | [1–607] |
| 2535 | [1–463] | 2583 | [1–231] | 2704 | [1–464] | 2751 | [1–548] |
| 2536 | [1–484] | 2584 | [155–647] | 2705 | [1–590] | 2752 | [1–496] |
| 2537 | [1–125],[292–533] | 2585 | [1–476] | 2706 | [97–484] | 2753 | [1–352] |
| 2538 | [1–516] | 2586 | [1–482] | 2707 | [64–196],[298–483] | 2754 | [1–447] |
| 2539 | [1–183],[317–484] | 2587 | [1–560] | 2708 | [1–517] | 2755 | [79–302],[465–526] |
| 2540 | [1–985] | 2588 | [1–541] | 2709 | [1–474] | 2757 | [1–551] |
| 2541 | [1–508] | 2589 | [1–492] | 2710 | [1–473] | 2758 | [1–476] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 2711 | [1–513] | 2759 | [131–563] | 2880 | [1–482] | 2927 | [1–577] |
| 2712 | [1–513] | 2760 | [1–670] | 2881 | [1–575] | 2928 | [1–489] |
| 2713 | [1–501] | 2761 | [1–183] | 2882 | [1–543] | 2929 | [1–474] |
| 2714 | [1–506] | 2762 | [1–241],[355–472] | 2883 | [1–456] | 2930 | [1–466] |
| 2715 | [1–471] | 2763 | [1–48] | 2884 | [1–560] | 2931 | [1–199],[376–709] |
| 2716 | [1–525] | 2764 | [1–481] | 2885 | [1–478] | 2932 | [1–581] |
| 2717 | [1–515] | 2765 | [1–509] | 2886 | [1–36] | 2933 | [1–300],[342–407], [455–530] |
| 2718 | [1–521] | 2766 | [1–436] | | | | |
| 2719 | [1–399] | 2767 | [1–424] | 2887 | [1–503] | 2934 | [1–218],[410–486] |
| 2720 | [1–107],[138–481] | 2768 | [1–423] | 2888 | [102–166] | 2935 | [221–471] |
| 2721 | [1–497] | 2769 | [1–556] | 2889 | [1–467] | 2936 | [1–464] |
| 2722 | [1–126],[382–414] | 2770 | [1–333] | 2890 | [174–331],[399–482] | 2937 | [1–515] |
| 2723 | [1–498] | 2771 | [1–320] | 2891 | [1–489] | 2938 | [57–264],[439–772] |
| 2724 | [1–506] | 2772 | [1–247],[403–506] | 2892 | [65–284],[329–499] | 2939 | [35–103],[240–278] |
| 2725 | [1–890] | 2773 | [1–517] | 2893 | [1–459] | 2940 | [1–199],[376–687] |
| 2726 | [1–517] | 2774 | [1–572] | 2894 | [1–547] | 2941 | [1–440] |
| 2727 | [1–583] | 2775 | [1–647] | 2895 | [1–76],[223–459] | 2942 | [1–179],[215–518] |
| 2728 | [1–201],[324–569] | 2776 | [1–504] | 2896 | [1–296],[349–644] | 2943 | [1–509] |
| 2729 | [1–549] | 2777 | [69–506] | 2897 | [1–463] | 2944 | [1–465] |
| 2730 | [1–153],[276–470] | 2778 | [1–490] | 2898 | [1–527] | 2945 | [1–543] |
| 2731 | [129–279] | 2779 | [1–471] | 2899 | [1–511] | 2946 | [1–402] |
| 2732 | [1–477] | 2780 | [1–502] | 2900 | [1–390],[451–486] | 2947 | [226–296] |
| 2781 | [1–630] | 2828 | [1–516] | 2901 | [1–284] | 2948 | [1–233],[340–498] |
| 2782 | [133–482] | 2829 | [1–152] | 2902 | [1–721] | 2949 | [46–505] |
| 2783 | [1–195],[428–488] | 2830 | [1–535] | 2903 | [1–269] | 2950 | [1–540] |
| 2784 | [1–555] | 2831 | [1–421] | 2904 | [1–506] | 2951 | [1–506] |
| 2785 | [1–527] | 2832 | [1–625] | 2905 | [1–474] | 2952 | [1–525] |
| 2786 | [1–430] | 2833 | [1–461] | 2906 | [1–387] | 2953 | [1–272] |
| 2787 | [1–527] | 2834 | [1–444] | 2907 | [1–523] | 2954 | [1–519] |
| 2788 | [1–504] | 2835 | [1–400] | 2908 | [1–539] | 2955 | [1–395] |
| 2789 | [1–485] | 2836 | [1–542] | 2909 | [1–255] | 2956 | [1–251] |
| 2790 | [1–487] | 2837 | [1–467] | 2910 | [1–471] | 2957 | [1–257] |
| 2791 | [1–483] | 2838 | [1–517] | 2911 | [1–531] | 2958 | [1–462] |
| 2792 | [1–903] | 2839 | [1–469] | 2912 | [1–475] | 2959 | [1–590] |
| 2793 | [1–472] | 2840 | [1–414] | 2913 | [1–483] | 2960 | [1–271] |
| 2794 | [1–501] | 2841 | [1–284] | 2914 | [1–122],[320–571] | 2961 | [1–371] |
| 2795 | [1–455] | 2842 | [1–453] | 2915 | [1–495] | 2962 | [1–499] |
| 2796 | [1–460] | 2843 | [50–473] | 2916 | [1–453] | 2963 | [1–539] |
| 2797 | [1–459] | 2844 | [1–88],[201–305] | 2917 | [77–368] | 2964 | [1–499] |
| 2798 | [1–457] | 2845 | [1–192],[493–567] | 2918 | [1–236] | 2965 | [80–452] |
| 2799 | [1–462] | 2846 | [1–158] | 2919 | [1–519] | 2966 | [1–452] |
| 2800 | [1–455] | 2847 | [1–72] | 2920 | [1–454] | 2968 | [1–97],[411–575] |
| 2801 | [1–457] | 2848 | [1–158] | 2921 | [1–392],[452–492] | 2969 | [1–520] |
| 2802 | [1–457] | 2849 | [1–521] | 2970 | [1–447],[508–534] | 3017 | [1–469] |
| 2803 | [1–456] | 2850 | [1–453] | 2971 | [1–491] | 3018 | [1–531] |
| 2804 | [1–458] | 2851 | [1–470] | 2972 | [1–477] | 3019 | [1–390],[452–610] |
| 2805 | [1–472] | 2852 | [1–512] | 2973 | [1–119] | 3020 | [119–466] |
| 2806 | [1–483] | 2853 | [1–483] | 2974 | [36–517] | 3021 | [1–530] |
| 2807 | [1–474] | 2854 | [1–522] | 2975 | [1–611] | 3022 | [1–436] |
| 2808 | [1–464] | 2855 | [1–527] | 2976 | [1–470] | 3023 | [1–494] |
| 2809 | [1–262],[316–605] | 2856 | [1–528] | 2977 | [1–398] | 3024 | [1–488] |
| 2810 | [1–510] | 2857 | [1–444] | 2978 | [1–517] | 3025 | [471–582] |
| 2811 | [1–499] | 2858 | [1–496] | 2979 | [1–491] | 3026 | [1–355] |
| 2812 | [1–515] | 2859 | [1–488] | 2980 | [1–484] | 3027 | [1–807] |
| 2813 | [1–832] | 2860 | [1–510] | 2981 | [140–291],[399–577] | 3028 | [1–254] |
| 2814 | [1–41],[98–552] | 2861 | [1–486] | 2982 | [51–555] | 3029 | [1–533] |
| 2815 | [1–33],[200–407] | 2862 | [1–490] | 2983 | [1–507] | 3030 | [1–505] |
| 2816 | [1–31] | 2863 | [1–330],[437–536] | 2984 | [1–349] | 3031 | [1–520] |
| 2817 | [1–494] | 2864 | [1–495] | 2985 | [1–783] | 3032 | [1–585] |
| 2818 | [1–253] | 2865 | [1–497] | 2986 | [128–502] | 3033 | [76–420] |
| 2819 | [1–529] | 2866 | [1–494] | 2987 | [1–342] | 3034 | [1–407] |
| 2820 | [1–1035] | 2867 | [1–539] | 2988 | [1–272] | 3035 | [1–156] |
| 2821 | [1–492] | 2868 | [1–713] | 2989 | [1–478] | 3036 | [1–375] |
| 2822 | [1–509] | 2869 | [1–476] | 2990 | [1–482] | 3037 | [1–462] |
| 2823 | [1–515] | 2870 | [69–145],[267–531] | 2991 | [1–515] | 3038 | [1–510] |
| 2824 | [1–524] | 2871 | [69–145],[267–468] | 2992 | [1–480] | 3039 | [1–139],[260–483] |
| 2825 | [138–524] | 2872 | [49–496] | 2993 | [1–476] | 3040 | [1–93],[149–409] |
| 2826 | [218–469] | 2873 | [1–524] | 2994 | [1–499] | 3041 | [1–524] |
| 2827 | [1–476] | 2874 | [1–486] | 2995 | [1–509] | 3042 | [1–504] |
| 2875 | [1–494] | 2922 | [1–518] | 2996 | [49–466] | 3043 | [1–486] |
| 2876 | [1–486] | 2923 | [1–504] | 2997 | [1–486] | 3044 | [1–491] |
| 2877 | [1–706] | 2924 | [1–615] | 2998 | [1–546] | 3045 | [1–519] |
| 2878 | [1–531] | 2925 | [1–514] | 2999 | [1–345] | 3046 | [1–477] |
| 2879 | [1–502] | 2926 | [1–483] | 3000 | [1–482] | 3047 | [1–523],[661–691] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3001 | [1–26] | 3048 | [1–465] | 3170 | [1–563] | 3218 | [1–517] |
| 3002 | [1–483] | 3049 | [177–300],[367–563] | 3171 | [1–409] | 3219 | [1–509] |
| 3003 | [1–518] | 3050 | [1–515] | 3172 | [1–172],[218–470],[596–826] | 3220 | [1–461] |
| 3004 | [1–393] | 3051 | [1–642] | 3173 | [1–455] | 3221 | [1–492] |
| 3005 | [1–61],[354–557] | 3052 | [160–751] | 3174 | [1–465] | 3222 | [1–347] |
| 3006 | [1–388] | 3053 | [1–418],[760–787] | 3175 | [1–484] | 3223 | [1–517] |
| 3007 | [1–548] | 3054 | [1–386] | 3176 | [1–45],[106–273],[307–482] | 3224 | [1–473] |
| 3008 | [1–513] | 3055 | [1–561] | 3177 | [1–482] | 3225 | [1–497] |
| 3009 | [1–491] | 3056 | [1–233] | 3178 | [1–497] | 3226 | [1–601] |
| 3010 | [138–507] | 3057 | [1–468] | 3179 | [1–485] | 3227 | [1–516] |
| 3011 | [1–674] | 3058 | [1–558] | 3180 | [1–401] | 3228 | [1–513] |
| 3012 | [1–505] | 3059 | [1–481] | 3181 | [1–246],[372–442],[488–517] | 3229 | [1–525] |
| 3013 | [1–557] | 3060 | [1–494] | 3182 | [1–577] | 3230 | [1–103],[448–548] |
| 3014 | [1–467] | 3061 | [1–523] | 3183 | [1–84],[149–207],[320–451] | 3231 | [1–103],[381–440] |
| 3015 | [1–338] | 3062 | [1–537] | 3184 | [1–394] | 3232 | [1–523] |
| 3016 | [1–513] | 3063 | [1–470] | 3185 | [1–556] | 3233 | [1–399] |
| 3064 | [1–519] | 3113 | [1–451] | 3186 | [1–539] | 3234 | [197–532] |
| 3065 | [1–494] | 3114 | [1–525] | 3188 | [1–444] | 3235 | [1–436] |
| 3066 | [1–456] | 3115 | [1–475] | 3189 | [1–225] | 3236 | [540–580] |
| 3067 | [1–561] | 3116 | [1–445] | 3190 | [1–530] | 3237 | [1–499] |
| 3068 | [1–116],[184–340],[408–463] | 3117 | [1–498] | 3191 | [1–452] | 3238 | [342–587] |
| 3069 | [1–513] | 3118 | [1–509] | 3192 | [1–527] | 3239 | [1–748] |
| 3070 | [1–484] | 3119 | [1–284] | 3193 | [1–757] | 3240 | [1–468] |
| 3071 | [1–473] | 3120 | [1–494] | 3194 | [1–503] | 3241 | [1–690] |
| 3072 | [1–297] | 3121 | [232–436],[604–632] | 3195 | [1–486] | 3242 | [1–92],[172–266],[359–525] |
| 3073 | [1–56],[156–200],[243–506] | 3122 | [232–616] | 3196 | [161–390],[420–489] | 3243 | [1–466] |
| 3074 | [1–484] | 3123 | [1–483] | 3197 | [1–494] | 3244 | [1–504] |
| 3075 | [125–459] | 3124 | [1–479] | 3198 | [1–336] | 3245 | [1–597] |
| 3076 | [1–500] | 3125 | [1–492] | 3199 | [1–328] | 3246 | [1–460] |
| 3077 | [1–44] | 3126 | [1–707] | 3200 | [1–484] | 3247 | [1–565] |
| 3078 | [1–419] | 3127 | [372–503] | 3201 | [1–463] | 3248 | [1–80],[128–432] |
| 3079 | [1–456] | 3128 | [146–479] | 3202 | [1–473] | 3249 | [1–314] |
| 3080 | [1–500] | 3129 | [1–464] | 3203 | [1–85],[379–419] | 3250 | [1–503] |
| 3081 | [1–566] | 3130 | [1–497] | 3204 | [1–443] | 3251 | [1–456] |
| 3082 | [1–529] | 3131 | [1–316] | 3205 | [1–533] | 3252 | [1–344] |
| 3083 | [1–463] | 3132 | [1–464] | 3206 | [1–464] | 3253 | [1–474] |
| 3084 | [1–528] | 3133 | [1–58],[93–546] | 3207 | [1–521] | 3254 | [1–552] |
| 3085 | [1–279] | 3134 | [1–52],[87–556] | 3255 | [1–315],[368–482] | 3302 | [1–418] |
| 3086 | [1–513] | 3135 | [56–452] | 3256 | [1–463] | 3303 | [1–462] |
| 3087 | [290–392] | 3136 | [1–52],[87–460] | 3257 | [1–496] | 3304 | [1–406] |
| 3088 | [290–398] | 3137 | [1–341] | 3258 | [1–533] | 3305 | [101–460] |
| 3099 | [290–400] | 3138 | [1–489] | 3259 | [1–464] | 3306 | [1–478] |
| 3092 | [290–396] | 3139 | [1–408] | 3260 | [1–429] | 3307 | [1–471] |
| 3093 | [1–49],[165–490] | 340 | [1–457] | 3261 | [1–462] | 3308 | [1–524] |
| 3094 | [1–505] | 3141 | [1–549] | 3262 | [1–134],[180–330] | 3309 | [1–309] |
| 3095 | [1–552] | 3142 | [1–438] | 3263 | [1–321] | 3310 | [1–358] |
| 3096 | [1–185],[270–508] | 3143 | [1–513] | 3264 | [401–469] | 3311 | [1–444] |
| 3097 | [1–263],[378–476] | 3144 | [1–336],[505–548] | 3265 | [1–460] | 3312 | [1–932] |
| 3098 | [1–155] | 3145 | [69–238],[286–725] | 3266 | [1–511] | 3313 | [1–549] |
| 3099 | [1–533] | 3146 | [1–476] | 3267 | [1–425] | 3314 | [105–472] |
| 3100 | [1–340] | 3147 | [1–500] | 3268 | [1–453] | 3315 | [1–497] |
| 3101 | [80–187],[332–404] | 3148 | [1–462] | 3269 | [1–503] | 3316 | [1–511] |
| 3102 | [1–450] | 3149 | [1–523] | 3270 | [1–415] | 3317 | [1–414] |
| 3103 | [1–490] | 3150 | [1–864] | 3271 | [167–292],[367–412],[465–529] | 3318 | [1–117],[159–289] |
| 3104 | [1–501] | 3151 | [1–655] | 3272 | [1–353] | 3319 | [1–217],[334–476] |
| 3105 | [1–482] | 3152 | [1–484] | 3273 | [1–401] | 3320 | [1–416] |
| 3106 | [1–557] | 3153 | [1–459] | 3274 | [1–447] | 3321 | [1–212],[329–471] |
| 3107 | [166–542] | 3154 | [1–526] | 3275 | [1–461] | 3322 | [1–133],[218–473] |
| 3108 | [1–451] | 3155 | [1–505] | 3276 | [1–628] | 3323 | [1–254],[406–479] |
| 3109 | [1–484] | 3156 | [308–605] | 3277 | [1–29],[117–475] | 3324 | [1–294] |
| 3110 | [1–428] | 3157 | [1–238],[368–409] | 3278 | [1–476] | 3325 | [1–485] |
| 3111 | [1–491] | 3158 | [1–156],[251–482] | 3279 | [1–527] | 3326 | [1–451] |
| 3112 | [1–480] | 3159 | [172–238],[368–471] | 3280 | [1–185],[392–505] | 3327 | [1–515] |
| 3160 | [1–326],[373–494] | 3208 | [71–222],[344–465] | 3281 | [1–513] | 3328 | [1–527] |
| 3161 | [1–238],[368–451] | 3209 | [1–505] | 3282 | [1–486] | 3329 | [1–74],[148–199],[318–481] |
| 3162 | [1–494] | 3210 | [58–380] | 3283 | [1–555] | 3330 | [1–74],[148–199],[318–370] |
| 3163 | [1–478] | 3211 | [1–578] | | | | |
| 3164 | [1–508] | 3212 | [1–461] | 3284 | [1–471] | 3331 | [1–528] |
| 3165 | [1–498] | 3213 | [1–444] | 3285 | [1–48] | 3332 | [1–465] |
| 3166 | [84–111] | 3214 | [1–457] | 3286 | [1–526] | 3333 | [1–389] |
| 3167 | [1–350] | 3215 | [1–474] | 3287 | [1–479] | 3334 | [1–151],[206–348] |
| 3168 | [1–471] | 3216 | [1–458] | | | | |
| 3169 | [1–490] | 3217 | [1–526] | | | | |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3288 | [1–482] | 3335 | [1–479] | 3456 | [1–450] | 3503 | [1–513] |
| 3289 | [40–218],[440–489] | 3336 | [1–452] | 3457 | [1–571] | 3504 | [1–394] |
| 3290 | [1–176],[221–318],[355–489] | 3337 | [1–846] | 3458 | [1–478] | 3505 | [220–502] |
| 3291 | [1–270] | 3338 | [1–386] | 3459 | [1–565] | 3506 | [268–394],[425–478] |
| 3292 | [1–176],[221–318],[355–435] | 3339 | [1–474] | 3460 | [1–543] | 3507 | [1–497] |
| 3293 | [1–460] | 3340 | [1–431] | 3461 | [130–183],[218–365],[413–461] | 3508 | [1–470] |
| 3294 | [1–450] | 3341 | [1–505] | 3462 | [51–546] | 3509 | [1–98],[149–557] |
| 3295 | [273–513] | 3342 | [1–464] | 3463 | [1–577] | 3510 | [1–25],[64–96],[147–495] |
| 3296 | [1–461] | 3343 | [1–441],[480–596] | 3464 | [1–481] | 3511 | [1–57],[408–477] |
| 3297 | [1–432] | 3344 | [1–496] | 3465 | [1–526] | 3512 | [1–492] |
| 3298 | [1–32],[70–360] | 3345 | [1–550] | 3466 | [1–75],[168–586],[667–778],[815–875] | 3513 | [1–461] |
| 3299 | [1–459] | 3346 | [78–123],[326–466] | 3467 | [1–99],[272–314],[386–412] | 3514 | [259–469] |
| 3300 | [1–450] | 3347 | [78–351] | 3468 | [33–546] | 3515 | [267–325] |
| 3301 | [1–542] | 3348 | [1–286] | 3469 | [33–495] | 3516 | [1–255] |
| 3349 | [1–527] | 3397 | [1–477] | 3470 | [1–484] | 3517 | [1–297] |
| 3350 | [1–320] | 3398 | [1–451] | 3471 | [1–512] | 3518 | [1–754] |
| 3351 | [1–506] | 3399 | [1–468] | 3472 | [1–492] | 3519 | [1–657] |
| 3353 | [1–461] | 3400 | [1–431] | 3473 | [1–438] | 3520 | [1–490] |
| 3354 | [1–263] | 3401 | [1–461] | 3474 | [1–133],[250–512] | 3521 | [1–517] |
| 3355 | [1–415] | 3402 | [1–319] | 3475 | [1–497] | 3522 | [1–530] |
| 3356 | [1–408] | 3403 | [1–471] | 3476 | [1–511] | 3523 | [1–503] |
| 3357 | [1–532] | 3404 | [1–482] | 3477 | [1–528] | 3524 | [1–545] |
| 3358 | [1–147],[379–475] | 3405 | [1–508] | 3478 | [1–498] | 3525 | [1–572] |
| 3359 | [1–413] | 3406 | [1–726] | 3479 | [1–478] | 3526 | [1–457] |
| 3360 | [1–249],[296–593] | 3407 | [1–170],[209–459] | 3480 | [1–531] | 3527 | [1–614] |
| 3361 | [1–509] | 3408 | [1–455] | 3481 | [1–539] | 3528 | [1–36],[119–502] |
| 3362 | [1–82],[296–699] | 3409 | [1–450] | 3482 | [1–661] | 3529 | [1–182],[261–288],[384–476] |
| 3363 | [1–82],[296–579] | 3410 | [1–451] | | | | |
| 3364 | [1–82],[296–612] | 3411 | [1–417],[451–495] | 3483 | [1–556] | 3530 | [1–454] |
| 3365 | [224–385] | 3412 | [1–484] | 3484 | [1–518] | 3531 | [1–385] |
| 3366 | [1–516] | 3413 | [1–390] | 3485 | [1–546] | 3532 | [1–511] |
| 3367 | [231–447] | 3414 | [1–473] | 3486 | [1–478] | 3533 | [1–421] |
| 3368 | [1–118],[197–568] | 3415 | [1–585] | 3487 | [1–561] | 3534 | [184–218] |
| 3369 | [1–152],[232–397] | 3416 | [1–100],[130–519] | 3488 | [1–478] | 3535 | [1–482] |
| 3370 | [1–501] | 3417 | [1–547] | 3489 | [1–527] | 3536 | [1–428] |
| 3371 | [1–508] | 3418 | [1–509] | 3490 | [1–70],[99–284],[337–482] | 3537 | [1–424] |
| 3372 | [1–384] | 3419 | [1–519] | 3538 | [1–495] | 3587 | [153–489] |
| 3373 | [1–414] | 3420 | [1–436] | 3539 | [1–498] | 3588 | [1–558] |
| 3374 | [1–467] | 3421 | [1–472] | 3540 | [1–500] | 3589 | [1–637] |
| 3375 | [1–544] | 3422 | [1–594] | 3541 | [1–293] | 3590 | [1–477] |
| 3376 | [1–560] | 3423 | [1–429] | 3542 | [1–526] | 3591 | [1–459] |
| 3377 | [1–424] | 3424 | [1–386] | 3543 | [1–520] | 3592 | [101–135],[211–502] |
| 3378 | [1–528] | 3425 | [1–442] | 3544 | [1–406] | 3593 | [56–492] |
| 3379 | [1–461] | 3426 | [1–431] | 3545 | [1–281] | 3594 | [1–512] |
| 3380 | [1–490] | 3427 | [1–484] | 3546 | [1–466] | 3595 | [1–571] |
| 3381 | [1–487] | 3428 | [1–455] | 3547 | [1–470] | 3596 | [1–482] |
| 3382 | [1–738] | 3429 | [243–363] | 3548 | [1–496] | 3597 | [1–70] |
| 3383 | [43–486] | 3430 | [1–804] | 3549 | [1–475] | 3598 | [49–415],[60–756],[786–826] |
| 3384 | [1–162],[332–560] | 3431 | [1–524] | | | | |
| 3385 | [1–421] | 3432 | [1–479] | 3550 | [1–401] | 3599 | [1–656] |
| 3386 | [1–456] | 3433 | [1–473] | 3551 | [1–494] | 3600 | [1–157],[210–236],[284–477] |
| 3387 | [1–480] | 3434 | [1–489] | | | | |
| 3388 | [1–579] | 3435 | [1–588] | 3552 | [1–43],[99–490] | 3601 | [1–150],[203–394] |
| 3389 | [1–566] | 3436 | [1–475] | 3553 | [1–210],[339–523] | 3602 | [1–480] |
| 3390 | [1–452] | 3437 | [1–462] | 3554 | [1–234] | 3603 | [1–460] |
| 3391 | [144–302],[436–526] | 3438 | [1–556] | 3555 | [1–118],[312–664] | 3604 | [1–441] |
| 3392 | [1–478] | 3439 | [1–449] | 3556 | [1–118],[312–581] | 3605 | [1–486] |
| 3393 | [1–341] | 3440 | [1–608] | 3557 | [1–244] | 3606 | [1–469] |
| 3394 | [1–465] | 3441 | [1–453] | 3558 | [1–462] | 3607 | [1–488] |
| 3395 | [1–469] | 3442 | [1–450] | 3559 | [1–548] | 3608 | [1–501] |
| 3396 | [1–316] | 3443 | [1–443],[285–515] | 3560 | [1–461] | 3609 | [1–638] |
| 3444 | [1–439] | 3491 | [30–83],[112–561] | 3561 | [1–540] | 3610 | [1–490] |
| 3445 | [1–168] | 3492 | [30–82],[111–522] | 3562 | [1–453] | 3611 | [1–453] |
| 3446 | [1–741] | 3493 | [1–477] | 3563 | [1–465] | 3612 | [1–204],[383–550],[610–642] |
| 3447 | [1–495] | 3494 | [1–494] | | | | |
| 3448 | [1–518] | 3495 | [183–533] | 3564 | [1–553] | 3613 | [1–377] |
| 3449 | [1–508] | 3496 | [1–470] | 3565 | [1–138],[301–491] | 3614 | [217–493] |
| 3450 | [1–503] | 3497 | [118–520] | 3566 | [1–138],[301–494] | 3615 | [1–194),[239–491] |
| 3451 | [1–452] | 3498 | [1–684] | 3567 | [1–459] | 3616 | [1–549] |
| 3452 | [1–413] | 3499 | [1–465] | 3568 | [1–379],[491–538] | 3617 | [1–489] |
| 3453 | [1–325] | 3500 | [1–609] | 3569 | [1–441],[553–595] | 3618 | [1–753] |
| 3454 | [51–283] | 3501 | [1–511] | 3570 | [1–265] | 3619 | [1–393] |
| 3455 | [1–540] | 3502 | [1–490] | | | | |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3571 | [1–404] | 3620 | [1–482] | 3743 | [1–613] | 3790 | [1–495] |
| 3572 | [1–401],[513–555] | 3621 | [1–299] | 3744 | [1–42],[129–376] | 3791 | [1–398] |
| 3573 | [1–504] | 3622 | [1–479] | 3745 | [1–39],[126–268],[391–427] | 3792 | [1–28],[94–272] |
| 3574 | [1–557] | 3623 | [1–505] | 3746 | [1–418] | 3794 | [1–124],[160–240], [292–321],[358–652] |
| 3575 | [1–494] | 3624 | [1–479] |  |  |  |  |
| 3576 | [1–282] | 3625 | [1–422] | 3747 | [1–27],[192–487] | 3795 | [1–217],[432–471] |
| 3577 | [1–313] | 3626 | [1–407] | 3748 | [1–534] | 3796 | [1–380] |
| 3579 | [1–308] | 3627 | [1–32],[289–553] | 3749 | [1–194],[337–506] | 3797 | [1–186],[259–473] |
| 3580 | [1–407] | 3628 | [1–522] | 3750 | [1–71],[193–424] | 3799 | [1–51],[487–511] |
| 3582 | [1–296] | 3629 | [1–821] | 3751 | [1–444] | 3800 | [1–135] |
| 3583 | [1–516] | 3630 | [1–319] | 3752 | [1–468] | 3801 | [1–462] |
| 3584 | [1–162] | 3631 | [476–500] | 3753 | [1–557] | 3802 | [1–468] |
| 3585 | [1–396] | 3632 | [253–476] | 3754 | [380–495] | 3803 | [1–985] |
| 3586 | [1–472] | 3633 | [1–464] | 3755 | [62–499] | 3804 | [1–509] |
| 3634 | [1–408] | 3683 | [1–243],[411–479] | 3756 | [1–525] | 3805 | [1–400] |
| 3635 | [1–483] | 3684 | [1–370],[482–508] | 3757 | [1–473] | 3806 | [1–450] |
| 3636 | [165–419] | 3685 | [1–427] | 3758 | [1–483] | 3807 | [1–498] |
| 3637 | [1–488] | 3686 | [1–392] | 3759 | [1–518] | 3808 | [1–499] |
| 3638 | [1–474] | 3687 | [1–532] | 3760 | [1–258] | 3809 | [1–590] |
| 3639 | [1–486] | 3688 | [1–471] | 3761 | [1–63],[187–324] | 3810 | [1–503] |
| 3640 | [1–404] | 3689 | [1–525] | 3762 | [1–345] | 3811 | [1–528] |
| 3641 | [1–452] | 3690 | [1–513] | 3763 | [1–477] | 3812 | [1–519] |
| 3642 | [1–484] | 3691 | [1–564] | 3764 | [1–96],[280–480] | 3813 | [1–518] |
| 3643 | [1–295] | 3692 | [116–323],[363–452] | 3765 | [1–504] | 3814 | [1–515] |
| 3644 | [1–485] | 3693 | [1–473] | 3766 | [1–728] | 3815 | [1–480] |
| 3645 | [1–474] | 3694 | [1–461] | 3767 | [42–149],[348–478] | 3816 | [1–458] |
| 3646 | [59–258],[416–473] | 3695 | [1–422] | 3768 | [1–480] | 3817 | [1–329] |
| 3647 | [1–527] | 3696 | [1–365] | 3769 | [1–461] | 3818 | [1–484] |
| 3648 | [1–490] | 3697 | [1–469] | 3770 | [1–460] | 3819 | [1–383],[479–527] |
| 3649 | [1–536] | 3698 | [1–485] | 3771 | [1–618] | 3820 | [1–94],[445–480] |
| 3650 | [1–484] | 3699 | [1–245],[357–716] | 3772 | [220–492] | 3821 | [1–316],[378–449] |
| 3651 | [1–494] | 3700 | [1–526] | 3773 | [1–505] | 3822 | [1–569] |
| 3652 | [1–381] | 3701 | [1–572] | 3774 | [1–60],[102–1041], [1074–1108] | 3823 | [1–453] |
| 3653 | [1–501] | 3702 | [1–543] |  |  |  |  |
| 3654 | [1–595] | 3703 | [1–503] | 3775 | [1–473] | 3824 | [1–491] |
| 3655 | [1–490] | 3704 | [1–485] | 3776 | [1–1100] | 3825 | [1–487] |
| 3656 | [1–30],[271–459] | 3705 | [42–215] | 3826 | [1–603] | 3873 | [1–523] |
| 3657 | [51–457] | 3706 | [1–499] | 3827 | [1–465] | 3874 | [1–613] |
| 3658 | [1–456] | 3707 | [1–400] | 3828 | [1–544] | 3875 | [1–501] |
| 3659 | [1–112],[333–495] | 3708 | [1–633] | 3829 | [1–294],[392–589] | 3876 | [1–497] |
| 3660 | [1–296],[355–423] | 3709 | [1–504] | 3830 | [1–561] | 3877 | [1–453] |
| 3661 | [1–97],[225–297] | 3710 | [1–560] | 3831 | [1–542] | 3878 | [1–275],[352–505] |
| 3662 | [1–362] | 3711 | [1–261],[291–461] | 3832 | [41–456] | 3879 | [1–489] |
| 3663 | [1–1043] | 3712 | [1–479] | 3833 | [1–463] | 3880 | [1–315],[426–707] |
| 3664 | [1–82],[177–445],[497–536] | 3713 | [1–499] | 3834 | [1–592] | 3881 | [1–459] |
| 3665 | [1–94],[222–294],[324–385] | 3714 | [1–480] | 3835 | [1–452] | 3882 | [1–168],[221–485] |
| 3666 | [1–81],[176–444],[496–567] | 3715 | [1–507] | 3836 | [1–298] | 3883 | [1–231] |
| 3667 | [323–397] | 3716 | [1–771] | 3837 | [1–550] | 7744 | [1–108] |
| 3668 | [1–367],[413–467] | 3717 | [1–599] | 3838 | [68–470] | 7745 | [1–89] |
| 3669 | [1–94],[222–294],[324–385] | 3718 | [1–475] | 3839 | [320–536] | 7746 | [1–108] |
| 3670 | [1–71],[322–550] | 3719 | [1–511] | 3840 | [320–508] | 7747 | [1–108] |
| 3671 | [1–110],[288–400] | 3720 | [1–816] | 3841 | [1–421] | 7748 | [1–154] |
| 3673 | [1–110],[359–400] | 3721 | [1–469] | 3842 | [1–377] | 7749 | [1–108] |
| 3674 | [1–426] | 3722 | [1–496] | 3843 | [1–296] | 7750 | [1–96] |
| 3675 | [1–110],[359–400] | 3723 | [1–477] | 3844 | [1–252] | 7751 | [1–153] |
| 3676 | [1–586] | 3724 | [1–469] | 3845 | [1–352] | 7752 | [1–108] |
| 3677 | [70–368],[414–465] | 3725 | [1–60],[208–373] | 3846 | [149–768] | 7753 | [1–101] |
| 3678 | [1–471] | 3726 | [1–523] | 3847 | [172–453] | 7754 | [1–108] |
| 3679 | [1–524] | 3727 | [1–221],[270–579] | 3848 | [1–106],[140–674] | 7755 | [1–113] |
| 3680 | [1–941] | 3728 | [1–455] | 3849 | [1–515] | 7756 | [1–108] |
| 3682 | [1–336] | 3729 | [1–450] | 3850 | [1–514] | 7757 | [1–108] |
| 3730 | [1–394] | 3777 | [1–516] | 3851 | [1–514] | 7758 | [1–108] |
| 3731 | [1–494] | 3778 | [1–687] | 3852 | [1–104],[138–515] | 7759 | [1–406] |
| 3732 | [1–524] | 3779 | [1–203] | 3853 | [1–516] | 7760 | [1–108] |
| 3733 | [1–479] | 3780 | [1–203],[524–555] | 3854 | [1–519] | 7761 | [1–88] |
| 3734 | [193–451] | 3781 | [1–534] | 3855 | [1–516] | 7762 | [1–169] |
| 3735 | [1–377] | 3782 | [1–467] | 3856 | [1–105],[139–428] | 7763 | [1–108] |
| 3736 | [1–496] | 3783 | [1–467] | 3857 | [1–105],[139–428] | 7764 | [1–108] |
| 3737 | [1–458] | 3784 | [1–484] | 3858 | [1–105],[139–516] | 7765 | [1–108] |
| 3738 | [1–145],[376–564] | 3785 | [1–153],[388–442] | 3859 | [1–515] | 7766 | [1–169] |
| 3739 | [1–100],[129–327] | 3786 | [1–420] | 3860 | [1–468] | 7767 | [1–108] |
| 3740 | [1–246] | 3787 | [1–505] | 3861 | [1–99],[355–425] | 7768 | [1–134] |
| 3741 | [1–387] | 3788 | [54–300],[384–491] | 3862 | [1–508] | 7769 | [1–108] |
| 3742 | [1–127],[160–316],[459–603] | 3789 | [[1–488] | 3863 | [1–251] | 7770 | [1–108] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 3864 | [1–513] | 7771 | [1–108] | 7900 | [1–476] | 7948 | [1–140] |
| 3865 | [263–495] | 7772 | [1–266] | 7901 | [1–440] | 7949 | [1–316] |
| 3866 | [1–470] | 7773 | [1–108] | 7902 | [1–357] | 7950 | [1–412] |
| 3867 | [1–482] | 7774 | [1–63] | 7903 | [1–334] | 7951 | [1–431] |
| 3868 | [1–500] | 7775 | [1–299] | 7904 | [1–164] | 7952 | [1–83] |
| 3869 | [1–489] | 7776 | [1–108] | 7906 | [1–170] | 7953 | [1–280] |
| 3870 | [1–503] | 7778 | [1–101] | 7907 | [1–170] | 7954 | [1–171] |
| 3871 | [1–298] | 7779 | [1–63] | 7908 | [143–431] | 7955 | [1–459] |
| 3872 | [1–480] | 7781 | [1–108] | 7909 | [1–445] | 7956 | [1–391] |
| 7782 | [1–154] | 7833 | [1–505] | 7910 | [1–51] | 7957 | [1–384] |
| 7783 | [1–169] | 7834 | [1–187] | 7911 | [1–479] | 7958 | [1–171] |
| 7784 | [1–108] | 7836 | [1–307] | 7912 | [1–84] | 7959 | [1–397] |
| 7785 | [1–108] | 7837 | [1–547] | 7913 | [1–314] | 7960 | [1–244] |
| 7786 | [1–366] | 7838 | [1–263] | 7914 | [1–52] | 7961 | [1–95] |
| 7787 | [1–101] | 7839 | [1–465] | 7915 | [1–123] | 7962 | [1–429] |
| 7788 | [1–144] | 7840 | [1–409] | 7916 | [1–61] | 7963 | [1–334] |
| 7789 | [1–108] | 7841 | [1–307] | 7917 | [1–321] | 7964 | [1–293] |
| 7790 | [1–108] | 7842 | [1–515] | 7918 | [1–65] | 7965 | [212–442] |
| 7791 | [1–108] | 7843 | [1–365] | 7919 | [1–271] | 7966 | [1–152] |
| 7792 | [1–339] | 7844 | [1–308] | 7920 | [1–171] | 7967 | [1–86] |
| 7793 | [1–79] | 7845 | [1–562] | 7921 | [1–356] | 7968 | [1–330] |
| 7794 | [1–63] | 7846 | [1–488] | 7922 | [1–299] | 7969 | [165–442] |
| 7795 | [1–169] | 7847 | [1–467] | 7923 | [1–354] | 7970 | [1–67] |
| 7796 | [1–108] | 7848 | [1–329] | 7924 | [1–455] | 7971 | [1–206] |
| 7798 | [1–108] | 7849 | [1–100] | 7925 | [1–425] | 7972 | [1–73] |
| 7799 | [1–89] | 7850 | [1–100] | 7926 | [1–83] | 7973 | [1–332] |
| 7800 | [1–63] | 7851 | [1–449] | 7927 | [1–313] | 7974 | [1–449] |
| 7801 | [1–150] | 7852 | [1–116] | 7928 | [1–314] | 7976 | [1–270] |
| 7802 | [1–500] | 7853 | [1–58] | 7929 | [1–313] | 7977 | [1–172] |
| 7803 | [1–108] | 7854 | [1–81] | 7978 | [1–321] | 8028 | [1–103] |
| 7804 | [1–108] | 7855 | [1–90] | 7979 | [1–170] | 8030 | [1–104] |
| 7805 | [1–108] | 7856 | [1–118] | 7982 | [1–328] | 8031 | [1–104] |
| 7806 | [1–297] | 7857 | [1–115] | 7983 | [1–58] | 8032 | [1–104] |
| 7807 | [1–357] | 7858 | [1–73] | 7984 | [1–422] | 8033 | [1–77] |
| 7809 | [1–385] | 7859 | [1–56] | 7985 | [1–113] | 8034 | [1–74] |
| 7810 | [1–53] | 7860 | [1–112] | 7986 | [1–163] | 8035 | [1–104] |
| 7811 | [1–381] | 7861 | [1–100] | 7987 | [76–312] | 8036 | [1–58] |
| 7812 | [1–177] | 7862 | [1–184] | 7988 | [1–171] | 8037 | [1–104] |
| 7813 | [1–162] | 7863 | [1–237] | 7989 | [1–192] | 8038 | [1–90] |
| 7814 | [1–319] | 7864 | [1–426] | 7990 | [1–171] | 8039 | [1–65] |
| 7815 | [1–36] | 7865 | [1–367] | 7991 | [1–519] | 8040 | [1–166] |
| 7817 | [1–157] | 7866 | [1–256] | 7992 | [1–67] | 8041 | [1–103] |
| 7818 | [1–158] | 7867 | [1–452] | 7993 | [1–185] | 8042 | [1–79] |
| 7819 | [1–205] | 7869 | [70–214] | 7994 | [1–171] | 8043 | [1–103] |
| 7820 | [84–366] | 7870 | [1–349] | 7995 | [1–436] | 8044 | [1–150] |
| 7821 | [1–361] | 7871 | [1–177] | 7996 | [1–171] | 8045 | [1–360] |
| 7822 | [1–317] | 7872 | [1–494] | 7997 | [1–176] | 8046 | [1–104] |
| 7823 | [1–343] | 7873 | [1–276] | 7998 | [1–429] | 8047 | [1–71] |
| 7824 | [1–343] | 7874 | [1–216] | 7999 | [1–68] | 8048 | [1–92] |
| 7825 | [1–208] | 7875 | [1–106] | 8000 | [1–385] | 8049 | [1–103] |
| 7826 | [76–293] | 7876 | [1–172] | 8001 | [1–324] | 8050 | [1–103] |
| 7827 | [1–242] | 7877 | [1–233] | 8002 | [1–481] | 8051 | [1–132] |
| 7828 | [1–584] | 7878 | [1–155] | 8003 | [1–481] | 8052 | [1–92] |
| 7830 | [1–310] | 7879 | [1–83] | 8004 | [1–421] | 8053 | [1–103] |
| 7831 | [1–548] | 7880 | [1–265] | 8005 | [1–333] | 8054 | [1–103] |
| 7832 | [1–328] | 7881 | [1–508] | 8006 | [1–58] | 8055 | [1–88] |
| 7882 | [1–363] | 7930 | [1–328] | 8007 | [1–475] | 8056 | [1–103] |
| 7883 | [1–314] | 7931 | [1–483] | 8008 | [1–283],[367–435] | 8057 | [1–57] |
| 7884 | [1–501] | 7932 | [1–125] | 8009 | [1–314] | 8058 | [1–191] |
| 7885 | [1–344] | 7933 | [1–314] | 8010 | [1–337] | 8059 | [1–75] |
| 7886 | [1–455] | 7934 | [1–294] | 8011 | [1–310] | 8060 | [1–365] |
| 7887 | [1–401] | 7935 | [1–408] | 8012 | [1–60] | 8061 | [1–65] |
| 7888 | [1–171] | 7936 | [1–279] | 8013 | [1–376] | 8062 | [1–58] |
| 7889 | [1–77] | 7937 | [1–65] | 8014 | [1–463] | 8063 | [1–335] |
| 7890 | [1–328] | 7938 | [1–270] | 8015 | [1–329] | 8064 | [1–198] |
| 7891 | [1–395] | 7939 | [1–369] | 8016 | [1–60] | 8065 | [1–165] |
| 7892 | [1–501] | 7940 | [1–263] | 8017 | [1–408] | 8066 | [1–104] |
| 7893 | [1–329] | 7941 | [141–320] | 8018 | [1–103] | 8067 | [1–165] |
| 7894 | [238–419] | 7942 | [1–315] | 8019 | [1–73] | 8068 | [1–104] |
| 7895 | [1–170] | 7943 | [1–458] | 8020 | [1–96] | 8069 | [1–84] |
| 7896 | [1–170] | 7944 | [1–309] | 8021 | [1–121] | 8070 | [1–164] |
| 7897 | [54–437] | 7945 | [1–238] | 8022 | [1–67] | 8071 | [1–235] |
| 7898 | [1–475] | 7946 | [1–336] | 8023 | [1–58] | 8072 | [1–104] |
| 7899 | [1–314] | 7947 | [1–166] | 8024 | [1–164] | 8073 | [1–177] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 8025 | [1–104] | 8074 | [1–165] | 8204 | [1–344] | 8251 | [1–413] |
| 8027 | [1–163] | 8075 | [1–104] | 8205 | [1–29],[59–85] | 8252 | [1–299] |
| 8076 | [1–58] | 8127 | [1–165] | 8206 | [1–321] | 8253 | [1–350] |
| 8077 | [1–454] | 8128 | [1–104] | 8207 | [1–452] | 8254 | [1–430] |
| 8078 | [1–103] | 8129 | [1–236] | 8208 | [1–185] | 8255 | [1–230] |
| 8080 | [1–103] | 8130 | [1–317] | 8209 | [239–490] | 8257 | [1–63] |
| 8081 | [1–127] | 8131 | [42–463] | 8210 | [1–297] | 8258 | [1–275],[352–393] |
| 8082 | [1–102] | 8132 | [1–54] | 8211 | [1–167] | 8259 | [1–420] |
| 8083 | [139–170] | 8133 | [1–352] | 8212 | [1–403] | 8260 | [1–438] |
| 8084 | [1–103] | 8134 | [1–390] | 8213 | [1–466] | 8261 | [1–419] |
| 8085 | [1–146] | 8135 | [1–441] | 8214 | [1–389] | 8262 | [1–319] |
| 8086 | [1–164] | 8136 | [1–528] | 8215 | [1–428] | 8263 | [1–89] |
| 8087 | [1–103] | 8137 | [1–243] | 8216 | [185–403] | 8264 | [1–139] |
| 8088 | [1–103] | 8138 | [1–368] | 8217 | [1–368] | 8265 | [1–188] |
| 8089 | [1–58] | 8140 | [1–407] | 8218 | [1–197] | 8266 | [1–371] |
| 8090 | [1–97] | 8141 | [1–390] | 8219 | [1–377] | 8267 | [1–447] |
| 8092 | [1–103] | 8143 | [36–151],[474–499] | 8220 | [66–386] | 8268 | [1–402] |
| 8093 | [1–67] | 8144 | [1–537] | 8221 | [1–50] | 8269 | [1–467] |
| 8094 | [1–114] | 8145 | [1–266] | 8222 | [1–359] | 8270 | [1–97],[231–342] |
| 8095 | [1–67] | 8147 | [1–414] | 8223 | [1–468] | 8271 | [1–374] |
| 8096 | [1–58] | 8148 | [71–460] | 8224 | [1–407] | 8272 | [1–196] |
| 8097 | [1–61] | 8149 | [80–428] | 8225 | [1–83] | 8273 | [1–468] |
| 8098 | [1–74] | 8150 | [1–412] | 8226 | [1–473] | 8274 | [1–374] |
| 8099 | [1–377] | 8151 | [1–160] | 8275 | [1–395] | 8323 | [1–353] |
| 8100 | [1–148] | 8152 | [1–165] | 8276 | [1–498] | 8324 | [1–459] |
| 8102 | [1–58] | 8153 | [1–111] | 8277 | [1–240] | 8325 | [1–307] |
| 8103 | [1–58] | 8154 | [1–395] | 8278 | [34–479] | 8326 | [40–412] |
| 8104 | [1–55] | 8155 | [1–445] | 8279 | [1–160],[230–413] | 8327 | [1–277] |
| 8105 | [1–234] | 8156 | [1–407] | 8281 | [1–180] | 8328 | [1–378] |
| 8106 | [1–102] | 8159 | [1–170],[200–396] | 8282 | [1–62] | 8329 | [1–360] |
| 8107 | [1–95] | 8160 | [66–377] | 8283 | [1–442] | 8330 | [1–349] |
| 8108 | [1–72] | 8161 | [1–385] | 8284 | [1–480] | 8331 | [1–457] |
| 8109 | [1–147] | 8162 | [1–367] | 8285 | [1–234],[269–404] | 8332 | [1–90] |
| 8110 | [1–103] | 8163 | [1–153] | 8286 | [1–202] | 8333 | [1–167] |
| 8111 | [1–104] | 8164 | [1–385] | 8287 | [1–353] | 8334 | [1–386] |
| 8112 | [1–138] | 8165 | [1–89] | 8288 | [1–296] | 8335 | [1–389] |
| 8113 | [1–103] | 8166 | [1–325] | 8289 | [1–316] | 8336 | [1–356] |
| 8114 | [1–103] | 8167 | [1–433] | 8290 | [1–290] | 8337 | [1–56] |
| 8115 | [1–104] | 8168 | [1–423] | 8291 | [1–327] | 8338 | [1–311] |
| 8116 | [1–103] | 8170 | [1–399] | 8292 | [1–326],[394–457] | 8339 | [143–289] |
| 8117 | [1–58] | 8171 | [1–56] | 8293 | [1–241] | 8340 | [1–289] |
| 8118 | [1–164] | 8172 | [1–72] | 8294 | [1–287] | 8341 | [1–440] |
| 8119 | [1–58] | 8173 | [34–425] | 8295 | [1–218] | 8342 | [48–391] |
| 8120 | [1–75] | 8174 | [1–444] | 8296 | [1–292] | 8343 | [1–422] |
| 8121 | [1–76] | 8175 | [1–403] | 8297 | [1–280] | 8344 | [1–189],[218–363] |
| 8123 | [1–104] | 8176 | [296–338] | 8298 | [1–100] | 8345 | [1–359] |
| 8124 | [1–58] | 8177 | [1–438] | 8299 | [1–244],[283–339] | 8346 | [1–387] |
| 8125 | [1–210],[371–399] | 8178 | [1–298] | 8300 | [1–369] | 8347 | [1–304] |
| 8126 | [1–29] | 8179 | [1–292] | 8301 | [1–121],[198–346] | 8348 | [1–365] |
| 8180 | [1–153] | 8227 | [1–535] | 8302 | [1–168] | 8349 | [1–327] |
| 8181 | [1–352] | 8228 | [1–378] | 8303 | [1–66] | 8350 | [277–393] |
| 8182 | [1–70] | 8229 | [1–432] | 8304 | [1–106] | 8351 | [1–477] |
| 8183 | [1–347] | 8230 | [1–404] | 8305 | [1–358] | 8352 | [1–425] |
| 8184 | [1–382] | 8231 | [1–72] | 8306 | [1–425] | 8353 | [1–272] |
| 8185 | [1–318] | 8232 | [35–410] | 8307 | [1–393] | 8354 | [1–203] |
| 8186 | [1–383] | 8233 | [1–356] | 8308 | [1–338] | 8355 | [1–83] |
| 8187 | [1–430] | 8234 | [1–122] | 8309 | [1–216] | 8356 | [1–534] |
| 8188 | [1–370] | 8235 | [1–452] | 8310 | [1–333] | 8357 | [1–211] |
| 8189 | [1–157],[192–283] | 8236 | [1–155] | 8311 | [1–414] | 8358 | [1–472] |
| 8190 | [1–379] | 8237 | [1–432] | 8312 | [1–228] | 8359 | [1–416] |
| 8191 | [1–63] | 8238 | [1–444] | 8313 | [1–432] | 8360 | [1–424] |
| 8192 | [1–50] | 8239 | [297–445] | 8314 | [1–107] | 8361 | [1–349] |
| 8193 | [1–310] | 8240 | [1–455] | 8315 | [1–361] | 8363 | [1–361] |
| 8194 | [1–157] | 8241 | [1–189] | 8316 | [1–41],[81–341] | 8364 | [1–344] |
| 8195 | [1–183] | 8242 | [1–65],[180–221],[388–450] | 8317 | [1–416] | 8365 | [1–180] |
| 8196 | [1–408] | 8243 | [1–243] | 8318 | [1–353] | 8366 | [1–268] |
| 8197 | [1–460] | 8244 | [1–463] | 8319 | [1–433] | 8367 | [1–370] |
| 8198 | [1–459] | 8245 | [1–446] | 8320 | [1–337] | 8368 | [1–327] |
| 8199 | [1–447] | 8246 | [1–473] | 8321 | [1–398] | 8369 | [1–360] |
| 8200 | [1–62] | 8247 | [1–549] | 8322 | [1–396] | 8370 | [1–498] |
| 8201 | [1–398] | 8248 | [1–506] | 8371 | [1–77] | 8423 | [1–50] |
| 8202 | [1–448] | 8249 | [1–525] | 8372 | [1–389] | 8424 | [1–312] |
| 8203 | [1–429] | 8250 | [1–435] | 8373 | [1–358] | 8425 | [1–157] |
|  |  |  |  | 8374 | [1–398] | 8426 | [1–83] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 8375 | [1–405] | 8427 | [1–504] | 8505 | [1–375] | 8555 | [1–426] |
| 8376 | [1–143],[257–383] | 8428 | [1–395] | 8506 | [1–364] | 8556 | [1–404] |
| 8377 | [1–150] | 8429 | [1–438] | 8507 | [1–401] | 8557 | [1–318] |
| 8378 | [1–412] | 8430 | [1–73] | 8508 | [1–268],[302–421] | 8558 | [1–171] |
| 8379 | [1–378] | 8431 | [1–79] | 8509 | [1–429] | 8559 | [1–312] |
| 8380 | [1–464] | 8432 | [1–232] | 8510 | [1–406] | 8560 | [1–442] |
| 8381 | [1–351] | 8434 | [1–427] | 8511 | [1–394] | 8561 | [1–318] |
| 8382 | [1–51] | 8435 | [1–309] | 8512 | [1–427] | 8562 | [1–317] |
| 8383 | [1–159] | 8436 | [1–586] | 8514 | [1–396] | 8563 | [1–184] |
| 8384 | [1–440] | 8437 | [1–423] | 8515 | [1–494] | 8564 | [1–136] |
| 8385 | [1–438] | 8438 | [1–465] | 8516 | [1–350] | 8565 | [1–307] |
| 8386 | [90–421] | 8439 | [1–304] | 8517 | [1–388] | 8566 | [1–207] |
| 8387 | [1–401] | 8440 | [1–68] | 8518 | [1–322] | 8567 | [1–136] |
| 8389 | [1–445] | 8441 | [1–125] | 8519 | [1–286] | 8568 | [1–395] |
| 8390 | [1–442] | 8442 | [108–355] | 8520 | [1–411] | 8569 | [1–152] |
| 8391 | [1–419] | 8443 | [1–330] | 8521 | [1–303] | 8570 | [1–184] |
| 8393 | [1–463] | 8444 | [1–403] | 8571 | [1–67] | 8635 | [1–103] |
| 8394 | [77–237],[300–393] | 8445 | [1–419] | 8572 | [1–387] | 8636 | [1–164] |
| 8395 | [1–360] | 8446 | [158–265] | 8573 | [1–191] | 8637 | [1–103] |
| 8396 | [1–314] | 8447 | [1–67] | 8574 | [1–416] | 8638 | [1–361] |
| 8397 | [1–439] | 8448 | [1–238] | 8575 | [1–331] | 8639 | [1–75] |
| 8398 | [1–328] | 8449 | [1–449] | 8576 | [1–68] | 8640 | [1–91] |
| 8399 | [1–398] | 8451 | [1–349] | 8577 | [1–483] | 8641 | [1–58] |
| 8400 | [1–96] | 8452 | [1–547] | 8578 | [1–386] | 8643 | [1–361] |
| 8401 | [1–557] | 8453 | [1–75] | 8579 | [1–363] | 8644 | [1–148] |
| 8402 | [1–446] | 8454 | [1–268] | 8580 | [1–385] | 8645 | [1–58] |
| 8403 | [1–379] | 8455 | [1–349] | 8581 | [1–202] | 8646 | [1–58] |
| 8404 | [1–155] | 8456 | [1–350] | 8583 | [1–130] | 8647 | [1–361] |
| 8406 | [1–221] | 8457 | [31–73] | 8584 | [1–144] | 8649 | [1–103] |
| 8407 | [1–27] | 8458 | [1–378] | 8585 | [1–361] | 8651 | [1–166] |
| 8408 | [1–398] | 8460 | [1–77] | 8586 | [1–439] | 8652 | [1–77] |
| 8409 | [1–229] | 8461 | [1–494] | 8587 | [1–166] | 8653 | [1–51] |
| 8410 | [1–108] | 8462 | [1–421] | 8588 | [1–103] | 8654 | [1–363] |
| 8411 | [1–329] | 8464 | [1–369] | 8589 | [1–151] | 8655 | [1–159] |
| 8412 | [1–271] | 8465 | [1–480] | 8591 | [1–362] | 8656 | [1–150] |
| 8413 | [1–492] | 8466 | [1–508] | 8592 | [1–85] | 8657 | [1–359] |
| 8414 | [236–391] | 8467 | [1–460] | 8593 | [1–80] | 8658 | [1–167] |
| 8416 | [1–283] | 8468 | [1–466] | 8594 | [1–84] | 8659 | [1–103] |
| 8417 | [1–340] | 8469 | [1–121] | 8597 | [1–144] | 8660 | [1–96] |
| 8418 | [1–226] | 8470 | [1–430] | 8598 | [1–348] | 8661 | [1–103] |
| 8420 | [1–67] | 8471 | [1–332] | 8599 | [1–363] | 8663 | [1–84] |
| 8421 | [1–484] | 8472 | [1–445] | 8600 | [1–126] | 8664 | [1–96] |
| 8422 | [1–52] | 8473 | [1–375] | 8603 | [1–132] | 8665 | [1–152] |
| 8474 | [1–256] | 8522 | [1–157] | 8605 | [1–114] | 8666 | [1–84] |
| 8475 | [1–355] | 8523 | [1–354] | 8606 | [1–84] | 8667 | [1–288],[405–468] |
| 8476 | [1–342] | 8524 | [1–398] | 8607 | [1–96] | 8668 | [1–58] |
| 8477 | [1–369] | 8525 | [1–83] | 8609 | [1–73] | 8671 | [1–116] |
| 8478 | [1–445] | 8526 | [1–326] | 8611 | [1–103] | 8672 | [1–97] |
| 8479 | [1–206] | 8527 | [1–315] | 8613 | [1–89] | 8673 | [1–82] |
| 8480 | [1–138] | 8528 | [1–374] | 8614 | [1–361] | 8674 | [1–96] |
| 8481 | [1–67] | 8529 | [1–460] | 8616 | [1–361] | 8675 | [1–222] |
| 8482 | [1–96] | 8530 | [365–434] | 8617 | [1–164] | 8677 | [1–164] |
| 8483 | [1–270] | 8531 | [1–114] | 8620 | [1–345] | 8678 | [1–449] |
| 8484 | [1–317] | 8532 | [1–508] | 8621 | [1–361] | 8679 | [1–56] |
| 8485 | [1–312] | 8534 | [1–369] | 8622 | [1–58] | 8680 | [1–73] |
| 8486 | [1–324] | 8535 | [1–154] | 8623 | [1–159] | 8681 | [1–73] |
| 8487 | [1–203] | 8536 | [1–433] | 8625 | [1–97] | 8682 | [1–186] |
| 8488 | [1–355] | 8537 | [1–391] | 8626 | [1–103] | 8684 | [1–164] |
| 8489 | [1–328] | 8538 | [1–459] | 8627 | [1–506] | 8685 | [1–103] |
| 8490 | [1–58] | 8539 | [1–351] | 8628 | [1–58] | 8687 | [1–83] |
| 8491 | [1–361] | 8540 | [1–423] | 8630 | [1–164] | 8689 | [1–366] |
| 8492 | [1–109],[175–295] | 8541 | [1–394] | 8632 | [1–139] | 8690 | [1–116] |
| 8493 | [1–333] | 8543 | [1–480] | 8633 | [1–103] | 8691 | [1–79] |
| 8494 | [1–81] | 8544 | [1–408] | 8692 | [1–82] | 8742 | [1–283],[400–455] |
| 8495 | [1–395] | 8545 | [1–302] | 8693 | [1–84] | 8743 | [1–377] |
| 8496 | [1–104] | 8546 | [1–348] | 8694 | [1–90] | 8744 | [1–287] |
| 8497 | [1–403] | 8547 | [1–84] | 8696 | [1–513] | 8745 | [1–284] |
| 8498 | [1–91] | 8548 | [1–88] | 8697 | [1–500] | 8746 | [1–319] |
| 8499 | [1–226],[391–416] | 8549 | [1–183] | 8698 | [1–455] | 8747 | [1–327] |
| 8500 | [1–432] | 8550 | [1–146] | 8699 | [1–238] | 8748 | [1–322] |
| 8501 | [1–462] | 8551 | [1–147] | 8700 | [1–565] | 8749 | [1–81] |
| 8502 | [1–451] | 8552 | [1–149] | 8701 | [1–530] | 8750 | [1–409] |
| 8503 | [1–365] | 8553 | [1–167] | 8702 | [1–451] | 8751 | [1–476] |
| 8504 | [1–359] | 8554 | [1–474] | 8703 | [1–271] | 8752 | [1–354] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 8704 | [1–447] | 8753 | [1–327] | 8827 | [1–434] | 8875 | [1–103] |
| 8705 | [1–141] | 8754 | [1–422] | 8828 | [1–487] | 8876 | [1–95] |
| 8706 | [1–500] | 8755 | [1–150] | 8829 | [1–342] | 8877 | [1–95] |
| 8707 | [1–485] | 8756 | [1–94] | 8830 | [1–544] | 8878 | [1–103] |
| 8708 | [1–483] | 8757 | [1–148] | 8831 | [1–74] | 8879 | [1–94] |
| 8709 | [1–48],[153–433] | 8758 | [1–402] | 8832 | [1–96] | 8880 | [1–96] |
| 8710 | [1–260] | 8759 | [1–289] | 8833 | [1–103] | 8881 | [1–149] |
| 8711 | [1–251] | 8760 | [1–314] | 8834 | [1–103] | 8882 | [1–96] |
| 8712 | [1–115] | 8761 | [1–154] | 8836 | [1–103] | 8883 | [1–95] |
| 8713 | [1–447] | 8762 | [1–203] | 8885 | [1–442] | 8933 | [1–83] |
| 8714 | [1–431] | 8763 | [1–374] | 8886 | [1–148] | 8934 | [1–93],[195–239] |
| 8715 | [1–454] | 8764 | [58–360] | 8887 | [1–103] | 8935 | [1–132] |
| 8716 | [1–73],[161–222] | 8765 | [1–384] | 8888 | [1–58] | 8936 | [1–103] |
| 8717 | [1–309] | 8766 | [1–73] | 8889 | [1–103] | 8937 | [1–362] |
| 8718 | [1–384] | 8767 | [1–375] | 8890 | [1–361] | 8938 | [1–103] |
| 8719 | [1–375] | 8768 | [1–281],[398–448] | 8892 | [1–103] | 8939 | [1–103] |
| 8720 | [77–251] | 8769 | [1–341] | 8893 | [1–188] | 8940 | [1–96] |
| 8721 | [1–236] | 8770 | [1–414] | 8894 | [1–103] | 8941 | [1–76] |
| 8722 | [1–329] | 8771 | [1–236] | 8895 | [1–96] | 8942 | [1–149] |
| 8723 | [1–159] | 8772 | [1–386] | 8896 | [1–58] | 8943 | [1–29] |
| 8724 | [1–342] | 8773 | [152–211] | 8897 | [1–58] | 8944 | [1–103] |
| 8725 | [1–74] | 8774 | [1–191] | 8898 | [1–103] | 8945 | [1–76] |
| 8726 | [1–199] | 8775 | [30–336] | 8899 | [1–150] | 8946 | [1–392] |
| 8727 | [1–390] | 8776 | [1–273] | 8900 | [1–128] | 8947 | [1–138] |
| 8728 | [1–28],[78–322] | 8777 | [1–226] | 8901 | [1–103] | 8948 | [1–65] |
| 8730 | [1–201] | 8778 | [1–226] | 8902 | [1–84] | 8949 | [1–96] |
| 8731 | [1–178] | 8779 | [1–380] | 8903 | [1–89] | 8950 | [1–95] |
| 8732 | [1–291],[408–465] | 8780 | [1–215] | 8904 | [1–89] | 8951 | [1–88] |
| 8733 | [1–172] | 8781 | [1–410] | 8905 | [1–212] | 8952 | [1–152] |
| 8734 | [1–384] | 8782 | [1–136] | 8906 | [1–96] | 8953 | [1–85] |
| 8735 | [1–78] | 8783 | [1–73] | 8907 | [1–95] | 8954 | [1–96] |
| 8736 | [1–52] | 8784 | [1–139] | 8908 | [1–413] | 8955 | [1–445] |
| 8738 | [1–294] | 8785 | [1–396] | 8909 | [1–58] | 8956 | [1–96] |
| 8739 | [1–398] | 8786 | [1–251] | 8910 | [1–58] | 8957 | [1–95] |
| 8740 | [1–337] | 8787 | [1–399] | 8911 | [1–103] | 8958 | [1–103] |
| 8741 | [1–239] | 8788 | [1–509] | 8912 | [1–103] | 8959 | [1–95] |
| 8789 | [1–446] | 8837 | [1–58] | 8913 | [1–103] | 8960 | [1–104] |
| 8790 | [1–464] | 8838 | [1–361] | 8914 | [1–104] | 8961 | [1–89] |
| 8791 | [1–461] | 8839 | [1–76] | 8915 | [1–58] | 8962 | [1–90] |
| 8792 | [1–235] | 8840 | [1–71] | 8916 | [1–103] | 8963 | [1–103] |
| 8793 | [1–408] | 8841 | [1–475] | 8917 | [1–103] | 8964 | [1–103] |
| 8794 | [1–421] | 8842 | [1–76] | 8918 | [1–103] | 8965 | [1–114] |
| 8795 | [212–390] | 8843 | [1–130] | 8919 | [1–95] | 8966 | [1–256] |
| 8796 | [1–159] | 8844 | [1–103] | 8920 | [1–96] | 8967 | [1–103] |
| 8797 | [1–71] | 8845 | [1–133] | 8921 | [1–58] | 8968 | [1–103] |
| 8798 | [1–354] | 8846 | [1–103] | 8922 | [1–73] | 8969 | [1–89] |
| 8799 | [1–408] | 8847 | [1–362] | 8923 | [1–96] | 8970 | [1–103] |
| 8800 | [1–295] | 8848 | [1–103] | 8924 | [1–96] | 8971 | [1–152] |
| 8801 | [1–457] | 8849 | [1–73] | 8925 | [1–84] | 8972 | [1–164] |
| 8802 | [1–83] | 8850 | [1–103] | 8926 | [1–103) | 8973 | [1–94] |
| 8803 | [1–158] | 8851 | [1–83] | 8927 | [1–353] | 8974 | [1–103] |
| 8804 | [196–530] | 8852 | [1–103] | 8928 | [1–164] | 8975 | [1–103] |
| 8805 | [1–361] | 8853 | [1–96] | 8929 | [1–76] | 8976 | [1–399] |
| 8806 | [1–158] | 8854 | [1–85] | 8930 | [1–361] | 8977 | [1–96] |
| 8807 | [1–314] | 8855 | [1–103] | 8931 | [1–103] | 8978 | [1–103] |
| 8808 | [1–448] | 8856 | [1–103] | 8932 | [1–104] | 8979 | [1–96] |
| 8809 | [208–251] | 8857 | [1–103] | 8980 | [1–103] | 9030 | [1–470] |
| 8810 | [1–181] | 8858 | [1–84] | 8981 | [1–92] | 9031 | [1–484] |
| 8811 | [1–207] | 8859 | [1–95] | 8982 | [1–372] | 9032 | [1–62] |
| 8812 | [1–408] | 8860 | [1–58] | 8983 | [1–430] | 9033 | [93–136] |
| 8813 | [1–372] | 8861 | [1–96] | 8984 | [1–418] | 9034 | [1–422] |
| 8814 | [1–495] | 8862 | [1–379] | 8985 | [1–482] | 9035 | [1–83] |
| 8815 | [1–433] | 8863 | [1–149] | 8986 | [1–323] | 9036 | [1–280] |
| 8816 | [1–471] | 8864 | [1–103] | 8987 | [1–542] | 9037 | [1–117] |
| 8817 | [1–84] | 8865 | [1–103] | 8989 | [1–410] | 9038 | [1–72] |
| 8818 | [1–444] | 8866 | [1–58] | 8990 | [1–247] | 9039 | [1–442] |
| 8819 | [1–472] | 8867 | [1–71] | 8991 | [1–89] | 9040 | [1–139] |
| 8820 | [1–384] | 8868 | [1–103] | 8992 | [1–478] | 9041 | [1–229],[279–523] |
| 8821 | [1–410] | 8869 | [1–164] | 8993 | [1–530] | 9042 | [1–432] |
| 8822 | [1–419] | 8870 | [1–103] | 8994 | [1–522] | 9043 | [1–455] |
| 8823 | [1–154],[352–477] | 8871 | [1–89] | 8995 | [1–206] | 9044 | [35–206] |
| 8824 | [1–95] | 8872 | [1–381] | 8996 | [1–62] | 9045 | [1–372] |
| 8825 | [1–54] | 8873 | [1–482] | 8998 | [1–603] | 9046 | [1–508] |
| 8826 | [1–485] | 8874 | [1–103] | 9000 | [1–169] | 9047 | [1–467] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 9001 | [1–446] | 9048 | [1–461] | 9124 | [1–286] | 9171 | [1–404] |
| 9002 | [1–341] | 9049 | [1–232] | 9125 | [1–422] | 9172 | [1–424] |
| 9003 | [1–381] | 9050 | [1–132] | 9173 | [1–350] | 9223 | [1–449] |
| 9004 | [1–171] | 9051 | [1–434] | 9174 | [1–390] | 9224 | [1–277] |
| 9005 | [1–366] | 9052 | [1–63] | 9175 | [1–473] | 9225 | [1–97] |
| 9006 | [1–349] | 9053 | [1–366] | 9176 | [1–428] | 9226 | [1–355] |
| 9007 | [1–452] | 9054 | [1–392] | 9177 | [1–384] | 9228 | [1–83],[218–371] |
| 9008 | [1–425] | 9055 | [1–404] | 9178 | [1–470] | 9229 | [82–384] |
| 9009 | [1–422] | 9056 | [1–149] | 9179 | [1–435] | 9230 | [1–379] |
| 9010 | [1–234] | 9057 | [1–386] | 9180 | [1–185] | 9231 | [1–409] |
| 9011 | [1–380] | 9058 | [1–381] | 9181 | [1–424] | 9232 | [1–408] |
| 9012 | [1–468] | 9059 | [1–79] | 9182 | [1–435] | 9233 | [1–427] |
| 9013 | [1–443] | 9060 | [1–459] | 9183 | [1–427] | 9234 | [1–425] |
| 9014 | [1–81] | 9061 | [53–358] | 9184 | [1–422] | 9235 | [1–438] |
| 9015 | [1–381] | 9062 | [281–423] | 9185 | [1–392] | 9236 | [1–435] |
| 9016 | [1–515] | 9063 | [1–181] | 9186 | [1–191] | 9237 | [1–88] |
| 9017 | [1–442] | 9064 | [1–439] | 9187 | [1–411] | 9238 | [1–455] |
| 9018 | [1–460] | 9066 | [287–455] | 9188 | [1–460] | 9240 | [1–76],[232–377] |
| 9019 | [1–261] | 9067 | [1–439] | 9189 | [1–426] | 9241 | [1–483] |
| 9020 | [1–411] | 9068 | [1–485] | 9190 | [1–308] | 9242 | [1–496] |
| 9021 | [1–48],[113–303] | 9069 | [1–487] | 9191 | [1–380] | 9243 | [1–214] |
| 9022 | [1–111],[227–281] | 9070 | [1–361] | 9192 | [67–313] | 9244 | [1–439] |
| 9023 | [1–509] | 9071 | [1–447] | 9194 | [1–371] | 9245 | [1–472] |
| 9024 | [1–387] | 9072 | [1–403] | 9195 | [1–167] | 9246 | [1–409] |
| 9025 | [1–76] | 9073 | [1–383] | 9196 | [1–283] | 9247 | [1–398] |
| 9026 | [1–472] | 9074 | [1–463] | 9197 | [1–418] | 9248 | [1–387] |
| 9027 | [1–315] | 9075 | [1–385] | 9198 | [1–383] | 9250 | [1–203] |
| 9028 | [1–385] | 9076 | [1–372] | 9199 | [1–40] | 9251 | [1–440] |
| 9029 | [1–465] | 9077 | [1–147] | 9200 | [1–446] | 9252 | [1–163] |
| 9079 | [1–223] | 9126 | [1–390] | 9201 | [1–420] | 9253 | [1–142] |
| 9080 | [1–209] | 9127 | [1–453] | 9202 | [1–442] | 9254 | [161–441] |
| 9081 | [1–370] | 9128 | [1–496] | 9203 | [1–414] | 9255 | [1–402] |
| 9082 | [1–303] | 9129 | [1–271] | 9204 | [1–423] | 9256 | [1–531] |
| 9083 | [1–511] | 9130 | [1–275] | 9205 | [1–149] | 9257 | [1–402] |
| 9084 | [1–468] | 9131 | [65–108] | 9206 | [1–89] | 9258 | [1–461] |
| 9085 | [1–459] | 9132 | [1–170] | 9207 | [1–378] | 9259 | [1–504] |
| 9086 | [1–97] | 9133 | [1–93] | 9209 | [1–448] | 9260 | [1–291] |
| 9087 | [1–498] | 9134 | [1–94] | 9210 | [1–283],[325–434] | 9261 | [1–590] |
| 9088 | [1–183] | 9135 | [1–303] | 9212 | [1–361] | 9262 | [1–519] |
| 9089 | [1–471] | 9136 | [1–235] | 9213 | [1–457] | 9263 | [1–466] |
| 9090 | [1–219] | 9137 | [34–465] | 9214 | [1–388] | 9264 | [1–455] |
| 9091 | [1–448] | 9138 | [1–335] | 9215 | [1–429] | 9265 | [1–491] |
| 9092 | [1–420] | 9139 | [1–380] | 9216 | [1–56] | 9266 | [1–534] |
| 9093 | [1–175] | 9140 | [1–294] | 9217 | [1–465] | 9267 | [1–252] |
| 9094 | [1–267] | 9141 | [1–184],[262–477] | 9218 | [1–261],[326–684] | 9268 | [1–487] |
| 9095 | [1–156] | 9142 | [1–359] | 9219 | [1–448] | 9269 | [1–357] |
| 9096 | [1–151],[237–305] | 9143 | [1–366] | 9220 | [1–225] | 9270 | [1–424] |
| 9097 | [1–556] | 9144 | [1–373] | 9221 | [1–452] | 9271 | [1–578] |
| 9098 | [1–429] | 9145 | [1–350] | 9222 | [1–451] | 9272 | [1–471] |
| 9099 | [1–475] | 9146 | [36–102] | 9273 | [1–449] | 9321 | [58–265] |
| 9100 | [1–442] | 9147 | [1–412] | 9274 | [1–305] | 9322 | [1–390] |
| 9101 | [1–475] | 9148 | [1–422] | 9275 | [1–450] | 9323 | [1–217] |
| 9102 | [1–460] | 9149 | [1–447] | 9276 | [1–419] | 9324 | [1–258] |
| 9103 | [1–413] | 9150 | [1–432] | 9277 | [1–398] | 9326 | [1–369] |
| 9104 | [1–414] | 9151 | [1–369] | 9278 | [1–447] | 9327 | [1–452] |
| 9105 | [1–83],[113–248] | 9152 | [52–432] | 9279 | [1–512] | 9328 | [1–336] |
| 9106 | [1–464] | 9153 | [1–398] | 9280 | [1–178] | 9329 | [1–428] |
| 9107 | [1–157] | 9154 | [1–439] | 9281 | [1–368] | 9330 | [1–90] |
| 9108 | [1–470] | 9155 | [1–56] | 9282 | [1–457] | 9331 | [1–437] |
| 9109 | [1–251] | 9156 | [1–423] | 9283 | [164–208] | 9332 | [1–425] |
| 9110 | [1–247] | 9157 | [1–426] | 9284 | [1–417] | 9333 | [1–234] |
| 9111 | [1–452] | 9158 | [1–432] | 9285 | [1–347] | 9334 | [1–472] |
| 9112 | [1–416] | 9159 | [1–433] | 9286 | [1–438] | 9335 | [1–166] |
| 9113 | [1–444] | 9160 | [1–392] | 9287 | [1–126] | 9336 | [1–381] |
| 9114 | [1–359] | 9161 | [1–436] | 9288 | [1–495] | 9337 | [1–425] |
| 9115 | [1–298] | 9162 | [1–52] | 9289 | [1–485] | 9338 | [1–447] |
| 9116 | [1–326] | 9163 | [1–367] | 9290 | [1–239] | 9339 | [1–483] |
| 9117 | [1–312] | 9164 | [1–395] | 9291 | [1–431] | 9340 | [1–446] |
| 9118 | [1–277] | 9165 | [1–464] | 9292 | [1–463] | 9341 | [1–447] |
| 9119 | [1–258] | 9166 | [1–190] | 9293 | [1–426] | 9342 | [1–399] |
| 9120 | [37–219],[355–494] | 9167 | [1–168] | 9294 | [1–444] | 9343 | [1–202] |
| 9121 | [1–434] | 9168 | [1–401] | 9295 | [1–463] | 9344 | [1–432] |
| 9122 | [1–212] | 9169 | [1–385] | 9296 | [1–342] | 9345 | [1–138] |
| 9123 | [1–410] | 9170 | [1–469] | 9297 | [125–448] | 9346 | [1–420] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 9298 | [1–271] | 9347 | [1–422] | 9472 | [1–104] | 9525 | [1–328] |
| 9299 | [1–299] | 9348 | [1–107] | 9473 | [1–101] | 9526 | [1–160] |
| 9300 | [1–85] | 9349 | [1–430] | 9474 | [1–381] | 9527 | [1–245] |
| 9301 | [1–433] | 9350 | [1–513] | 9475 | [1–107] | 9528 | [1–505] |
| 9302 | [1–293] | 9351 | [1–470] | 9476 | [1–104] | 9529 | [1–55] |
| 9303 | [1–385] | 9352 | [1–477] | 9477 | [1–97] | 9530 | [33–81],[113–335] |
| 9304 | [1–451] | 9353 | [1–490] | 9478 | [1–60] | 9531 | [1–453] |
| 9305 | [1–444] | 9354 | [1–443] | 9480 | [1–52] | 9532 | [1–434] |
| 9306 | [1–510] | 9355 | [1–415] | 9481 | [1–323] | 9533 | [1–429] |
| 9307 | [1–420] | 9356 | [1–443] | 9482 | [1–96] | 9534 | [1–427] |
| 9308 | [1–96],[145–281],[312–414] | 9357 | [1–389] | 9483 | [1–59] | 9535 | [1–493] |
| 9309 | [1–535] | 9358 | [1–475] | 9484 | [1–399] | 9536 | [1–348] |
| 9310 | [1–534] | 9359 | [1–385] | 9485 | [1–103] | 9537 | [1–680] |
| 9311 | [1–370] | 9360 | [1–538] | 9486 | [1–61] | 9538 | [1–535] |
| 9312 | [1–484] | 9361 | [1–447] | 9487 | [1–107] | 9539 | [1–239] |
| 9313 | [1–538] | 9362 | [1–64] | 9489 | [1–96] | 9540 | [1–438] |
| 9314 | [1–81] | 9363 | [1–415] | 9491 | [1–88] | 9541 | [1–498] |
| 9315 | [1–443] | 9364 | [1–413] | 9492 | [1–107] | 9542 | [1–274] |
| 9316 | [1–440] | 9365 | [1–425] | 9493 | [1–240] | 9543 | [1–429] |
| 9317 | [1–441] | 9366 | [39–456] | 9494 | [1–83] | 9544 | [1–410] |
| 9319 | [1–424] | 9367 | [1–498] | 9495 | [1–88] | 9545 | [1–371] |
| 9320 | [1–446] | 9368 | [1–373] | 9496 | [1–102] | 9546 | [1–511] |
| 9369 | [1–390] | 9417 | [1–439] | 9498 | [1–350] | 9547 | [1–42],[102–297] |
| 9370 | [1–544] | 9418 | [162–464] | 9499 | [1–107] | 9548 | [1–73] |
| 9371 | [1–451] | 9419 | [1–430] | 9500 | [1–58] | 9549 | [1–527] |
| 9372 | [1–272] | 9420 | [1–368] | 9501 | [1–96] | 9550 | [1–487] |
| 9373 | [1–420] | 9421 | [1–413] | 9502 | [1–112] | 9551 | [1–40I] |
| 9374 | [1–426] | 9422 | [1–422] | 9503 | [1–54] | 9552 | [1–355] |
| 9375 | [1–237] | 9423 | [1–396] | 9504 | [1–105] | 9553 | [1–173] |
| 9376 | [1–438] | 9424 | [1–315],[356–435] | 9505 | [1–107] | 9556 | [264–405] |
| 9377 | [1–480] | 9425 | [1–426] | 9507 | [1–104] | 9558 | [189–281] |
| 9378 | [1–444] | 9426 | [1–490] | 9508 | [1–101] | 9559 | [1–488] |
| 9379 | [1–482] | 9427 | [1–302] | 9510 | [1–316] | 9560 | [1–306] |
| 9380 | [1–250] | 9428 | [1–234] | 9511 | [1–421] | 9561 | [1–168],[228–369] |
| 9381 | [1–305] | 9429 | [1–440] | 9512 | [1–167] | 9562 | [1–274] |
| 9382 | [1–325] | 9430 | [1–560] | 9513 | [1–351] | 9563 | [1–363] |
| 9383 | [1–381] | 9431 | [1–442] | 9514 | [1–352] | 9564 | [1–361] |
| 9384 | [1–362] | 9432 | [1–61] | 9515 | [1–377] | 9565 | [1–395] |
| 9385 | [1–436] | 9433 | [1–398] | 9516 | [1–297] | 9566 | [1–444] |
| 9386 | [1–127] | 9434 | [1–119] | 9517 | [1–210],[245–361] | 9567 | [1–191],[279–464] |
| 9387 | [1–336] | 9435 | [1–436] | 9518 | [1–240] | 9568 | [1–485] |
| 9388 | [63–88] | 9436 | [87–147] | 9519 | [1–521] | 9569 | [1–332] |
| 9389 | [1–510] | 9437 | [1–212] | 9570 | [1–428] | 9617 | [1–86] |
| 9390 | [1–447] | 9439 | [1–263] | 9571 | [1–501] | 9618 | [79–117] |
| 9391 | [1–433] | 9440 | [1–299] | 9572 | [1–511] | 9619 | [1–357] |
| 9392 | [1–104] | 9441 | [1–444] | 9573 | [1–76] | 9620 | [1–422] |
| 9393 | [1–435] | 9442 | [1–418] | 9574 | [1–454] | 9621 | [1–80] |
| 9394 | [207–414] | 9443 | [1–448) | 9575 | [1–179] | 9622 | [1–511] |
| 9395 | [1–423] | 9444 | [1–238] | 9576 | [1–318] | 9623 | [1–389] |
| 9396 | [1–485] | 9445 | [1–467] | 9577 | [1–264] | 9624 | [1–268] |
| 9397 | [1–471] | 9446 | [156–295] | 9578 | [1–448] | 9625 | [1–327] |
| 9398 | [1–445] | 9447 | [1–405] | 9579 | [1–455] | 9626 | [1–86] |
| 9399 | [1–420] | 9448 | [1–191] | 9580 | [1–474] | 9627 | [1–101],[144–452] |
| 9400 | [1–411] | 9449 | [1–416] | 9581 | [1–468] | 9628 | [1–102] |
| 9401 | [1–407] | 9450 | [1–415] | 9582 | [1–426] | 9629 | [1–233] |
| 9402 | [1–263] | 9451 | [1–427] | 9583 | [1–141] | 9630 | [1–321] |
| 9403 | [1–176] | 9452 | [1–279] | 9584 | [1–192] | 9631 | [1–308] |
| 9404 | [1–317] | 9453 | [1–328] | 9585 | [1–359] | 9632 | [1–391] |
| 9405 | [1–455] | 9454 | [1–392] | 9586 | [1–115] | 9633 | [139–274],[414–455] |
| 9406 | [1–255] | 9455 | [1–235] | 9587 | [1–138] | 9634 | [1–433] |
| 9407 | [1–276] | 9456 | [1–537] | 9588 | [1–63] | 9635 | [1–292] |
| 9408 | [1–454] | 9457 | [58–375] | 9589 | [1–72] | 9636 | [1–274] |
| 9409 | [1–137],[285–444] | 9458 | [1–103] | 9590 | [1–73] | 9637 | [31–297] |
| 9410 | [1–553] | 9460 | [1–71] | 9591 | [1–135] | 9638 | [1–369] |
| 9412 | [1–451] | 9461 | [1–59] | 9592 | [1–78] | 9639 | [1–473] |
| 9413 | [1–407] | 9462 | [1–61],[145–441] | 9593 | [245–420] | 9640 | [1–292] |
| 9414 | [1–308] | 9463 | [1–328] | 9594 | [1–331] | 9642 | [1–211] |
| 9415 | [32–144],[191–408] | 9464 | [1–91] | 9595 | [73–138] | 9643 | [1–468] |
| 9416 | [1–305] | 9466 | [1–341] | 9596 | [1–194] | 9644 | [1–93] |
| 9467 | [1–165] | 9520 | [99–295] | 9597 | [1–456] | 9645 | [1–501] |
| 9468 | [1–104] | 9521 | [1–579] | 9598 | [1–403] | 9646 | [1–134] |
| 9469 | [1–107] | 9522 | [1–83] | 9599 | [35–480] | 9647 | [1–364] |
| 9470 | [1–358] | 9523 | [1–383] | 9600 | [1–402] | 9648 | [1–347] |
| 9471 | [1–308] | 9524 | [83–312] | 9601 | [1–423] | 9649 | [1–157] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 9602 | [1–114] | 9650 | [1–171] | 9678 | [1–170] | 9727 | [1–167] |
| 9603 | [1–366] | 9651 | [1–430] | 9679 | [1–261] | 9728 | [1–67] |
| 9604 | [1–78] | 9652 | [1–569] | 9680 | [1–97] | 9729 | [1–356] |
| 9605 | [1–423] | 9653 | [1–306] | 9681 | [1–372] | 9730 | [1–58] |
| 9606 | [1–435] | 9654 | [1–206] | 9682 | [1–432] | 9731 | [1–621] |
| 9607 | [1–378] | 9655 | [1–137] | 9683 | [1–323] | 9732 | [1–207] |
| 9608 | [61–163] | 9656 | [1–111] | 9684 | [1–432] | 9733 | [1–87] |
| 9609 | [1–397] | 9657 | [1–244] | 9685 | [1–90] | 9734 | [1–63] |
| 9610 | [1–502] | 9658 | [1–332] | 9686 | [1–461] | 9735 | [1–135] |
| 9611 | [1–431] | 9659 | [1–80] | 9687 | [1–361] | 9736 | [1–93] |
| 9612 | [1–420] | 9660 | [1–389] | 9688 | [1–416] | 9738 | [1–429] |
| 9613 | [1–459] | 9661 | [1–76] | 9689 | [1–67] | 9739 | [1–146] |
| 9614 | [1–478] | 9662 | [1–446] | 9690 | [1–440] | 9740 | [1–61] |
| 9615 | [1–336] | 9663 | [1–204] | 9691 | [1–387] | 9741 | [1–57] |
| 9616 | [1–386] | 9664 | [1–456] | 9692 | [1–445] | 9742 | [76–108] |
| 9570 | [1–428] | 9617 | [1–86] | 9693 | [1–51] | 9743 | [1–146] |
| 9571 | [1–501] | 9618 | [79–117] | 9694 | [1–254] | 9744 | [1–337] |
| 9572 | [1–511] | 9619 | [1–357] | 9695 | [1–421] | 9745 | [1–78] |
| 9573 | [1–76] | 9620 | [1–422] | 9696 | [1–458] | 9746 | [1–60] |
| 9574 | [1–454] | 9621 | [1–80] | 9697 | [1–391] | 9747 | [1–415] |
| 9575 | [1–179] | 9622 | [1–511] | 9698 | [1–86] | 9748 | [1–76],[269–410] |
| 9576 | [1–318] | 9623 | [1–389] | 9699 | [1–432] | 9749 | [1–406] |
| 9577 | [1–264] | 9624 | [1–268] | 9700 | [1–93],[271–440] | 9750 | [1–109] |
| 9578 | [1–448] | 9625 | [1–327] | 9701 | [1–336] | 9751 | [1–371] |
| 9579 | [1–455] | 9626 | [1–86] | 9702 | [1–399] | 9752 | [1–103] |
| 9580 | [1–474] | 9627 | [1–101],[144–452] | 9703 | [1–89] | 9753 | [1–83] |
| 9581 | [1–468] | 9628 | [1–102] | 9704 | [1–323] | 9754 | [1–224] |
| 9582 | [1–426] | 9629 | [1–233] | 9705 | [1–407] | 9755 | [1–462] |
| 9583 | [1–141] | 9630 | [1–321] | 9706 | [1–383] | 9756 | [1–86] |
| 9584 | [1–192] | 9631 | [1–308] | 9707 | [1–463] | 9757 | [1–398] |
| 9585 | [1–359] | 9632 | [1–391] | 9708 | [1–405] | 9758 | [96–272],[370–477] |
| 9586 | [1–115] | 9633 | [139–274],[414–455] | 9710 | [1–367] | 9759 | [1–487] |
| 9587 | [1–138] | 9634 | [1–433] | 9711 | [31–305],[364–411] | 9760 | [1–130] |
| 9588 | [1–63] | 9635 | [1–292] | 9712 | [1–71] | 9761 | [1–432] |
| 9589 | [1–72] | 9636 | [1–274] | 9713 | [1–103] | 9762 | [1–483] |
| 9590 | [1–73] | 9637 | [31–297] | 9763 | [1–323] | 9812 | [1–502] |
| 9591 | [1–135] | 9638 | [1–369] | 9764 | [1–337] | 9813 | [1–500] |
| 9592 | [1–78] | 9639 | [1–473] | 9765 | [1–126] | 9814 | [1–500] |
| 9593 | [245–420] | 9640 | [1–292] | 9766 | [1–284] | 9815 | [1–416] |
| 9594 | [1–331] | 9642 | [1–211] | 9767 | [1–76] | 9816 | [52–370] |
| 9595 | [73–138] | 9643 | [1–468] | 9768 | [1–135] | 9817 | [1–471] |
| 9596 | [1–194] | 9644 | [1–93] | 9769 | [233–466] | 9818 | [53–400] |
| 9597 | [1–456] | 9645 | [1–501] | 9770 | [1–440] | 9819 | [1–472] |
| 9598 | [1–403] | 9646 | [1–134] | 9771 | [1–407] | 9820 | [1–482] |
| 9599 | [35–480] | 9647 | [1–364] | 9772 | [1–443] | 9821 | [1–441] |
| 9600 | [1–402] | 9648 | [1–347] | 9773 | [1–89] | 9822 | [1–444] |
| 9601 | [1–423] | 9649 | [1–157] | 9774 | [1–151] | 9823 | [1–237] |
| 9602 | [1–114] | 9650 | [1–171] | 9775 | [1–424] | 9824 | [1–79] |
| 9603 | [1–366] | 9651 | [1–430] | 9776 | [1–248] | 9825 | [1–452] |
| 9604 | [1–78] | 9652 | [1–569] | 9777 | [1–322] | 9826 | [1–155] |
| 9605 | [1–423] | 9653 | [1–306] | 9778 | [1–68] | 9827 | [1–438] |
| 9606 | [1–435] | 9654 | [1–206] | 9779 | [1–399] | 9828 | [1–463] |
| 9607 | [1–378] | 9655 | [1–137] | 9780 | [233–481] | 9829 | [1–487] |
| 9608 | [61–163] | 9656 | [1–111] | 9782 | [1–431] | 9830 | [1–479] |
| 9609 | [1–397] | 9657 | [1–244] | 9783 | [1–353] | 9831 | [1–79] |
| 9610 | [1–502] | 9658 | [1–332] | 9784 | [1–346] | 9832 | [1–426] |
| 9611 | [1–431] | 9659 | [1–80] | 9785 | [1–435] | 9833 | [1–369] |
| 9612 | [1–420] | 9660 | [1–389] | 9786 | [1–380] | 9834 | [1–500] |
| 9613 | [1–459] | 9661 | [1–76] | 9787 | [1–362] | 9835 | [1–343] |
| 9614 | [1–478] | 9662 | [1–446] | 9788 | [1–500] | 9836 | [1–62],[162–497] |
| 9615 | [1–336] | 9663 | [1–204] | 9789 | [1–250],[302–429] | 9837 | [1–72] |
| 9616 | [1–386] | 9664 | [1–456] | 9790 | [1–375] | 9838 | [1–507] |
| 9665 | [1–469] | 9714 | [1–369] | 9791 | [1–257],[354–425] | 9839 | [1–574] |
| 9666 | [1–452] | 9715 | [1–316] | 9792 | [1–299] | 9840 | [1–303] |
| 9667 | [1–216] | 9717 | [1–359] | 9793 | [1–356] | 9841 | [1–78] |
| 9668 | [1–242],[372–474] | 9718 | [1–57] | 9794 | [1–456] | 9842 | [1–415] |
| 9669 | [1–285] | 9719 | [1–434] | 9795 | [1–385] | 9843 | [1–52],[100–214] |
| 9671 | [1–81] | 9720 | [1–434] | 9796 | [1–374] | 9844 | [1–529] |
| 9672 | [1–481] | 9721 | [1–378] | 9797 | [1–393] | 9845 | [1–71] |
| 9673 | [281–488] | 9722 | [1–368] | 9798 | [1–375] | 9846 | [1–424] |
| 9674 | [1–53] | 9723 | [1–300] | 9799 | [1–425] | 9847 | [1–455] |
| 9675 | [52–378] | 9724 | [1–227] | 9801 | [1–462] | 9848 | [1–339] |
| 9676 | [1–429] | 9725 | [1–297] | 9802 | [1–91] | 9849 | [1–449] |
| 9677 | [1–434] | 9726 | [117–183] | 9803 | [1–236] | 9850 | [1–117] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 9804 | [1–254] | 9851 | [1–173] | 9980 | [1–423] | 10027 | [1–468] |
| 9805 | [1–351] | 9852 | [1–444] | 9981 | [1–283] | 10028 | [1–396] |
| 9806 | [1–425] | 9853 | [1–387] | 9982 | [1–55] | 10029 | [1–436] |
| 9807 | [1–68] | 9854 | [1–396] | 9983 | [1–388] | 10030 | [1–452] |
| 9808 | [1–394] | 9855 | [1–92] | 9984 | [1–71] | 10031 | [1–471] |
| 9809 | [1–463] | 9856 | [1–439] | 9985 | [1–485] | 10032 | [1–527] |
| 9810 | [1–368] | 9857 | [1–440] | 9986 | [1–162] | 10033 | [1–463] |
| 9811 | [1–62] | 9858 | [1–429] | 9987 | [1–455] | 10034 | [1–461] |
| 9859 | [1–488] | 9909 | [1–265] | 9988 | [116–488] | 10035 | [1–439] |
| 9860 | [1–438] | 9910 | [1–424] | 9989 | [1–383] | 10036 | [1–86] |
| 9862 | [1–472] | 9911 | [1–73] | 9990 | [1–491] | 10037 | [1–478] |
| 9863 | [1–345] | 9912 | [1–441] | 9991 | [1–500] | 10038 | [1–36] |
| 9864 | [1–110] | 9913 | [1–414] | 9992 | [1–448] | 10039 | [1–393] |
| 9865 | [1–157] | 9914 | [1–442] | 9993 | [1–355] | 10040 | [1–435] |
| 9866 | [1–461] | 9915 | [112–167] | 9994 | [1–77] | 10041 | [1–433] |
| 9867 | [32–475] | 9916 | [1–138] | 9995 | [1–481] | 10042 | [1–43],[305–366], [446–483] |
| 9868 | [1–144] | 9917 | [1–412] | | | | |
| 9869 | [242–502] | 9918 | [1–891] | 9996 | [1–367] | 10043 | [1–437] |
| 9870 | [1–356] | 9919 | [1–200] | 9997 | [1–86] | 10044 | [1–461] |
| 9871 | [1–165] | 9920 | [1–134] | 9998 | [1–327] | 10045 | [1–135] |
| 9872 | [1–424] | 9921 | [1–164] | 9999 | [164–348] | 10046 | [1–72] |
| 9873 | [1–175] | 9922 | [1–468] | 10000 | [1–479] | 10047 | [1–78] |
| 9875 | [1–452] | 9923 | [1–414] | 10001 | [1–391] | 10048 | [1–230] |
| 9876 | [1–137] | 9924 | [1–169] | 10002 | [1–325] | 10049 | [1–162] |
| 9877 | [1–426] | 9925 | [1–69] | 10003 | [1–367] | 10050 | [214–391] |
| 9878 | [1–439] | 9926 | [1–441] | 10004 | [1–437] | 10051 | [1–120] |
| 9879 | [1–504] | 9927 | [1–96] | 10005 | [1–364] | 10052 | [1–329] |
| 9880 | [1–194] | 9928 | [1–457] | 10006 | [1–476] | 10053 | [1–438] |
| 9881 | [1–483] | 9929 | [1–54] | 10007 | [1–486] | 10054 | [1–120] |
| 9882 | [1–335],[411–438] | 9930 | [1–379] | 10055 | [1–227] | 10102 | [1–126] |
| 9883 | [323–581] | 9931 | [1–419] | 10056 | [1–94] | 10103 | [1–146] |
| 9884 | [1–345] | 9932 | [1–422] | 10057 | [1–430] | 10105 | [1–466] |
| 9885 | [1–280] | 9933 | [1–198] | 10058 | [1–473] | 10106 | [1–441] |
| 9886 | [1–359] | 9934 | [1–207] | 10059 | [1–161] | 10107 | [1–324] |
| 9887 | [1–444] | 9935 | [1–413] | 10060 | [1–344] | 10108 | [1–41] |
| 9889 | [1–461] | 9936 | [1–440] | 10061 | [1–496] | 10109 | [1–379] |
| 9890 | [1–79] | 9937 | [168–391] | 10062 | [1–382] | 10110 | [1–375] |
| 9891 | [1–137],[306–439] | 9938 | [127–308] | 10063 | [1–272] | 10111 | [1–417] |
| 9892 | [1–68] | 9939 | [1–328] | 10064 | [1–530] | 10112 | [1–81] |
| 9893 | [1–482] | 9940 | [1–400] | 10065 | [1–44],[129–473] | 10113 | [1–467] |
| 9894 | [1–145] | 9941 | [1–161] | 10066 | [1–398] | 10115 | [1–432] |
| 9895 | [1–379] | 9942 | [1–169] | 10067 | [1–170] | 10116 | [1–289] |
| 9896 | [1–449] | 9944 | [148–172] | 10068 | [1–404] | 10117 | [1–423] |
| 9897 | [1–478] | 9945 | [1–138] | 10069 | [1–103] | 10118 | [1–89] |
| 9898 | [1–414] | 9947 | [1–64] | 10070 | [1–120] | 10120 | [1–341] |
| 9899 | [1–177] | 9948 | [1–219] | 10071 | [1–261] | 10121 | [1–201] |
| 9900 | [1–245] | 9949 | [1–190] | 10072 | [1–322] | 10122 | [1–436] |
| 9901 | [1–425] | 9950 | [1–188] | 10073 | [1–509] | 10123 | [1–405] |
| 9902 | [1–155] | 9951 | [1–140] | 10074 | [1–399] | 10124 | [1–343] |
| 9903 | [1–308] | 9952 | [1–188] | 10075 | [1–484] | 10125 | [1–473] |
| 9904 | [1–79] | 9953 | [1–176] | 10076 | [1–292] | 10126 | [1–451] |
| 9905 | [1–296] | 9954 | [1–176] | 10077 | [1–316] | 10127 | [1–342] |
| 9906 | [1–429] | 9955 | [1–479] | 10078 | [1–390] | 10128 | [1–228] |
| 9907 | [1–174] | 9956 | [1–400] | 10079 | [1–498] | 10129 | [1–414] |
| 9908 | [1–180] | 9957 | [1–380] | 10080 | [1–223] | 10130 | [1–107] |
| 9958 | [1–112] | 10008 | [1–415] | 10081 | [50–472] | 10131 | [1–89] |
| 9959 | [1–423] | 10009 | [1–289] | 10082 | [1–284] | 10132 | [1–223] |
| 9960 | [1–128] | 10010 | [1–440] | 10083 | [1–410] | 10133 | [1–78] |
| 9961 | [1–364] | 10011 | [1–326] | 10084 | [1–407] | 10134 | [1–125] |
| 9963 | [1–185] | 10012 | [1–361] | 10085 | [47–345] | 10135 | [1–128],[215–440] |
| 9964 | [1–469] | 10013 | [1–514] | 10086 | [1–136] | 10136 | [1–107],[189–348] |
| 9966 | [1–72] | 10014 | [1–476] | 10087 | [1–461] | 10137 | [1–257] |
| 9967 | [1–104] | 10015 | [1–289] | 10088 | [1–519] | 10138 | [1–429] |
| 9968 | [1–176] | 10016 | [1–411] | 10089 | [1–187] | 10139 | [1–337] |
| 9970 | [1–434] | 10017 | [1–246] | 10090 | [1–465] | 10140 | [1–476] |
| 9971 | [1–439] | 10018 | [1–432] | 10091 | [1–67] | 10141 | [1–308] |
| 9972 | [1–114] | 10019 | [1–502] | 10092 | [1–476] | 10142 | [1–61] |
| 9973 | [1–349] | 10020 | [1–326] | 10093 | [1–445] | 10143 | [1–173] |
| 9974 | [1–505] | 10021 | [1–106] | 10094 | [1–227] | 10144 | [1–176] |
| 9975 | [1–86] | 10022 | [1–445] | 10095 | [1–398] | 10145 | [1–72] |
| 9976 | [1–487] | 10023 | [1–212] | 10096 | [1–67],[164–367] | 10146 | [1–368] |
| 9977 | [1–338] | 10024 | [1–119] | 10097 | [1–46],[129–502] | 10147 | [52–357] |
| 9978 | [1–387] | 10025 | [1–337] | 10098 | [1–445] | 10148 | [1–145] |
| 9979 | [1–438] | 10026 | [1–146] | 10099 | [1–339] | 10149 | [1–444] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 10100 | [1–456] | 10150 | [1–434] | 10276 | [1–441] | 10325 | [1–445] |
| 10101 | [1–208] | 10151 | [1–142] | 10277 | [1–237] | 10326 | [165–342] |
| 10152 | [1–443] | 10203 | [1–257] | 10278 | [1–252] | 10327 | [1–362] |
| 10153 | [1–496] | 10204 | [1–215] | 10279 | [1–437] | 10328 | [1–304] |
| 10154 | [1–119] | 10205 | [1–379] | 10280 | [1–340] | 10329 | [37–308] |
| 10155 | [1–330] | 10206 | [1–92],[308–419] | 10281 | [1–343] | 10330 | [218–278] |
| 10156 | [1–50] | 10207 | [1–487] | 10282 | [1–402] | 10331 | [1–259] |
| 10157 | [1–347] | 10208 | [1–51] | 10283 | [1–377] | 10332 | [1–656] |
| 10158 | [1–343] | 10209 | [1–367] | 10284 | [1–386] | 10333 | [1–445] |
| 10159 | [1–252] | 10210 | [1–88] | 10285 | [1–440] | 10334 | [1–589] |
| 10161 | [1–67] | 10211 | [1–299] | 10286 | [1–247] | 10335 | [61–160] |
| 10162 | [1–323] | 10212 | [1–435] | 10287 | [1–422] | 10336 | [331–498] |
| 10163 | [1–345] | 10213 | [1–77] | 10288 | [1–135] | 10337 | [1–517] |
| 10164 | [79–244] | 10214 | [1–322] | 10289 | [1–430] | 10338 | [1–493] |
| 10165 | [1–484] | 10215 | [1–288] | 10290 | [1–427] | 10339 | [1–525] |
| 10166 | [1–375] | 10216 | [1–391] | 10291 | [1–422] | 10340 | [1–293] |
| 10167 | [1–476] | 10217 | [1–490] | 10292 | [1–75] | 10341 | [276–447] |
| 10169 | [1–355] | 10218 | [1–448] | 10293 | [1–477] | 10342 | [1–399] |
| 10170 | [1–472] | 10219 | [1–455] | 10294 | [1–469] | 10343 | [1–523] |
| 10171 | [1–467] | 10220 | [1–279] | 10295 | [1–488],[540–1211] | 10344 | [1–332] |
| 10172 | [1–327] | 10221 | [1–477] | 10296 | [1–481] | 10345 | [1–370] |
| 10173 | [1–326] | 10222 | [1–386] | 10297 | [1–259] | 10346 | [1–330] |
| 10174 | [52–369] | 10223 | [1–395] | 10347 | [1–75] | 10394 | [1–483] |
| 10175 | [88–488] | 10224 | [1–359] | 10348 | [1–557] | 10395 | [60–541] |
| 10177 | [1–433] | 10225 | [37–107] | 10349 | [1–428] | 10396 | [32–510] |
| 10178 | [1–246] | 10226 | [55–209] | 10350 | [1–445] | 10397 | [1–535] |
| 10179 | [49–108] | 10227 | [1–271] | 10351 | [1–397] | 10398 | [1–606] |
| 10180 | [1–492] | 10228 | [1–570] | 10352 | [1–451] | 10399 | [1–486] |
| 10181 | [1–77] | 10229 | [1–252] | 10353 | [1–417] | 10400 | [1–416] |
| 10182 | [1–188] | 10230 | [1–488] | 10354 | [1–485] | 10401 | [162–503] |
| 10183 | [1–40] | 10231 | [1–328] | 10355 | [1–458] | 10402 | [1–481] |
| 10184 | [1–191] | 10232 | [32–485] | 10356 | [1–293] | 10403 | [1–485] |
| 10185 | [1–255] | 10233 | [1–429] | 10357 | [1–220] | 10404 | [1–293] |
| 10186 | [1–326] | 10234 | [1–361] | 10358 | [1–73] | 10405 | [1–423] |
| 10187 | [1–503] | 10235 | [1–306] | 10359 | [1–431] | 10406 | [1–46],[109–427] |
| 10188 | [1–161] | 10236 | [1–407] | 10360 | [1–447] | 10407 | [30–86],[250–478] |
| 10190 | [1–314] | 10237 | [1–250] | 10361 | [1–360] | 10408 | [1–536] |
| 10191 | [1–486] | 10238 | [1–252] | 10362 | [1–460] | 10409 | [1–473] |
| 10192 | [1–337] | 10239 | [1–432] | 10363 | [1–401] | 10410 | [1–481] |
| 10193 | [1–271] | 10240 | [1–207] | 10364 | [1–188] | 10411 | [1–468] |
| 10194 | [89–418] | 10241 | [1–315] | 10365 | [1–496] | 10412 | [1–445] |
| 10195 | [1–130] | 10242 | [1–312] | 10366 | [32–496] | 10413 | [1–505] |
| 10196 | [1–77] | 10243 | [1–378] | 10367 | [1–449] | 10414 | [1–510] |
| 10197 | [1–76] | 10244 | [1–341] | 10368 | [1–337] | 10415 | [50–461] |
| 10198 | [1–398] | 10245 | [1–247] | 10369 | [1–448] | 10416 | [1–358] |
| 10199 | [1–452] | 10246 | [1–331] | 10370 | [1–116] | 10417 | [46–547] |
| 10200 | [1–476] | 10247 | [1–318] | 10371 | [1–453] | 10418 | [1–487] |
| 10201 | [1–78] | 10248 | [1–248] | 10372 | [1–450] | 10419 | [1–73] |
| 10202 | [289–365] | 10249 | [1–460] | 10373 | [1–427] | 10420 | [1–77] |
| 10250 | [1–136] | 10299 | [1–344],[444–519] | 10374 | [1–323] | 10421 | [228–425] |
| 10251 | [151–206] | 10300 | [1–310] | 10375 | [1–426] | 10422 | [1–535] |
| 10252 | [1–400] | 10301 | [1–323] | 10376 | [1–489] | 10423 | [1–357] |
| 10253 | [170–414] | 10302 | [90–290] | 10377 | [1–257] | 10424 | [1–72] |
| 10254 | [1–147] | 10303 | [1–359] | 10378 | [1–444] | 10425 | [1–441] |
| 10255 | [1–55] | 10304 | [1–303] | 10379 | [1–574] | 10426 | [1–184],[301–388] |
| 10256 | [1–397] | 10305 | [1–462] | 10380 | [1–271] | 10427 | [1–198] |
| 10257 | [1–425] | 10306 | [1–249] | 10381 | [1–539] | 10428 | [1–517] |
| 10258 | [1–319] | 10307 | [1–344] | 10382 | [1–232] | 10429 | [1–80] |
| 10259 | [1–423] | 10308 | [1–468] | 10383 | [1–147] | 10430 | [1–483] |
| 10260 | [1–381] | 10309 | [1–486] | 10384 | [1–417] | 10431 | [1–317] |
| 10261 | [1–433] | 10310 | [1–391] | 10385 | [1–478] | 10432 | [1–587] |
| 10262 | [1–336] | 10311 | [1–72] | 10386 | [1–376],[433–583] | 10433 | [1–435] |
| 10263 | [1–110] | 10312 | [1–70] | 10387 | [1–450] | 10435 | [1–333] |
| 10264 | [1–170] | 10313 | [1–426] | 10388 | [1–418] | 10436 | [1–469] |
| 10265 | [1–493] | 10314 | [1–444] | 10389 | [1–593] | 10437 | [1–306] |
| 10266 | [1–498] | 10315 | [1–348] | 10390 | [1–113] | 10438 | [1–500] |
| 10267 | [1–532] | 10317 | [1–440] | 10391 | [1–354] | 10439 | [1–140],[200–486] |
| 10268 | [1–563] | 10318 | [1–433] | 10392 | [1–395] | 10440 | [1–360] |
| 10269 | [1–266] | 10319 | [1–283] | 10393 | [1–586] | 10441 | [1–452] |
| 10270 | [95–466] | 10320 | [1–505] | 10442 | [1–75] | 10491 | [1–625] |
| 10271 | [1–28],[101–157] | 10321 | [1–157] | 10443 | [1–466] | 10492 | [1–555] |
| 10272 | [1–452] | 10322 | [1–436] | 10444 | [1–463] | 10493 | [1–600] |
| 10273 | [1–352] | 10323 | [1–445] | 10445 | [1–474] | 10494 | [1–312] |
| 10274 | [1–429] | 10324 | [1–450] | 10446 | [1–431] | 10495 | [1–469] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 10448 | [1–505] | 10496 | [52–373] | 10570 | [1–523] | 10618 | [1–563] |
| 10449 | [1–559] | 10497 | [1–406] | 10571 | [1–559] | 10619 | [1–454] |
| 10450 | [187–226] | 10498 | [1–390] | 10572 | [1–354] | 10621 | [1–470] |
| 10451 | [1–515] | 10499 | [1–63],[169–340] | 10573 | [106–296] | 10622 | [1–438] |
| 10452 | [1–533] | 10500 | [1–142] | 10574 | [1–271] | 10623 | [46–451] |
| 10454 | [1–474] | 10501 | [1–467] | 10575 | [1–90] | 10624 | [1–529] |
| 10455 | [1–500] | 10502 | [1–487] | 10576 | [1–353] | 10625 | [1–512] |
| 10456 | [1–418] | 10503 | [1–454] | 10577 | [1–314] | 10626 | [1–562] |
| 10457 | [1–362] | 10504 | [1–399] | 10578 | [1–119] | 10627 | [1–106],[137–337] |
| 10458 | [1–477] | 10505 | [1–433] | 10579 | [1–351] | 10628 | [1–501] |
| 10459 | [1–465] | 10506 | [1–402] | 10580 | [1–80] | 10629 | [1–365],[454–489] |
| 10460 | [1–519] | 10507 | [1–395] | 10581 | [1–361] | 10630 | [1–281] |
| 10461 | [1–69] | 10508 | [1–155] | 10582 | [1–47],[83–120] | 10631 | [1–400] |
| 10462 | [1–573] | 10509 | [1–338] | 10583 | [1–535] | 10632 | [1–511] |
| 10463 | [1–537] | 10510 | [1–346] | 10584 | [1–57] | 10633 | [1–374] |
| 10464 | [1–378] | 10511 | [1–577] | 10585 | [1–511] | 10634 | [1–487] |
| 10465 | [1–105] | 10512 | [1–386] | 10635 | [1–514] | 10682 | [1–410] |
| 10466 | [1–63] | 10513 | [1–151] | 10636 | [1–551] | 10683 | [1–487] |
| 10467 | [1–145] | 10514 | [1–142] | 10637 | [50–466] | 10684 | [1–546] |
| 10468 | [1–282] | 10515 | [1–164] | 10638 | [1–451] | 10685 | [1–501] |
| 10469 | [1–349] | 10516 | [1–524] | 10639 | [1–552] | 10686 | [1–293] |
| 10470 | [1–89] | 10517 | [1–400] | 10640 | [1–456] | 10687 | [1–477] |
| 10471 | [1–64] | 10518 | [1–387] | 10641 | [1–169] | 10688 | [1–447] |
| 10472 | [1–558] | 10519 | [1–408] | 10642 | [1–155] | 10689 | [1–84] |
| 10473 | [1–474] | 10520 | [1–433] | 10643 | [1–440] | 10690 | [1–67] |
| 10474 | [1–547] | 10521 | [1–369] | 10644 | [1–129] | 10691 | [1–429] |
| 10475 | [1–529] | 10522 | [1–441] | 10645 | [1–541] | 10692 | [1–356] |
| 10476 | [1–515] | 10523 | [1–534] | 10646 | [1–557] | 10693 | [1–361] |
| 10477 | [1–454] | 10524 | [1–274] | 10647 | [1–557] | 10694 | [1–162],[216–271] |
| 10478 | [1–145] | 10525 | [1–473] | 10648 | [1–484] | 10695 | [1–270] |
| 10479 | [1–419] | 10526 | [112–140] | 10649 | [1–553] | 10696 | [1–521] |
| 10480 | [1–503] | 10527 | [1–514] | 10650 | [1–538] | 10697 | [1–344] |
| 10481 | [1–450] | 10528 | [1–209] | 10651 | [1–497] | 10698 | [1–379] |
| 10482 | [1–398] | 10529 | [1–55] | 10652 | [1–445] | 10699 | [1–419] |
| 10483 | [1–369] | 10530 | [1–26],[70–232],[265–401] | 10653 | [1–309] | 10700 | [1–208],[293–470] |
| 10484 | [1–343] | 10531 | [1–300] | 10654 | [1–426] | 10701 | [1–288] |
| 10485 | [395–474] | 10532 | [1–416] | 10655 | [1–527] | 10702 | [1–299] |
| 10486 | [56–369] | 10533 | [1–481] | 10656 | [1–149] | 10703 | [1–470] |
| 10487 | [1–439] | 10534 | [50–474] | 10657 | [1–525] | 10704 | [1–85] |
| 10488 | [63–435] | 10535 | [1–188] | 10658 | [1–470] | 10705 | [1–540] |
| 10489 | [1–494] | 10536 | [50–474] | 10659 | [1–520] | 10706 | [1–420] |
| 10490 | [1–343] | 10537 | [1–428] | 10660 | [1–403] | 10707 | [1–233],[264–304] |
| 10538 | [1–581] | 10586 | [1–116] | 10661 | [1–428] | 10708 | [1–499] |
| 10539 | [1–442] | 10587 | [1–312] | 10662 | [1–503] | 10709 | [1–418] |
| 10540 | [1–294] | 10588 | [1–591] | 10663 | [1–468],[529–562] | 10710 | [1–194] |
| 10542 | [1–493] | 10589 | [1–129],[160–503] | 10664 | [1–583] | 10711 | [1–474] |
| 10543 | [1–193] | 10590 | [1–572] | 10665 | [1–265] | 10712 | [1–486] |
| 10544 | [1–396] | 10591 | [65–491] | 10666 | [1–480] | 10713 | [1–58] |
| 10545 | [1–506] | 10592 | [1–127] | 10667 | [89–433] | 10714 | [1–468] |
| 10546 | [1–504] | 10593 | [1–370] | 10668 | [1–260] | 10715 | [1–59] |
| 10547 | [1–154] | 10594 | [1–607] | 10669 | [1–493] | 10716 | [1–433] |
| 10548 | [1–501] | 10595 | [1–447] | 10670 | [1–345] | 10717 | [1–396] |
| 10549 | [1–127] | 10596 | [1–532] | 10671 | [1–196] | 10718 | [1–443] |
| 10550 | [1–439] | 10597 | [1–445] | 10672 | [1–447] | 10719 | [1–65] |
| 10551 | [1–409] | 10598 | [1–50] | 10673 | [1–429] | 10720 | [1–421] |
| 10552 | [1–72] | 10599 | [1–453] | 10674 | [1–531] | 10721 | [1–500] |
| 10553 | [32–494] | 10600 | [1–425] | 10675 | [1–233] | 10722 | [1–149] |
| 10554 | [1–409] | 10601 | [1–443] | 10676 | [1–410] | 10723 | [1–109] |
| 10555 | [1–306] | 10602 | [1–482] | 10677 | [1–497] | 10724 | [1–383] |
| 10556 | [1–491] | 10603 | [1–494] | 10678 | [1–402] | 10725 | [1–414] |
| 10557 | [1–437] | 10604 | [1–480] | 10679 | [1–351] | 10726 | [1–485] |
| 10558 | [1–337] | 10605 | [1–407] | 10680 | [1–298] | 10727 | [1–270] |
| 10559 | [1–233],[267–403] | 10606 | [50–472] | 10681 | [1–413] | 10728 | [1–492] |
| 10560 | [1–319] | 10607 | [89–303] | 10729 | [1–496] | 10779 | [1–268] |
| 10561 | [1–142] | 10608 | [1–250] | 10730 | [1–483] | 10780 | [1–479] |
| 10562 | [229–385] | 10609 | [1–87] | 10731 | [1–269] | 10781 | [1–462] |
| 10563 | [1–249] | 10611 | [1–391] | 10732 | [1–168] | 10782 | [1–431] |
| 10564 | [1–349] | 10612 | [1–187],[337–447] | 10733 | [1–266] | 10783 | [1–232] |
| 10565 | [1–443] | 10613 | [1–338] | 10734 | [1–472] | 10784 | [1–63] |
| 10566 | [1–419] | 10614 | [1–437] | 10735 | [1–88] | 10785 | [1–154] |
| 10567 | [1–328] | 10615 | [1–480] | 10736 | [1–264] | 10786 | [1–434] |
| 10568 | [1–106] | 10616 | [1–503] | 10737 | [1–206] | 10787 | [1–152] |
| 10569 | [1–575] | 10617 | [1–556] | 10738 | [1–454] | 10788 | [1–343] |
|  |  |  |  | 10739 | [1–485] | 10789 | [1–247] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 10740 | [1–291] | 10790 | [1–441] | 10865 | [1–438] | 10914 | [1–229] |
| 10741 | [1–415] | 10791 | [1–223] | 10866 | [1–256] | 10915 | [1–251] |
| 10742 | [1–514] | 10792 | [1–441] | 10867 | [1–197] | 10916 | [1–59] |
| 10744 | [1–481] | 10793 | [1–304] | 10868 | [1–372] | 10917 | [1–477] |
| 10745 | [1–468] | 10794 | [1–172] | 10869 | [1–358] | 10918 | [1–469] |
| 10746 | [1–478] | 10795 | [1–254] | 10870 | [1–389] | 10919 | [1–353] |
| 10747 | [1–468] | 10796 | [1–374] | 10871 | [1–53] | 10920 | [1–112] |
| 10748 | [1–277] | 10797 | [1–80] | 10872 | [1–296] | 10921 | [1–247] |
| 10749 | [1–475] | 10798 | [91–417] | 10873 | [1–378] | 10922 | [1–80] |
| 10750 | [1–150] | 10799 | [1–268] | 10923 | [72–218] | 10971 | [1–72] |
| 10751 | [1–375] | 10800 | [1–447] | 10924 | [1–226] | 10973 | [1–366] |
| 10752 | [1–305] | 10801 | [61–142] | 10925 | [1–243] | 10974 | [1–497] |
| 10753 | [1–360] | 10802 | [1–245] | 10926 | [1–463] | 10975 | [1–430] |
| 10754 | [1–455] | 10803 | [1–168] | 10927 | [1–512] | 10976 | [1–520] |
| 10755 | [1–258] | 10804 | [1–361] | 10928 | [1–463] | 10977 | [1–374] |
| 10756 | [52–376] | 10805 | [1–170] | 10929 | [1–131] | 10978 | [1–149],[230–292], [361–478] |
| 10757 | [1–271] | 10806 | [1–376] | | | | |
| 10759 | [1–455] | 10807 | [1–343] | 10930 | [1–312] | 10979 | [31–461] |
| 10761 | [1–364] | 10808 | [1–221] | 10931 | [1–242] | 10980 | [1–55] |
| 10762 | [1–81],[211–476] | 10809 | [86–264] | 10932 | [1–79] | 10981 | [1–456] |
| 10763 | [1–70],[135–440] | 10811 | [1–188] | 10933 | [1–386] | 10982 | [1–459] |
| 10764 | [1–71] | 10812 | [1–447] | 10934 | [1–464] | 10983 | [1–209] |
| 10765 | [1–481] | 10813 | [1–52] | 10935 | [1–412] | 10984 | [1–250] |
| 10766 | [1–162] | 10814 | [1–237] | 10936 | [1–531] | 10985 | [1–424] |
| 10767 | [1–506] | 10815 | [1–232] | 10937 | [1–304] | 10986 | [1–438] |
| 10768 | [1–421] | 10816 | [1–263] | 10938 | [1–372] | 10987 | [1–443] |
| 10769 | [1–329] | 10817 | [1–401] | 10939 | [1–458] | 10988 | [1–341] |
| 10770 | [1–354] | 10818 | [1–463] | 10940 | [1–136] | 10989 | [1–274] |
| 10771 | [1–127] | 10819 | [1–436] | 10941 | [1–185] | 10990 | [1–328] |
| 10772 | [46–263] | 10820 | [1–222] | 10942 | [1–220] | 10991 | [1–442] |
| 10773 | [1–320] | 10821 | [1–355] | 10943 | [1–366] | 10992 | [1–410] |
| 10774 | [1–203] | 10822 | [1–88] | 10944 | [1–359] | 10993 | [1–322] |
| 10775 | [1–347] | 10823 | [1–398] | 10946 | [80–200] | 10994 | [1–309] |
| 10776 | [1–375] | 10824 | [1–504] | 10947 | [1–344] | 10995 | [1–412] |
| 10777 | [1–372] | 10825 | [1–45],[269–364] | 10948 | [1–391] | 10996 | [50–471] |
| 10778 | [1–379] | 10826 | [1–58] | 10949 | [1–87] | 10997 | [1–246] |
| 10827 | [1–440] | 10874 | [1–294] | 10950 | [1–369] | 10998 | [1–487] |
| 10828 | [1–331] | 10875 | [1–157] | 10951 | [1–364] | 10999 | [1–167] |
| 10829 | [1–80] | 10876 | [1–484] | 10952 | [1–364] | 11000 | [1–233],[264–292] |
| 10830 | [1–234] | 10877 | [1–475] | 10953 | [1–239] | 11001 | [1–73] |
| 10831 | [1–429] | 10878 | [1–438] | 10954 | [1–481] | 11002 | [1–293] |
| 10832 | [1–69] | 10879 | [1–288] | 10955 | [1–209] | 11003 | [137–212],[270–395] |
| 10833 | [54–189] | 10880 | [1–58] | 10956 | [1–67] | 11004 | [1–544] |
| 10834 | [130–440] | 10881 | [1–300] | 10957 | [1–428] | 11005 | [1–223] |
| 10835 | [1–418] | 10882 | [1–238] | 10958 | [1–453] | 11006 | [1–552] |
| 10836 | [1–348] | 10883 | [1–340] | 10959 | [1–346] | 11007 | [1–53] |
| 10837 | [1–51] | 10884 | [1–358] | 10960 | [1–506] | 11008 | [1–491] |
| 10838 | [1–130] | 10885 | [1–171] | 10961 | [1–146] | 11009 | [1–155] |
| 10839 | [1–348] | 10886 | [1–429] | 10962 | [1–150] | 11010 | [1–452] |
| 10840 | [1–233] | 10887 | [1–476] | 10963 | [1–597] | 11011 | [1–469] |
| 10841 | [1–446] | 10888 | [1–301] | 10964 | [1–507] | 11012 | [1–498] |
| 10842 | [1–101] | 10889 | [1–407] | 10965 | [1–438] | 11013 | [1–376] |
| 10843 | [1–282] | 10890 | [1–497] | 10966 | [1–356] | 11014 | [1–460] |
| 10844 | [1–199] | 10891 | [1–53] | 10967 | [1–591] | 11015 | [71–318],[353–468] |
| 10845 | [1–471] | 10892 | [1–360] | 10968 | [1–485] | 11016 | [1–419] |
| 10846 | [1–134] | 10893 | [1–436] | 10969 | [1–418] | 11017 | [1–403] |
| 10847 | [1–166] | 10895 | [1–358] | 10970 | [1–397] | 11018 | [1–365] |
| 10848 | [1–326] | 10896 | [1–67] | 11019 | [1–458] | 11067 | [1–531] |
| 10849 | [1–246] | 10897 | [218–278] | 11021 | [1–499] | 11068 | [1–483] |
| 10850 | [1–390] | 10898 | [1–156] | 11022 | [1–80] | 11069 | [1–312] |
| 10851 | [1–243] | 10899 | [1–85],[131–215] | 11023 | [1–452] | 11070 | [1–488] |
| 10852 | [1–483] | 10900 | [1–159] | 11024 | [1–418] | 11071 | [1–253] |
| 10853 | [1–435] | 10901 | [1–375] | 11025 | [1–497] | 11072 | [53–398] |
| 10854 | [1–93] | 10902 | [1–479] | 11026 | [1–470] | 11073 | [1–499] |
| 10855 | [1–217] | 10903 | [1–476] | 11027 | [1–482] | 11074 | [1–401] |
| 10856 | [1–487] | 10904 | [1–373] | 11028 | [1–498] | 11075 | [1–444] |
| 10857 | [1–349] | 10905 | [1–369] | 11029 | [1–479] | 11076 | [1–448] |
| 10858 | [1–470] | 10906 | [1–103] | 11030 | [52–357] | 11077 | [1–332],[446–482] |
| 10859 | [1–433] | 10907 | [1–68] | 11031 | [1–470] | 11078 | [228–273] |
| 10860 | [1–450] | 10908 | [1–349] | 11032 | [1–416] | 11079 | [1–331] |
| 10861 | [1–333] | 10909 | [1–138] | 11033 | [1–414] | 11080 | [50–391] |
| 10862 | [1–76],[110–350] | 10911 | [1–184] | 11034 | [1–484] | 11081 | [1–488] |
| 10863 | [1–184] | 10912 | [1–197] | 11035 | [1–489] | 11082 | [1–258] |
| 10864 | [1–450] | 10913 | [1–227] | 11036 | [1–501] | 11083 | [1–468] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11037 | [1–76] | 11084 | [1–339] | 11159 | [1–293] | 11209 | [1–58],[89–205] |
| 11038 | [1–128],[159–469] | 11085 | [1–488] | 11160 | [1–505] | 11210 | [1–96] |
| 11039 | [1–487] | 11086 | [1–478] | 11161 | [1–176] | 11211 | [1–257] |
| 11040 | [1–475] | 11087 | [61–135] | 11213 | [1–201] | 11265 | [1–73] |
| 11041 | [1–482] | 11088 | [1–438] | 11214 | [1–381] | 11266 | [1–224] |
| 11042 | [1–391] | 11090 | [1–61] | 11216 | [1–251] | 11267 | [1–399] |
| 11043 | [1–424] | 11091 | [1–62] | 11217 | [1–207] | 11268 | [1–168] |
| 11044 | [1–481] | 11092 | [1–336] | 11218 | [1–132] | 11269 | [1–219] |
| 11045 | [1–306] | 11093 | [1–454] | 11219 | [1–245] | 11270 | [1–219] |
| 11046 | [1–443] | 11094 | [49–125] | 11220 | [1–235] | 11271 | [1–228] |
| 11047 | [1–491] | 11095 | [1–67] | 11221 | [1–321] | 11272 | [1–219] |
| 11048 | [1–252] | 11096 | [1–489] | 11222 | [1–281] | 11273 | [1–219] |
| 11049 | [1–414] | 11097 | [1–387] | 11223 | [109–306] | 11274 | [1–219] |
| 11050 | [53–416] | 11098 | [1–132] | 11224 | [1–169] | 11275 | [1–189] |
| 11051 | [1–89] | 11099 | [53–395] | 11225 | [1–260] | 11276 | [1–219] |
| 11052 | [1–436] | 11100 | [1–485] | 11226 | [1–270] | 11277 | [1–219] |
| 11053 | [1–466] | 11101 | [1–422] | 11227 | [208–481] | 11278 | [1–118] |
| 11054 | [1–483] | 11102 | [1–517] | 11228 | [1–318] | 11279 | [1–469] |
| 11055 | [1–442] | 11103 | [1–304] | 11229 | [1–425] | 11280 | [1–207] |
| 11056 | [1–347] | 11104 | [1–457] | 11230 | [1–356] | 11281 | [1–219] |
| 11057 | [1–492] | 11105 | [1–476] | 11231 | [74–248] | 11282 | [1–136] |
| 11058 | [1–432] | 11106 | [49–108] | 11232 | [1–51],[96–407] | 11283 | [1–206] |
| 11059 | [1–306] | 11107 | [1–446] | 11234 | [1–201] | 11284 | [1–219] |
| 11060 | [1–478] | 11108 | [1–397] | 11236 | [1–405] | 11285 | [1–206] |
| 11061 | [53–436] | 11109 | [1–379] | 11238 | [1–362] | 11286 | [1–219] |
| 11062 | [1–500] | 11110 | [1–488] | 11239 | [1–343] | 11287 | [1–111] |
| 11063 | [1–85] | 11111 | [1–414] | 11240 | [1–151] | 11288 | [1–219] |
| 11064 | [64–337] | 11112 | [1–399] | 11241 | [1–358] | 11289 | [1–219] |
| 11065 | [1–468] | 11113 | [1–432] | 11242 | [1–310] | 11290 | [1–74] |
| 11066 | [1–484] | 11114 | [1–471] | 11243 | [1–370] | 11291 | [1–136] |
| 11115 | [1–452] | 11162 | [1–394] | 11244 | [1–103] | 11292 | [1–219] |
| 11116 | [50–474] | 11163 | [1–126] | 11245 | [1–186] | 11293 | [1–219] |
| 11117 | [1–376] | 11164 | [1–460] | 11246 | [1–444] | 11294 | [1–206] |
| 11118 | [1–434] | 11165 | [1–478] | 11247 | [1–374] | 11295 | [1–136] |
| 11119 | [1–457] | 11166 | [1–80] | 11248 | [1–418] | 11296 | [1–219] |
| 11120 | [1–421] | 11167 | [1–311] | 11249 | [1–169] | 11297 | [1–219] |
| 11121 | [53–399] | 11168 | [1–488] | 11250 | [1–467] | 11298 | [1–399] |
| 11122 | [1–168] | 11169 | [1–507] | 11251 | [1–288] | 11299 | [1–206] |
| 11123 | [1–469] | 11170 | [1–495] | 11252 | [1–250] | 11300 | [1–193] |
| 11124 | [1–338] | 11171 | [1–309] | 11253 | [1–219] | 11301 | [1–129] |
| 11125 | [1–446] | 11172 | [1–529] | 11254 | [1–74] | 11302 | [1–128] |
| 11126 | [1–398] | 11173 | [1–482] | 11255 | [1–219] | 11303 | [1–72] |
| 11127 | [1–478] | 11174 | [1–127] | 11257 | [1–72] | 11304 | [1–219] |
| 11128 | [1–481] | 11175 | [1–209],[292–391] | 11258 | [1–447] | 11305 | [1–144] |
| 11129 | [1–397] | 11176 | [1–282] | 11259 | [1–219] | 11306 | [1–101] |
| 11130 | [1–474] | 11177 | [1–437] | 11260 | [1–219] | 11307 | [1–136] |
| 11131 | [1–460] | 11178 | [1–122] | 11261 | [1–219] | 11308 | [1–219] |
| 11132 | [1–214] | 11179 | [1–522] | 11262 | [1–282] | 11309 | [1–136] |
| 11133 | [1–509] | 11180 | [1–137] | 11263 | [1–219] | 11310 | [1–489] |
| 11134 | [37–312] | 11181 | [1–386] | 11264 | [1–219] | 11311 | [1–219] |
| 11135 | [1–469] | 11182 | [1–473] | 11312 | [1–61] | 11360 | [365–464] |
| 11136 | [1–495] | 11183 | [1–278] | 11313 | [1–419] | 11362 | [1–370],[418–523] |
| 11137 | [1–53] | 11184 | [1–478] | 11314 | [1–207] | 11363 | [1–415] |
| 11138 | [1–468] | 11185 | [1–518] | 11315 | [1–207] | 11364 | [328–447] |
| 11139 | [1–415] | 11187 | [1–502] | 11316 | [1–111] | 11365 | [1–281] |
| 11140 | [1–102] | 11188 | [1–408] | 11317 | [1–206] | 11366 | [1–505] |
| 11141 | [53–121] | 11189 | [1–488] | 11318 | [1–144] | 11367 | [1–306] |
| 11142 | [1–437] | 11190 | [1–413] | 11319 | [1–110] | 11368 | [1–440] |
| 11143 | [1–439] | 11191 | [1–428] | 11320 | [1–219] | 11369 | [1–498] |
| 11144 | [1–540] | 11192 | [1–80] | 11321 | [1–450] | 11370 | [1–439] |
| 11145 | [403–449] | 11193 | [1–130] | 11322 | [1–219] | 11371 | [1–341] |
| 11146 | [1–481] | 11194 | [1–83] | 11323 | [1–60] | 11372 | [124–278] |
| 11147 | [1–273] | 11195 | [1–139] | 11324 | [1–219] | 11373 | [1–325] |
| 11148 | [1–240] | 11196 | [1–470] | 11325 | [1–72] | 11374 | [1–644] |
| 11149 | [1–362] | 11197 | [1–391] | 11326 | [1–171] | 11375 | [1–610] |
| 11150 | [1–491] | 11198 | [1–104] | 11327 | [1–225] | 11376 | [1–489] |
| 11151 | [1–438] | 11199 | [1–55] | 11328 | [1–221] | 11377 | [1–482] |
| 11152 | [1–98] | 11200 | [1–175],[451–499] | 11329 | [1–219] | 11378 | [1–295] |
| 11153 | [1–503] | 11202 | [1–492] | 11330 | [1–237] | 11380 | [34–334] |
| 11154 | [1–479] | 11203 | [1–494] | 11331 | [1–153] | 11381 | [1–437] |
| 11155 | [1–493] | 11204 | [1–68] | 11332 | [1–219] | 11382 | [1–105] |
| 11156 | [1–476] | 11205 | [1–515] | 11333 | [1–219] | 11383 | [1–401] |
| 11157 | [52–370] | 11206 | [1–108] | 11334 | [1–207] | 11384 | [1–326] |
| 11158 | [1–566] | 11208 | [1–381] | 11335 | [1–121] | 11385 | [1–233] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11336 | [1–187] | 11386 | [1–292] | 11507 | [1–177] | 11554 | [1–495] |
| 11337 | [1–220] | 11387 | [1–493] | 11508 | [1–178] | 11555 | [1–328] |
| 11338 | [1–219] | 11388 | [1–525] | 11509 | [1–212] | 11556 | [1–120] |
| 11339 | [1–219] | 11389 | [1–543] | 11510 | [1–191] | 11557 | [1–70],[117–320] |
| 11340 | [1–185] | 11390 | [1–146] | 11511 | [1–318] | 11558 | [1–530] |
| 11342 | [1–198] | 11391 | [1–302] | 11512 | [1–345] | 11559 | [1–460] |
| 11343 | [1–498] | 11392 | [1–521] | 11513 | [1–317] | 11560 | [1–114] |
| 11344 | [214–388] | 11393 | [1–353] | 11514 | [56–355] | 11561 | [1–396] |
| 11345 | [1–426] | 11394 | [50–126],[194–236] | 11515 | [149–479] | 11562 | [1–147] |
| 11346 | [1–430] | 11395 | [1–212] | 11516 | [1–316] | 11563 | [1–324] |
| 11347 | [1–440] | 11396 | [1–285] | 11517 | [1–314] | 11564 | [1–280] |
| 11348 | [1–382] | 11397 | [1–148] | 11518 | [1–299] | 11565 | [1–387] |
| 11349 | [1–483] | 11398 | [1–147] | 11519 | [1–224] | 11566 | [1–148] |
| 11350 | [1–410] | 11399 | [1–375] | 11520 | [1–221] | 11567 | [1–318] |
| 11351 | [1–427] | 11400 | [1–234] | 11521 | [1–388] | 11568 | [1–305] |
| 11352 | [1–342] | 11401 | [1–77] | 11522 | [1–140] | 11569 | [1–200] |
| 11353 | [1–330] | 11402 | [1–394] | 11523 | [1–172] | 11570 | [1–200] |
| 11354 | [1–149],[188–409] | 11403 | [1–406] | 11524 | [1–413] | 11571 | [1–111] |
| 11355 | [1–471] | 11404 | [1–350] | 11525 | [1–147] | 11572 | [1–93] |
| 11356 | [1–307] | 11405 | [1–64] | 11526 | [1–298] | 11573 | [1–172] |
| 11357 | [1–107] | 11406 | [1–193] | 11527 | [1–597] | 11574 | [1–159] |
| 11358 | [1–330] | 11407 | [1–294] | 11528 | [1–300] | 11575 | [1–173] |
| 11359 | [54–192] | 11408 | [1–460] | 11529 | [1–303] | 11576 | [1–408] |
| 11409 | [1–401] | 11456 | [1–286] | 11530 | [1–317] | 11577 | [1–311] |
| 11410 | [1–428] | 11457 | [1–374] | 11531 | [1–457] | 11578 | [1–125] |
| 11411 | [1–203] | 11458 | [1–366] | 11532 | [1–402] | 11579 | [1–314] |
| 11412 | [1–326] | 11459 | [1–365] | 11533 | [1–387] | 11580 | [1–162] |
| 11413 | [1–99] | 11460 | [1–388] | 11534 | [1–175] | 11581 | [1–327] |
| 11414 | [1–57] | 11461 | [1–120] | 11535 | [1–312] | 11582 | [1–309] |
| 11415 | [1–428] | 11462 | [1–373] | 11536 | [1–61] | 11583 | [1–53] |
| 11416 | [1–307] | 11463 | [1–384] | 11537 | [1–371] | 11584 | [1–333] |
| 11417 | [1–466] | 11464 | [1–339] | 11538 | [1–306] | 11585 | [1–281] |
| 11418 | [1–316] | 11465 | [1–349] | 11539 | [1–313] | 11586 | [1–160] |
| 11419 | [1–306] | 11466 | [1–95] | 11540 | [1–77] | 11587 | [1–315] |
| 11420 | [1–136] | 11467 | [1–386] | 11541 | [1–463] | 11588 | [1–431] |
| 11421 | [1–249] | 11468 | [1–398] | 11542 | [1–316] | 11589 | [1–320] |
| 11422 | [1–224],[308–608] | 11469 | [1–453] | 11543 | [1–297] | 11590 | [1–200] |
| 11423 | [1–430] | 11470 | [1–172] | 11544 | [1–383] | 11591 | [1–200] |
| 11424 | [1–480] | 11471 | [1–446] | 11545 | [1–456] | 11592 | [1–171] |
| 11425 | [1–457] | 11472 | [1–425] | 11546 | [139–180] | 11593 | [1–162] |
| 11426 | [1–309] | 11473 | [1–311] | 11547 | [1–209] | 11594 | [1–118] |
| 11427 | [1–309] | 11474 | [1–441] | 11548 | [1–163] | 11595 | [32–245] |
| 11428 | [1–198] | 11475 | [1–367] | 11549 | [1–268] | 11596 | [1–86] |
| 11429 | [1–198] | 11476 | [1–348] | 11597 | [1–347] | 11646 | [1–122] |
| 11430 | [1–230] | 11477 | [1–178] | 11598 | [1–200] | 11647 | [1–294] |
| 11431 | [1–180] | 11478 | [1–149] | 11599 | [1–299] | 11648 | [1–189] |
| 11432 | [1–393] | 11479 | [1–418] | 11600 | [1–347] | 11649 | [1–301] |
| 11433 | [1–378] | 11480 | [1–415] | 11601 | [1–114] | 11650 | [1–152] |
| 11434 | [1–291] | 11481 | [116–323] | 11602 | [1–168] | 11651 | [1–55] |
| 11435 | [1–472] | 11482 | [1–442] | 11603 | [1–200] | 11652 | [1–109] |
| 11436 | [1–102] | 11483 | [1–385] | 11604 | [1–371] | 11653 | [1–201] |
| 11437 | [1–436] | 11484 | [1–476] | 11605 | [1–280] | 11654 | [1–110] |
| 11438 | [1–261] | 11485 | [1–426] | 11606 | [1–157],[224–250] | 11655 | [1–333] |
| 11439 | [1–504] | 11486 | [1–118] | 11607 | [1–165] | 11656 | [1–127] |
| 11440 | [1–506] | 11487 | [1–351] | 11608 | [1–353] | 11657 | [1–62] |
| 11441 | [1–452] | 11488 | [1–443] | 11609 | [1–385] | 11658 | [1–63] |
| 11442 | [40–255] | 11489 | [1–140] | 11610 | [1–383] | 11659 | [1–361] |
| 11443 | [1–244] | 11490 | [1–370] | 11611 | [1–174] | 11660 | [1–149] |
| 11444 | [1–396] | 11491 | [1–406] | 11612 | [1–295] | 11661 | [1–162] |
| 11445 | [1–261] | 11492 | [1–422] | 11613 | [1–68] | 11662 | [1–225] |
| 11446 | [1–137] | 11493 | [1–132] | 11614 | [1–160] | 11663 | [1–99] |
| 11447 | [1–367] | 11494 | [1–106] | 11615 | [1–281] | 11664 | [1–81] |
| 11448 | [1–346] | 11495 | [1–392] | 11616 | [39–87] | 11665 | [1–347] |
| 11449 | [1–486] | 11496 | [152–366] | 11617 | [1–225] | 11666 | [1–173] |
| 11450 | [1–318] | 11497 | [1–79] | 11619 | [1–200] | 11667 | [1–200] |
| 11451 | [1–352] | 11498 | [1–553] | 11620 | [1–322] | 11668 | [1–163] |
| 11452 | [1–241] | 11499 | [1–504] | 11621 | [1–369] | 11669 | [1–132] |
| 11453 | [1–400] | 11500 | [1–577] | 11622 | [1–166] | 11670 | [1–329] |
| 11454 | [1–495] | 11501 | [1–161] | 11623 | [1–170] | 11671 | [1–174] |
| 11455 | [1–117] | 11502 | [1–515] | 11624 | [1–152] | 11672 | [1–305] |
| 11503 | [1–154] | 11550 | [1–409] | 11625 | [1–144] | 11673 | [1–337] |
| 11504 | [1–176] | 11551 | [1–493] | 11626 | [1–225] | 11674 | [1–75],[183–224],[275–473] |
| 11505 | [1–238] | 11552 | [1–369] | 11627 | [1–226] | 11675 | [1–261] |
| 11506 | [1–174] | 11553 | [1–220] | | | | |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11628 | [1–341] | 11676 | [1–107] | 11798 | [1–298] | 11845 | [1–158] |
| 11629 | [1–173] | 11677 | [1–114] | 11799 | [1–106] | 11846 | [1–200] |
| 11630 | [1–316] | 11678 | [1–144] | 11800 | [1–118] | 11847 | [1–190] |
| 11631 | [1–78] | 11679 | [1–189] | 11801 | [1–224] | 11848 | [1–166] |
| 11632 | [1–195] | 11680 | [1–174] | 11802 | [1–197] | 11849 | [1–364] |
| 11633 | [1–78] | 11681 | [1–200] | 11803 | [1–213] | 11850 | [1–213] |
| 11634 | [1–221] | 11682 | [1–104] | 11804 | [1–226] | 11851 | [1–246] |
| 11635 | [1–242] | 11683 | [1–179] | 11805 | [1–340] | 11852 | [1–314] |
| 11636 | [1–134] | 11684 | [1–194] | 11806 | [1–345] | 11853 | [1–200] |
| 11638 | [1–173] | 11685 | [125–167] | 11807 | [1–243] | 11854 | [1–373] |
| 11639 | [1–127] | 11686 | [1–129] | 11808 | [1–171] | 11855 | [1–345] |
| 11640 | [1–216] | 11687 | [1–174] | 11809 | [1–207] | 11856 | [1–187] |
| 11641 | [1–303] | 11688 | [1–158] | 11810 | [1–126] | 11857 | [1–148] |
| 11642 | [1–336] | 11689 | [1–82] | 11811 | [1–235] | 11858 | [1–200] |
| 11643 | [1–112] | 11690 | [1–378] | 11812 | [1–121] | 11859 | [1–128] |
| 11644 | [1–170] | 11691 | [1–317] | 11813 | [1–172] | 11860 | [1–174] |
| 11645 | [1–109] | 11692 | [1–118] | 11814 | [1–331] | 11861 | [1–99] |
| 11693 | [1–347] | 11740 | [1–80] | 11815 | [1–117] | 11862 | [1–344] |
| 11694 | [1–278] | 11741 | [1–109] | 11816 | [1–213] | 11863 | [1–164] |
| 11695 | [1–361] | 11742 | [1–364] | 11817 | [1–79] | 11864 | [1–82] |
| 11696 | [1–430] | 11743 | [1–110] | 11818 | [1–187] | 11865 | [1–200] |
| 11697 | [1–187] | 11744 | [1–98] | 11819 | [1–53] | 11866 | [1–141] |
| 11698 | [1–140] | 11745 | [1–171] | 11820 | [1–241] | 11867 | [1–304] |
| 11699 | [1–130] | 11746 | [1–305] | 11821 | [1–122] | 11868 | [1–96] |
| 11700 | [1–373] | 11747 | [1–565] | 11822 | [1–139] | 11869 | [1–170] |
| 11701 | [1–212] | 11748 | [1–187] | 11823 | [1–173] | 11870 | [1–158] |
| 11702 | [1–155] | 11749 | [1–253] | 11824 | [1–201] | 11871 | [1–336] |
| 11703 | [1–285] | 11750 | [1–311] | 11825 | [1–200] | 11872 | [1–57] |
| 11704 | [1–365] | 11751 | [1–293] | 11826 | [1–490] | 11873 | [1–366] |
| 11705 | [1–137] | 11752 | [1–302] | 11827 | [1–305] | 11874 | [35–79] |
| 11706 | [1–377] | 11754 | [1–200] | 11828 | [1–371] | 11875 | [1–37],[75–381] |
| 11707 | [1–397] | 11755 | [1–302] | 11829 | [1–336] | 11876 | [1–59] |
| 11708 | [1–128] | 11756 | [1–129] | 11830 | [1–225] | 11877 | [1–279] |
| 11709 | [1–114] | 11757 | [1–462] | 11831 | [1–306] | 11878 | [1–174] |
| 11710 | [1–84] | 11758 | [1–130] | 11832 | [1–142] | 11879 | [1–318] |
| 11711 | [1–237] | 11759 | [1–136] | 11833 | [1–492] | 11880 | [1–360] |
| 11712 | [1–490] | 11760 | [1–271] | 11834 | [1–225] | 11881 | [1–306] |
| 11713 | [1–173] | 11761 | [1–136] | 11882 | [1–188] | 11930 | [1–298] |
| 11714 | [1–191] | 11762 | [1–200] | 11883 | [1–121] | 11931 | [1–201] |
| 11715 | [1–123] | 11763 | [1–309] | 11884 | [1–547] | 11932 | [1–316] |
| 11716 | [1–200] | 11764 | [1–152] | 11885 | [1–117] | 11933 | [1–225] |
| 11717 | [1–439] | 11765 | [1–196] | 11886 | [1–209] | 11934 | [1–125] |
| 11718 | [1–199] | 11766 | [1–118] | 11887 | [1–69] | 11935 | [1–314] |
| 11719 | [1–163] | 11767 | [1–111] | 11888 | [1–82] | 11936 | [1–225] |
| 11720 | [1–195] | 11768 | [1–448] | 11889 | [1–290] | 11937 | [1–226] |
| 11721 | [1–231] | 11769 | [1–283] | 11890 | [1–281] | 11938 | [1–201] |
| 11722 | [1–172] | 11770 | [1–340] | 11891 | [1–111] | 11939 | [1–303] |
| 11723 | [1–339] | 11771 | [1–173] | 11892 | [1–98] | 11940 | [1–198] |
| 11724 | [1–171] | 11772 | [1–200] | 11893 | [1–97] | 11941 | [1–343] |
| 11725 | [1–343] | 11773 | [1–200] | 11894 | [1–99] | 11942 | [1–143] |
| 11726 | [1–394] | 11774 | [1–257] | 11895 | [1–483] | 11943 | [1–292] |
| 11727 | [1–358] | 11775 | [1–174] | 11896 | [1–314] | 11944 | [1–82] |
| 11728 | [1–200] | 11776 | [1–296] | 11897 | [1–163] | 11945 | [1–173] |
| 11729 | [1–278] | 11777 | [1–170] | 11898 | [1–143] | 11946 | [1–200] |
| 11730 | [1–303] | 11778 | [1–200] | 11899 | [1–471] | 11947 | [1–343] |
| 11731 | [1–126] | 11779 | [1–207] | 11900 | [1–118] | 11948 | [1–113] |
| 11732 | [1–142] | 11780 | [1–214] | 11901 | [1–314] | 11949 | [1–82] |
| 11733 | [1–181] | 11781 | [1–110] | 11902 | [1–200] | 11950 | [1–137] |
| 11734 | [1–311] | 11782 | [1–226] | 11903 | [1–101] | 11951 | [1–301] |
| 11735 | [1–225] | 11783 | [1–126] | 11904 | [1–207] | 11952 | [1–136] |
| 11736 | [1–213] | 11784 | [1–222] | 11905 | [1–200] | 11953 | [1–108] |
| 11737 | [1–525] | 11785 | [1–200] | 11906 | [1–322] | 11954 | [1–165] |
| 11738 | [1–126] | 11786 | [1–162] | 11907 | [1–317] | 11955 | [1–119] |
| 11739 | [1–162] | 11787 | [1–254] | 11908 | [1–296] | 11956 | [1–479] |
| 11788 | [1–172] | 11835 | [1–200] | 11909 | [1–67] | 11957 | [1–152] |
| 11789 | [1–186] | 11836 | [1–377] | 11910 | [1–174] | 11958 | [1–78] |
| 11790 | [1–479] | 11837 | [1–303] | 11911 | [1–253] | 11959 | [1–273] |
| 11791 | [1–316] | 11838 | [1–156] | 11912 | [1–68] | 11960 | [1–200] |
| 11792 | [1–133] | 11839 | [1–181] | 11914 | [1–306] | 11961 | [1–235] |
| 11793 | [1–358] | 11840 | [1–213] | 11915 | [1–173] | 11962 | [1–118] |
| 11794 | [1–226] | 11841 | [1–82] | 11916 | [1–419] | 11963 | [1–173] |
| 11795 | [1–192] | 11842 | [1–120] | 11917 | [1–298] | 11964 | [1–108] |
| 11796 | [1–186] | 11843 | [1–507] | 11918 | [1–353] | 11965 | [1–200] |
| 11797 | [1–90] | 11844 | [1–200] | 11919 | [1–200] | 11966 | [1–174] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 11920 | [1–162] | 11967 | [1–61] | 12088 | [1–82] | 12135 | [1–52] |
| 11921 | [1–123] | 11968 | [1–312] | 12089 | [1–372] | 12136 | [1–200] |
| 11922 | [1–209] | 11969 | [1–314] | 12090 | [1–243] | 12137 | [1–82] |
| 11923 | [1–155] | 11970 | [1–57] | 12091 | [174–488] | 12138 | [1–321] |
| 11924 | [1–172] | 11971 | [1–312] | 12092 | [1–124] | 12139 | [1–56] |
| 11925 | [1–172] | 11972 | [1–110] | 12093 | [1–195] | 12140 | [1–104] |
| 11926 | [1–171] | 11973 | [1–316] | 12094 | [1–143] | 12141 | [1–200] |
| 11927 | [1–509] | 11974 | [1–78] | 12095 | [1–200] | 12142 | [1–420] |
| 11928 | [1–100] | 11975 | [1–89] | 12096 | [1–368] | 12143 | [1–136] |
| 11929 | [1–307] | 11976 | [1–314] | 12097 | [1–325] | 12144 | [1–108] |
| 11977 | [1–437] | 12024 | [1–316] | 12098 | [1–170] | 12145 | [1–458] |
| 11978 | [1–106] | 12025 | [1–110] | 12099 | [1–84] | 12146 | [1–459] |
| 11979 | [1–201] | 12026 | [1–326] | 12100 | [1–472] | 12147 | [1–373] |
| 11980 | [1–132] | 12027 | [1–142] | 12101 | [1–379] | 12148 | [1–171] |
| 11981 | [1–350] | 12028 | [1–126] | 12102 | [1–66] | 12149 | [1–289] |
| 11982 | [1–311] | 12029 | [1–219] | 12103 | [1–82] | 12150 | [1–57] |
| 11983 | [1–371] | 12030 | [1–294] | 12104 | [1–200] | 12151 | [1–173] |
| 11984 | [1–331] | 12031 | [1–355] | 12105 | [1–331] | 12152 | [1–207] |
| 11985 | [1–200] | 12032 | [1–335] | 12106 | [1–74] | 12153 | [1–284] |
| 11986 | [1–173] | 12033 | [1–315] | 12107 | [1–173] | 12154 | [1–225] |
| 11987 | [1–110] | 12034 | [209–484] | 12108 | [1–53] | 12155 | [1–162] |
| 11988 | [1–112] | 12035 | [1–187] | 12109 | [1–201] | 12156 | [1–200] |
| 11989 | [1–150],[273–311] | 12036 | [1–189] | 12110 | [1–251] | 12157 | [1–156] |
| 11990 | [1–108] | 12037 | [1–77] | 12111 | [1–115] | 12158 | [1–200] |
| 11991 | [1–79] | 12038 | [1–144] | 12112 | [1–478] | 12159 | [1–307] |
| 11992 | [1–358] | 12039 | [99–154] | 12113 | [1–304] | 12160 | [1–98] |
| 11993 | [1–118] | 12040 | [1–220] | 12114 | [1–244] | 12161 | [1–91] |
| 11994 | [1–265] | 12041 | [1–294] | 12115 | [1–301] | 12162 | [1–120] |
| 11995 | [1–102] | 12042 | [1–125] | 12116 | [1–112] | 12163 | [1–257] |
| 11996 | [1–163] | 12043 | [1–129] | 12117 | [1–200] | 12165 | [1–50] |
| 11997 | [1–121] | 12044 | [1–200] | 12166 | [1–477] | 12213 | [1–243] |
| 11998 | [1–330] | 12045 | [1–120] | 12167 | [1–118] | 12214 | [1–128] |
| 11999 | [1–291] | 12046 | [1–344] | 12168 | [1–383] | 12215 | [1–508] |
| 12000 | [1–226] | 12047 | [1–173] | 12169 | [1–312] | 12216 | [1–94] |
| 12001 | [1–99] | 12048 | [1–78] | 12170 | [1–371] | 12217 | [1–163] |
| 12002 | [1–200] | 12049 | [1–154] | 12171 | [1–172] | 12218 | [1–440] |
| 12003 | [1–250] | 12050 | [99–154] | 12172 | [1–175] | 12219 | [1–192] |
| 12004 | [1–314] | 12051 | [1–163] | 12173 | [1–125] | 12220 | [1–225] |
| 12005 | [1–68] | 12052 | [1–166] | 12174 | [1–127] | 12221 | [1–162] |
| 12006 | [1–69] | 12053 | [1–145] | 12175 | [1–83] | 12222 | [1–443] |
| 12007 | [1–103] | 12054 | [1–263] | 12176 | [1–371] | 12223 | [1–226] |
| 12008 | [1–303] | 12055 | [1–313] | 12177 | [1–520] | 12224 | [1–200] |
| 12009 | [1–321] | 12056 | [1–221] | 12178 | [1–323] | 12225 | [1–78] |
| 12010 | [1–173] | 12057 | [1–194] | 12179 | [1–163] | 12226 | [1–127] |
| 12011 | [1–170] | 12058 | [1–175] | 12180 | [1–58] | 12227 | [1–361] |
| 12012 | [1–200] | 12059 | [1–333] | 12181 | [1–159] | 12228 | [1–134] |
| 12013 | [1–181] | 12060 | [1–199] | 12182 | [1–160] | 12229 | [1–176] |
| 12014 | [1–200] | 12061 | [1–155] | 12183 | [1–317] | 12231 | [1–63] |
| 12015 | [1–82] | 12062 | [1–419] | 12184 | [1–336] | 12232 | [1–457] |
| 12016 | [1–433] | 12063 | [1–447] | 12185 | [1–111] | 12233 | [1–172] |
| 12017 | [1–306] | 12064 | [1–306] | 12186 | [1–304] | 12234 | [1–343] |
| 12018 | [1–326] | 12065 | [1–200] | 12187 | [1–157] | 12235 | [1–174] |
| 12019 | [1–180] | 12066 | [1–117] | 12188 | [1–304] | 12236 | [1–313] |
| 12020 | [1–516] | 12067 | [1–383] | 12189 | [1–161] | 12237 | [1–383] |
| 12021 | [1–293] | 12068 | [1–173] | 12190 | [1–301] | 12238 | [1–380] |
| 12022 | [1–161] | 12069 | [1–114] | 12191 | [1–383] | 12239 | [1–485] |
| 12023 | [1–200] | 12070 | [1–161] | 12192 | [1–372] | 12240 | [1–176] |
| 12071 | [1–452] | 12118 | [1–109] | 12193 | [33–211] | 12241 | [1–372] |
| 12072 | [1–301] | 12119 | [1–108] | 12194 | [1–114] | 12242 | [1–171] |
| 12073 | [1–174] | 12120 | [1–424] | 12195 | [1–83] | 12243 | [1–163] |
| 12074 | [1–164] | 12121 | [1–159] | 12196 | [1–129] | 12244 | [1–485] |
| 12075 | [1–163] | 12122 | [1–324] | 12197 | [171–387] | 12245 | [1–155] |
| 12076 | [1–170] | 12123 | [186–254] | 12198 | [1–81] | 12246 | [1–211] |
| 12077 | [1–240] | 12124 | [1–324] | 12199 | [1–173] | 12247 | [1–353] |
| 12078 | [1–225] | 12125 | [1–153] | 12200 | [1–363] | 12248 | [1–314] |
| 12079 | [1–106] | 12126 | [1–337] | 12201 | [1–200] | 12249 | [1–225] |
| 12080 | [1–111] | 12127 | [1–82] | 12202 | [1–294] | 12250 | [1–173] |
| 12081 | [1–317] | 12128 | [1–200] | 12203 | [1–360] | 12251 | [1–104] |
| 12082 | [1–490] | 12129 | [1–164] | 12204 | [1–118] | 12252 | [1–247] |
| 12083 | [1–115] | 12130 | [1–77] | 12205 | [1–172] | 12253 | [1–173] |
| 12084 | [1–327] | 12131 | [1–82] | 12206 | [1–236] | 12254 | [1–162] |
| 12085 | [1–221] | 12132 | [1–200] | 12207 | [1–311] | 12255 | [1–327] |
| 12086 | [1–37],[70–242] | 12133 | [1–113] | 12208 | [1–312] | 12256 | [1–190] |
| 12087 | [1–83] | 12134 | [1–51] | 12209 | [1–439] | 12257 | [1–200] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 12210 | [1–163] | 12258 | [1–200] | 12381 | [1–200] | 12428 | [1–314] |
| 12211 | [1–209] | 12259 | [1–225] | 12382 | [1–162] | 12429 | [1–83] |
| 12212 | [1–155] | 12260 | [1–170] | 12383 | [1–175] | 12430 | [1–97] |
| 12261 | [1–93] | 12309 | [1–92] | 12384 | [1–243] | 12431 | [1–158] |
| 12262 | [1–116] | 12310 | [1–296] | 12385 | [1–343] | 12432 | [1–125] |
| 12263 | [1–112] | 12311 | [1–149] | 12386 | [1–433] | 12433 | [1–367] |
| 12264 | [1–159] | 12312 | [1–401] | 12387 | [1–354] | 12434 | [1–82] |
| 12266 | [1–77] | 12313 | [1–235] | 12388 | [1–162] | 12435 | [1–346] |
| 12267 | [1–438] | 12314 | [1–444] | 12389 | [1–111] | 12436 | [1–70] |
| 12268 | [1–365] | 12315 | [1–135] | 12390 | [1–72] | 12437 | [1–507] |
| 12269 | [1–302] | 12316 | [1–372] | 12391 | [1–170] | 12438 | [1–158] |
| 12270 | [1–175] | 12317 | [1–400] | 12392 | [1–101] | 12439 | [1–294] |
| 12271 | [1–124] | 12318 | [1–475] | 12393 | [1–302] | 12440 | [1–70] |
| 12272 | [1–175] | 12319 | [1–337] | 12394 | [1–253] | 12441 | [1–94] |
| 12273 | [1–99] | 12320 | [1–225] | 12395 | [1–123] | 12442 | [1–374] |
| 12274 | [1–187] | 12322 | [1–82] | 12396 | [1–200] | 12443 | [1–280] |
| 12275 | [1–367] | 12323 | [1–200] | 12397 | [1–111] | 12444 | [1–143] |
| 12276 | [1–78] | 12324 | [1–310] | 12398 | [1–78] | 12445 | [1–187] |
| 12277 | [1–98] | 12325 | [1–117] | 12399 | [1–369] | 12446 | [1–76] |
| 12278 | [1–219] | 12326 | [1–289] | 12400 | [1–153] | 12447 | [1–331] |
| 12279 | [1–360] | 12327 | [1–128] | 12401 | [1–148] | 12448 | [1–107] |
| 12280 | [1–341] | 12328 | [1–141] | 12402 | [1–174] | 12449 | [1–173] |
| 12281 | [1–174] | 12329 | [1–314] | 12403 | [1–108] | 12450 | [1–83] |
| 12282 | [1–225] | 12330 | [1–123] | 12451 | [1–200] | 12500 | [1–127] |
| 12283 | [1–372] | 12331 | [1–174] | 12453 | [1–154] | 12501 | [1–129] |
| 12284 | [1–370] | 12332 | [1–53] | 12454 | [1–69] | 12502 | [1–510] |
| 12285 | [1–165] | 12333 | [1–302] | 12455 | [1–99] | 12503 | [1–276] |
| 12286 | [1–200] | 12334 | [1–163] | 12456 | [1–408] | 12504 | [50–470] |
| 12287 | [1–488] | 12335 | [1–162] | 12457 | [1–455] | 12505 | [1–462] |
| 12288 | [1–310] | 12336 | [1–173] | 12459 | [1–369] | 12506 | [1–134] |
| 12289 | [1–209] | 12337 | [1–142] | 12460 | [1–432] | 12507 | [1–419] |
| 12290 | [1–351] | 12338 | [1–155] | 12461 | [1–422] | 12508 | [1–455] |
| 12291 | [1–124] | 12339 | [1–366] | 12462 | [1–325] | 12509 | [1–445] |
| 12292 | [1–255] | 12340 | [1–314] | 12463 | [52–372] | 12510 | [1–458] |
| 12293 | [1–485] | 12341 | [1–80] | 12464 | [1–70] | 12511 | [1–238] |
| 12294 | [1–174] | 12342 | [1–360] | 12465 | [81–138],[190–287] | 12512 | [1–442] |
| 12295 | [1–300] | 12343 | [1–225] | 12466 | [1–418] | 12514 | [1–233] |
| 12296 | [1–339] | 12344 | [1–187] | 12467 | [1–34],[121–440] | 12515 | [1–406] |
| 12297 | [1–243] | 12345 | [1–173] | 12468 | [1–325] | 12516 | [1–75] |
| 12298 | [1–67] | 12346 | [1–147] | 12469 | [1–414] | 12517 | [53–399] |
| 12299 | [1–78] | 12347 | [1–354] | 12470 | [1–485] | 12518 | [53–118] |
| 12300 | [1–170] | 12348 | [1–108] | 12471 | [1–94] | 12519 | [32–495] |
| 12301 | [1–200] | 12349 | [1–225] | 12472 | [1–485] | 12520 | [1–240] |
| 12302 | [1–174] | 12350 | [1–224] | 12473 | [1–450] | 12521 | [1–527] |
| 12303 | [1–309] | 12351 | [1–307] | 12474 | [1–217] | 12522 | [1–531] |
| 12304 | [1–74] | 12352 | [1–144] | 12475 | [1–335] | 12523 | [1–450] |
| 12305 | [1–246] | 12353 | [1–200] | 12476 | [1–478] | 12524 | [1–104] |
| 12306 | [1–489] | 12354 | [1–132] | 12477 | [1–473] | 12525 | [1–448] |
| 12307 | [1–215] | 12355 | [1–318] | 12478 | [1–460] | 12526 | [1–415] |
| 12308 | [1–162] | 12356 | [1–212],[254–373] | 12479 | [1–437] | 12527 | [1–312] |
| 12357 | [1–200] | 12404 | [1–66] | 12480 | [1–60] | 12528 | [1–472] |
| 12358 | [1–173] | 12405 | [1–311] | 12481 | [1–459] | 12529 | [1–483] |
| 12359 | [1–173] | 12406 | [1–156] | 12482 | [1–438] | 12530 | [1–53] |
| 12360 | [1–200] | 12407 | [1–158] | 12483 | [1–486] | 12531 | [1–302] |
| 12361 | [1–344] | 12408 | [1–293] | 12484 | [1–489] | 12532 | [1–465] |
| 12362 | [1–213] | 12409 | [1–197] | 12485 | [1–483] | 12533 | [1–445] |
| 12363 | [1–96] | 12410 | [1–200] | 12486 | [1–385] | 12534 | [1–106] |
| 12364 | [1–143] | 12411 | [1–200] | 12487 | [1–196] | 12535 | [1–440] |
| 12365 | [1–444] | 12412 | [1–486] | 12488 | [32–509] | 12536 | [1–193] |
| 12366 | [1–371] | 12413 | [1–277] | 12489 | [1–380] | 12537 | [1–347] |
| 12367 | [1–89] | 12414 | [1–163] | 12490 | [1–299] | 12538 | [1–421] |
| 12368 | [1–82] | 12415 | [1–173] | 12491 | [1–393] | 12539 | [1–103] |
| 12369 | [1–108] | 12416 | [1–162] | 12492 | [1–469] | 12540 | [1–477] |
| 12370 | [1–173] | 12417 | [1–109] | 12493 | [1–436] | 12541 | [1–473] |
| 12371 | [1–105] | 12418 | [1–312] | 12494 | [1–458] | 12542 | [1–266] |
| 12372 | [1–202] | 12419 | [1–173] | 12495 | [1–230] | 12543 | [1–315] |
| 12373 | [1–313] | 12420 | [1–355] | 12496 | [1–494] | 12544 | [1–476] |
| 12374 | [1–130] | 12421 | [1–163] | 12497 | [1–468] | 12545 | [1–443] |
| 12375 | [1–449] | 12422 | [1–140] | 12498 | [1–454] | 12546 | [1–488] |
| 12376 | [1–375] | 12423 | [1–327] | 12499 | [1–146] | 12547 | [1–146] |
| 12377 | [1–55] | 12424 | [1–173] | 12548 | [49–104] | 12596 | [46–102] |
| 12378 | [1–134] | 12425 | [1–306] | 12549 | [1–194] | 12597 | [1–370] |
| 12379 | [1–137] | 12426 | [1–225] | 12550 | [1–414] | 12598 | [1–461] |
| 12380 | [1–305] | 12427 | [1–129] | 12551 | [1–163] | 12599 | [1–54] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 12552 | [1–450] | 12600 | [1–169] | 12676 | [1–298] | 12726 | [1–322] |
| 12553 | [1–419] | 12601 | [1–243] | 12677 | [1–429] | 12727 | [1–261] |
| 12554 | [1–307] | 12602 | [1–397] | 12678 | [251–326],[367–397] | 12728 | [1–138] |
| 12555 | [1–468] | 12603 | [1–478] | 12679 | [1–328] | 12729 | [1–243] |
| 12556 | [1–425] | 12604 | [1–436] | 12680 | [1–318] | 12730 | [1–413] |
| 12557 | [1–395] | 12605 | [1–377] | 12681 | [1–88] | 12731 | [1–393] |
| 12558 | [1–146],[266–493] | 12606 | [1–458] | 12682 | [1–83] | 12733 | [1–387] |
| 12559 | [1–471] | 12607 | [1–90] | 12683 | [1–460] | 12734 | [1–173] |
| 12560 | [1–234] | 12608 | [1–64] | 12684 | [1–177] | 12735 | [71–416] |
| 12561 | [1–479] | 12609 | [55–106],[203–255] | 12685 | [1–361] | 12736 | [1–45],[219–348] |
| 12562 | [1–428] | 12610 | [1–521] | 12687 | [1–145] | 12737 | [1–494] |
| 12564 | [1–458] | 12611 | [34–347] | 12688 | [1–468] | 12738 | [1–56] |
| 12565 | [1–335] | 12612 | [1–200] | 12689 | [1–281] | 12740 | [1–257] |
| 12566 | [1–77] | 12613 | [1–409] | 12690 | [1–453] | 12741 | [1–310] |
| 12567 | [1–422] | 12614 | [1–376] | 12691 | [1–460] | 12743 | [1–155] |
| 12568 | [1–373] | 12615 | [1–397] | 12692 | [1–61] | 12744 | [1–290] |
| 12569 | [1–392] | 12616 | [1–506] | 12746 | [1–443] | 12796 | [1–479] |
| 12570 | [53–393] | 12617 | [1–458] | 12749 | [1–434] | 12797 | [1–288] |
| 12571 | [1–90],[121–314] | 12618 | [1–544] | 12750 | [1–274] | 12798 | [1–392] |
| 12572 | [1–477] | 12619 | [1–463] | 12751 | [73–397] | 12799 | [1–253] |
| 12573 | [1–134] | 12620 | [1–325] | 12752 | [1–432] | 12800 | [1–445] |
| 12574 | [1–428] | 12621 | [1–70] | 12753 | [1–187] | 12801 | [32–339] |
| 12575 | [1–70] | 12622 | [1–97] | 12754 | [1–224] | 12802 | [1–438] |
| 12576 | [1–304] | 12623 | [1–274] | 12755 | [1–412] | 12803 | [1–249],[281–396] |
| 12577 | [1–318] | 12624 | [1–466] | 12756 | [1–343] | 12804 | [1–263] |
| 12578 | [1–59] | 12625 | [1–109],[142–438] | 12757 | [1–480] | 12805 | [1–140] |
| 12579 | [1–432] | 12626 | [1–147] | 12758 | [1–409] | 12806 | [1–185] |
| 12580 | [1–444] | 12627 | [1–272] | 12759 | [1–329] | 12807 | [1–442] |
| 12581 | [1–409] | 12628 | [1–412] | 12760 | [1–376] | 12808 | [1–338] |
| 12582 | [1–224],[311–444] | 12629 | [1–409] | 12761 | [1–308] | 12809 | [1–236] |
| 12583 | [1–467] | 12630 | [1–456] | 12762 | [1–199] | 12810 | [1–455] |
| 12584 | [1–423] | 12631 | [1–297] | 12763 | [1–411] | 12811 | [1–97] |
| 12585 | [1–423] | 12632 | [1–263] | 12764 | [1–192] | 12812 | [1–180] |
| 12586 | [1–328] | 12633 | [1–421] | 12765 | [1–141] | 12813 | [1–308] |
| 12587 | [1–393] | 12634 | [1–146] | 12766 | [236–480] | 12814 | [1–226] |
| 12588 | [1–95] | 12635 | [1–553] | 12767 | [1–85] | 12815 | [1–345] |
| 12589 | [1–76] | 12636 | [1–426] | 12768 | [1–130] | 12816 | [1–500] |
| 12590 | [1–440] | 12638 | [1–449] | 12769 | [1–393] | 12817 | [1–115] |
| 12591 | [1–222] | 12639 | [1–432] | 12770 | [1–393] | 12818 | [1–122] |
| 12592 | [1–156] | 12640 | [1–67] | 12771 | [1–389] | 12819 | [1–67] |
| 12593 | [1–473] | 12641 | [105–402] | 12772 | [1–227] | 12820 | [1–435] |
| 12594 | [1–412] | 12642 | [1–291] | 12773 | [1–362] | 12821 | [1–472] |
| 12595 | [1–398] | 12643 | [1–488] | 12774 | [1–100] | 12822 | [1–169] |
| 12644 | [1–344] | 12693 | [1–193] | 12775 | [1–242] | 12823 | [1–530] |
| 12645 | [1–316] | 12694 | [1–447] | 12776 | [1–424] | 12824 | [1–101] |
| 12646 | [1–139] | 12695 | [1–315] | 12777 | [1–458] | 12825 | [1–154] |
| 12647 | [1–122] | 12696 | [1–108] | 12778 | [1–64] | 12826 | [64–373] |
| 12648 | [1–331] | 12697 | [1–398] | 12779 | [1–43],[76–271] | 12827 | [1–58] |
| 12649 | [1–424] | 12698 | [1–267] | 12781 | [1–174] | 12828 | [1–505] |
| 12650 | [1–395] | 12699 | [1–318] | 12782 | [1–340] | 12829 | [1–116] |
| 12651 | [1–344] | 12700 | [1–385] | 12783 | [1–320] | 12830 | [1–111] |
| 12652 | [1–60] | 12701 | [1–50] | 12784 | [1–351] | 12831 | [1–398] |
| 12653 | [1–347] | 12702 | [1–286] | 12785 | [1–74] | 12832 | [1–475] |
| 12654 | [1–324] | 12703 | [124–315] | 12786 | [1–458] | 12833 | [1–67] |
| 12655 | [1–422] | 12704 | [1–219] | 12787 | [1–274] | 12834 | [1–429] |
| 12656 | [1–152] | 12705 | [1–63] | 12788 | [1–405] | 12835 | [1–552] |
| 12657 | [1–54] | 12706 | [1–184] | 12789 | [1–118] | 12836 | [1–358] |
| 12658 | [1–145] | 12707 | [1–199] | 12790 | [1–473] | 12837 | [1–363] |
| 12659 | [1–321] | 12708 | [1–299] | 12791 | [1–185] | 12838 | [1–421] |
| 12660 | [1–240] | 12710 | [1–81] | 12792 | [1–369] | 12839 | [1–267] |
| 12661 | [1–292] | 12711 | [1–293] | 12793 | [1–152] | 12840 | [1–454] |
| 12662 | [1–177] | 12712 | [1–372] | 12794 | [1–335] | 12841 | [1–316] |
| 12663 | [1–87] | 12713 | [1–208] | 12795 | [1–236] | 12842 | [1–434] |
| 12664 | [1–424] | 12714 | [97–264] | 12843 | [1–515] | 12891 | [1–454] |
| 12665 | [1–396] | 12715 | [1–120] | 12845 | [1–327] | 12892 | [1–130] |
| 12667 | [1–380] | 12716 | [1–479] | 12846 | [1–442] | 12893 | [1–184] |
| 12668 | [1–182] | 12717 | [1–169] | 12847 | [1–285] | 12894 | [1–289] |
| 12669 | [1–490] | 12718 | [1–328] | 12848 | [1–451] | 12895 | [1–335] |
| 12670 | [1–526] | 12719 | [1–333] | 12849 | [1–441] | 12896 | [1–323] |
| 12671 | [1–120] | 12720 | [1–291] | 12850 | [1–415] | 12897 | [1–397] |
| 12672 | [1–459] | 12722 | [1–329] | 12851 | [1–497] | 12898 | [1–440] |
| 12673 | [1–505] | 12723 | [1–400] | 12852 | [1–397] | 12899 | [1–345] |
| 12674 | [1–292] | 12724 | [1–224],[311–499] | 12853 | [1–476] | 12900 | [1–459] |
| 12675 | [1–444] | 12725 | [1–263] | 12854 | [1–513] | 12901 | [1–352] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 12855 | [1–115] | 12902 | [1–318] | 12976 | [1–471] | 13024 | [1–304] |
| 12856 | [1–97] | 12903 | [1–124] | 12977 | [1–161] | 13025 | [311–435] |
| 12857 | [1–267] | 12904 | [1–468] | 12978 | [1–397] | 13026 | [1–268] |
| 12858 | [1–144],[191–397] | 12905 | [1–479] | 12979 | [1–361] | 13027 | [1–484] |
| 12859 | [1–313] | 12906 | [99–288] | 12980 | [1–404] | 13028 | [91–498] |
| 12860 | [1–492] | 12907 | [1–357] | 12981 | [1–450] | 13029 | [1–386] |
| 12861 | [1–326] | 12908 | [1–380] | 12982 | [1–309] | 13030 | [1–445] |
| 12862 | [1–303] | 12909 | [1–300] | 12983 | [1–356] | 13031 | [1–433] |
| 12863 | [1–536] | 12910 | [1–476] | 12984 | [1–351] | 13032 | [1–64] |
| 12864 | [1–238] | 12911 | [1–431] | 13033 | [1–336] | 13082 | [1–320] |
| 12865 | [1–475] | 12912 | [1–257] | 13034 | [1–524] | 13083 | [1–400] |
| 12866 | [1–356] | 12913 | [1–271] | 13035 | [1–330] | 13084 | [1–59] |
| 12867 | [1–208] | 12914 | [1–283] | 13036 | [1–315] | 13085 | [1–458] |
| 12868 | [1–319] | 12915 | [1–297] | 13037 | [1–483] | 13086 | [1–207] |
| 12869 | [1–443] | 12916 | [1–307] | 13038 | [1–462] | 13087 | [1–461] |
| 12870 | [1–118] | 12917 | [44–203] | 13039 | [1–456] | 13088 | [1–416] |
| 12871 | [1–320] | 12918 | [1–61] | 13040 | [1–468] | 13089 | [1–319] |
| 12872 | [31–440] | 12919 | [1–274] | 13041 | [1–442] | 13090 | [1–266] |
| 12873 | [1–359] | 12920 | [1–80],[120–209] | 13042 | [327–486] | 13091 | [1–311] |
| 12874 | [1–400] | 12921 | [1–338] | 13043 | [1–127] | 13092 | [1–426] |
| 12875 | [1–443] | 12922 | [1–68] | 13044 | [1–306] | 13093 | [1–219] |
| 12876 | [1–129] | 12923 | [1–184] | 13045 | [1–413] | 13094 | [1–320] |
| 12877 | [1–484] | 12924 | [1–502] | 13046 | [1–309] | 13095 | [1–97] |
| 12878 | [1–357] | 12925 | [148–421] | 13047 | [1–109] | 13096 | [1–179] |
| 12879 | [1–611] | 12926 | [1–491] | 13048 | [1–152] | 13097 | [1–289] |
| 12880 | [1–425] | 12927 | [1–414] | 13049 | [1–59],[141–396] | 13098 | [1–360],[459–496] |
| 12881 | [1–106] | 12928 | [1–259] | 13050 | [1–438] | 13100 | [1–346] |
| 12882 | [1–473] | 12929 | [1–222] | 13051 | [1–179] | 13101 | [1–503] |
| 12883 | [1–397] | 12930 | [1–71] | 13052 | [1–425] | 13102 | [1–272] |
| 12884 | [1–496] | 12931 | [1–53] | 13053 | [1–204] | 13103 | [1–282] |
| 12885 | [1–101] | 12932 | [1–339] | 13054 | [1–381] | 13104 | [1–302] |
| 12886 | [1–439] | 12933 | [1–493] | 13055 | [1–178] | 13105 | [1–370] |
| 12887 | [1–307] | 12934 | [1–276] | 13056 | [1–542] | 13106 | [1–69] |
| 12888 | [1–297] | 12935 | [1–135] | 13057 | [1–198],[295–448] | 13107 | [1–272] |
| 12889 | [1–68] | 12936 | [1–350] | 13058 | [1–219] | 13108 | [1–319] |
| 12890 | [1–211] | 12937 | [1–109],[188–256] | 13059 | [1–192] | 13109 | [1–235] |
| 12938 | [1–340] | 12985 | [1–465] | 13060 | [1–294] | 13110 | [1–375] |
| 12939 | [1–62] | 12986 | [1–188] | 13061 | [1–430] | 13111 | [1–325] |
| 12940 | [1–372] | 12987 | [1–439] | 13062 | [1–341] | 13112 | [1–298] |
| 12941 | [1–330] | 12988 | [46–103] | 13063 | [1–381] | 13113 | [1–179] |
| 12942 | [1–413] | 12989 | [1–294] | 13064 | [1–442] | 13114 | [1–219] |
| 12943 | [1–417] | 12990 | [1–299] | 13065 | [1–295] | 13115 | [1–499] |
| 12944 | [1–514] | 12991 | [1–440] | 13066 | [1–492] | 13116 | [1–317] |
| 12945 | [1–482] | 12992 | [1–307] | 13067 | [1–500] | 13117 | [1–461] |
| 12946 | [1–324] | 12993 | [1–348] | 13068 | [1–353] | 13118 | [1–295] |
| 12947 | [1–399] | 12994 | [1–324] | 13069 | [1–53] | 13119 | [1–507] |
| 12948 | [36–281] | 12995 | [1–441] | 13070 | [1–292] | 13120 | [1–258] |
| 12949 | [217–365] | 12996 | [1–354] | 13071 | [1–434] | 13121 | [1–357] |
| 12950 | [1–513] | 12997 | [1–155] | 13072 | [1–361] | 13122 | [1–125] |
| 12951 | [1–308] | 12998 | [99–156] | 13073 | [1–469] | 13123 | [1–82] |
| 12952 | [1–82] | 12999 | [1–419] | 13074 | [1–295] | 13124 | [1–298] |
| 12953 | [1–315] | 13000 | [1–359] | 13076 | [1–390] | 13125 | [1–85] |
| 12954 | [1–509] | 13001 | [1–325] | 13077 | [1–82] | 13126 | [1–185] |
| 12955 | [1–175] | 13002 | [1–293] | 13078 | [1–506] | 13127 | [1–327] |
| 12956 | [1–473] | 13003 | [1–119] | 13079 | [1–72] | 13128 | [1–322] |
| 12957 | [1–452] | 13004 | [1–471] | 13080 | [1–438] | 13129 | [1–319] |
| 12958 | [1–324] | 13005 | [1–291] | 13130 | [1–473] | 13179 | [1–493] |
| 12959 | [1–311] | 13006 | [1–99] | 13132 | [1–204] | 13180 | [1–230],[270–667] |
| 12960 | [1–372] | 13007 | [1–94] | 13133 | [1–389] | 13181 | [1–197] |
| 12961 | [1–458] | 13008 | [1–346] | 13134 | [1–256] | 13182 | [1–457] |
| 12962 | [1–494] | 13009 | [1–329] | 13135 | [1–444] | 13184 | [1–325] |
| 12963 | [1–184],[228–287] | 13010 | [1–498] | 13136 | [1–518] | 13185 | [196–385] |
| 12964 | [1–366] | 13011 | [1–91] | 13137 | [1–316] | 13186 | [1–454] |
| 12965 | [1–288] | 13012 | [1–364] | 13138 | [1–441] | 13187 | [1–197] |
| 12966 | [1–376],[460–509] | 13013 | [1–284] | 13140 | [1–280] | 13188 | [1–317] |
| 12967 | [1–497] | 13014 | [1–309] | 13141 | [1–394] | 13190 | [1–346] |
| 12968 | [1–540] | 13015 | [1–443] | 13142 | [1–395] | 13191 | [1–455] |
| 12969 | [1–313] | 13016 | [1–508] | 13143 | [1–328] | 13192 | [1–486] |
| 12970 | [1–345] | 13017 | [1–420] | 13144 | [1–81] | 13193 | [1–66] |
| 12971 | [1–486] | 13018 | [1–487] | 13145 | [1–280] | 13194 | [1–160] |
| 12972 | [1–188] | 13019 | [1–347] | 13146 | [1–376] | 13195 | [1–372] |
| 12973 | [1–254] | 13020 | [1–435] | 13147 | [1–307] | 13196 | [1–185] |
| 12974 | [1–526] | 13022 | [1–311] | 13148 | [1–263] | 13197 | [91–498] |
| 12975 | [1–477] | 13023 | [94–528] | 13149 | [1–131] | 13198 | [1–479] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 13150 | [1–630] | 13199 | [1–227] | 13275 | [1–419] | 13323 | [1–85] |
| 13151 | [1–474] | 13200 | [1–420] | 13276 | [1–432] | 13324 | [1–467] |
| 13152 | [1–81] | 13201 | [1–73] | 13325 | [1–380] | 13374 | [1–279] |
| 13153 | [1–457] | 13202 | [1–339] | 13326 | [1–432] | 13375 | [1–159],[208–349] |
| 13154 | [1–402] | 13203 | [1–230] | 13327 | [1–298] | 13377 | [284–434] |
| 13155 | [1–440] | 13204 | [1–92],[233–297] | 13328 | [1–159] | 13378 | [1–303] |
| 13156 | [1–384] | 13205 | [1–374] | 13329 | [1–129] | 13379 | [1–208],[264–437] |
| 13157 | [1–297] | 13206 | [1–431] | 13330 | [1–160] | 13380 | [82–287] |
| 13158 | [1–378] | 13207 | [1–450] | 13331 | [1–485] | 13381 | [1–137],[171–416] |
| 13159 | [1–262] | 13208 | [1–404] | 13332 | [1–111] | 13382 | [1–228],[328–460] |
| 13160 | [1–428] | 13209 | [59–105],[237–490] | 13333 | [1–187] | 13383 | [1–409] |
| 13161 | [1–326] | 13210 | [1–171] | 13334 | [1–176] | 13384 | [66–134],[183–337] |
| 13162 | [1–432] | 13211 | [32–76] | 13335 | [42–481] | 13385 | [1–335] |
| 13163 | [1–459] | 13212 | [1–447] | 13336 | [1–500] | 13386 | [1–453] |
| 13164 | [1–148],[301–438] | 13213 | [1–454] | 13337 | [1–422] | 13387 | [1–473] |
| 13165 | [1–445] | 13214 | [1–349] | 13338 | [1–446] | 13388 | [1–469] |
| 13166 | [1–461] | 13215 | [1–59] | 13339 | [1–130] | 13389 | [1–83] |
| 13167 | [1–85] | 13217 | [1–433] | 13340 | [1–348] | 13390 | [1–378] |
| 13168 | [1–495] | 13218 | [1–469] | 13341 | [1–200] | 13391 | [1–390] |
| 13169 | [1–340] | 13219 | [1–128] | 13342 | [1–290] | 13392 | [93–160] |
| 13170 | [1–198] | 13220 | [1–351] | 13343 | [1–195] | 13393 | [1–172] |
| 13171 | [1–113] | 13221 | [1–459] | 13344 | [1–87] | 13394 | [1–461] |
| 13172 | [1–382] | 13222 | [1–477] | 13345 | [1–376] | 13395 | [1–85] |
| 13173 | [1–407] | 13223 | [1–56] | 13346 | [1–476] | 13396 | [1–117] |
| 13174 | [1–407] | 13224 | [1–318] | 13347 | [1–429] | 13397 | [1–469] |
| 13175 | [1–470] | 13225 | [1–499] | 13348 | [1–179] | 13398 | [1–134],[183–326] |
| 13176 | [1–438] | 13226 | [1–478] | 13349 | [1–339] | 13399 | [1–280] |
| 13177 | [1–421] | 13227 | [1–86] | 13350 | [1–300] | 13400 | [1–269] |
| 13178 | [1–431] | 13228 | [1–419] | 13351 | [1–439] | 13401 | [1–225] |
| 13229 | [1–446] | 13277 | [1–466] | 13352 | [1–267] | 13402 | [1–446] |
| 13230 | [1–517] | 13278 | [1–351] | 13353 | [1–339] | 13403 | [1–421] |
| 13231 | [1–444] | 13279 | [1–465] | 13354 | [1–156] | 13404 | [1–263] |
| 13232 | [1–443] | 13280 | [1–434] | 13355 | [1–377] | 13406 | [1–202],[287–481] |
| 13233 | [1–455] | 13281 | [66–202] | 13356 | [1–342] | 13407 | [93–160],[209–357] |
| 13234 | [1–444] | 13283 | [1–341] | 13357 | [1–352] | 13408 | [1–26] |
| 13235 | [1–446] | 13284 | [1–442] | 13358 | [1–171] | 13409 | [1–366] |
| 13236 | [1–454] | 13285 | [1–441] | 13359 | [66–134],[183–293] | 13410 | [1–438] |
| 13237 | [1–452] | 13286 | [264–303] | 13360 | [464–513] | 13411 | [1–267] |
| 13238 | [1–473] | 13287 | [1–305] | 13361 | [155–345] | 13412 | [93–161],[209–366] |
| 13239 | [1–433] | 13288 | [1–455] | 13362 | [1–291] | 13413 | [1–419] |
| 13240 | [1–414] | 13289 | [1–455] | 13363 | [1–130],[174–212],[278–342] | 13414 | [1–358] |
| 13241 | [1–437] | 13290 | [1–487] | 13364 | [1–225] | 13415 | [1–268] |
| 13242 | [1–432] | 13291 | [1–269] | 13367 | [66–134],[183–342] | 13416 | [1–68] |
| 13243 | [1–89] | 13292 | [1–313] | 13368 | [1–438] | 13417 | [1–313] |
| 13244 | [47–387] | 13293 | [1–200] | 13369 | [1–79] | 13418 | [147–187] |
| 13245 | [1–467] | 13294 | [94–257] | 13370 | [1–335] | 13419 | [1–311] |
| 13246 | [376–459] | 13295 | [1–171] | 13371 | [1–294] | 13420 | [93–160],[209–351] |
| 13247 | [1–109] | 13296 | [1–269] | 13372 | [1–229] | 13421 | [1–457] |
| 13248 | [1–457] | 13297 | [1–192] | 13373 | [1–267] | 13422 | [1–466] |
| 13249 | [1–316],[347–485] | 13298 | [1–474] | 13423 | [1–440] | 13471 | [1–426] |
| 13250 | [1–445] | 13299 | [1–87] | 13424 | [1–447] | 13472 | [1–461] |
| 13251 | [1–174] | 13300 | [1–75] | 13425 | [248–369] | 13473 | [1–464] |
| 13252 | [1–167],[213–469] | 13301 | [1–449] | 13426 | [1–99] | 13474 | [111–350] |
| 13253 | [1–450] | 13302 | [1–300] | 13427 | [1–480] | 13475 | [1–342] |
| 13254 | [1–488] | 13303 | [1–338] | 13428 | [1–159] | 13476 | [1–126],[162–362] |
| 13255 | [39–257] | 13304 | [1–423] | 13429 | [1–169] | 13478 | [1–447] |
| 13256 | [91–479] | 13305 | [1–250] | 13430 | [1–459] | 13479 | [1–202] |
| 13257 | [1–464] | 13306 | [1–200] | 13431 | [1–304] | 13480 | [1–63] |
| 13258 | [1–469] | 13307 | [1–461] | 13432 | [1–415] | 13481 | [1–495] |
| 13259 | [1–28],[90–184] | 13308 | [1–304] | 13433 | [155–219],[256–426] | 13482 | [1–466] |
| 13260 | [1–475] | 13309 | [1–140] | 13434 | [1–372] | 13483 | [1–295] |
| 13261 | [1–289] | 13310 | [1–236] | 13435 | [57–141] | 13484 | [1–374] |
| 13262 | [132–175] | 13311 | [1–325] | 13436 | [1–313] | 13485 | [1–478] |
| 13264 | [1–94] | 13312 | [1–415] | 13438 | [1–464] | 13486 | [1–370] |
| 13265 | [1–467] | 13313 | [1–370] | 13439 | [1–464] | 13487 | [1–170] |
| 13266 | [1–197] | 13314 | [1–50] | 13440 | [1–147] | 13488 | [1–200] |
| 13267 | [1–36],[124–173] | 13315 | [1–386] | 13441 | [53–293] | 13490 | [1–200] |
| 13268 | [1–30],[79–171] | 13316 | [1–208] | 13442 | [1–511] | 13491 | [36–214],[245–482] |
| 13269 | [1–404] | 13317 | [1–142] | 13443 | [93–160] | 13492 | [1–66] |
| 13270 | [1–215] | 13318 | [1–314] | 13444 | [1–120] | 13494 | [1–313] |
| 13271 | [1–367] | 13319 | [1–355] | 13445 | [1–441] | 13495 | [1–254] |
| 13272 | [1–465] | 13320 | [1–319] | 13446 | [1–300] | 13496 | [1–150],[247–312] |
| 13273 | [1–199] | 13321 | [1–382] | 13447 | [1–388] | 13497 | [1–72] |
| 13274 | [1–322] | 13322 | [1–375] | | | | |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 13448 | [1–54] | 13498 | [1–50] | 13623 | [1–221],[302–460] | 13675 | [1–479] |
| 13449 | [1–269] | 13499 | [1–82] | 13624 | [1–386] | 13676 | [1–70] |
| 13450 | [1–403] | 13500 | [1–200] | 13625 | [1–476] | 13677 | [147–468] |
| 13451 | [1–303] | 13501 | [1–354] | 13628 | [1–115] | 13678 | [1–467] |
| 13452 | [1–181],[285–328] | 13502 | [1–329] | 13629 | [1–514] | 13679 | [1–192] |
| 13453 | [1–99],[218–465] | 13503 | [1–321] | 13630 | [1–232] | 13680 | [1–355] |
| 13454 | [1–441] | 13504 | [1–201] | 13631 | [1–471] | 13681 | [1–463] |
| 13455 | [1–429] | 13505 | [1–481] | 13632 | [1–105],[166–507] | 13682 | [1–424] |
| 13456 | [1–191] | 13508 | [1–330] | 13633 | [1–466] | 13683 | [1–454] |
| 13457 | [1–91] | 13509 | [1–336] | 13634 | [1–513] | 13684 | [1–297],[344–505] |
| 13458 | [1–81] | 13510 | [1–383] | 13635 | [1–169],[230–321] | 13685 | [143–173] |
| 13459 | [1–90],[158–205],[252–341] | 13511 | [1–112] | 13636 | [151–257] | 13686 | [1–376] |
| 13460 | [271–312] | 13512 | [1–293] | 13637 | [1–504] | 13687 | [1–103],[211–469] |
| 13461 | [1–56] | 13513 | [1–495] | 13638 | [1–465] | 13688 | [1–291] |
| 13462 | [1–267] | 13514 | [1–483] | 13640 | [1–443] | 13689 | [1–402] |
| 13463 | [1–370] | 13515 | [1–337] | 13641 | [1–385] | 13690 | [1–510] |
| 13464 | [1–91] | 13516 | [1–267] | 13643 | [1–328] | 13691 | [1–492] |
| 13465 | [1–263] | 13517 | [1–207] | 13644 | [1–362] | 13693 | [1–511] |
| 13466 | [1–482] | 13518 | [1–378] | 13645 | [1–480] | 13694 | [1–229] |
| 13467 | [1–459] | 13519 | [1–372] | 13646 | [1–116] | 13695 | [1–513] |
| 13468 | [1–132] | 13520 | [1–271] | 13647 | [1–113] | 13696 | [1–472] |
| 13469 | [1–69] | 13521 | [1–144] | 13648 | [1–269] | 13697 | [1–312] |
| 13470 | [217–428] | 13522 | [1–225] | 13649 | [1–62] | 13698 | [1–424] |
| 13523 | [1–215] | 13572 | [1–109] | 13650 | [57–182] | 13699 | [1–130] |
| 13524 | [1–119] | 13573 | [1–224] | 13651 | [1–486] | 13700 | [1–266] |
| 13525 | [1–243] | 13574 | [1–342] | 13652 | [1–442] | 13701 | [1–466] |
| 13526 | [1–82] | 13575 | [1–200] | 13653 | [1–475] | 13702 | [1–366] |
| 13527 | [1–150],[247–310] | 13576 | [1–161] | 13654 | [1–79] | 13703 | [1–446] |
| 13528 | [1–200] | 13577 | [1–149] | 13655 | [1–284] | 13704 | [1–479] |
| 13529 | [1–170] | 13578 | [1–150],[247–312] | 13656 | [1–473] | 13705 | [1–462] |
| 13530 | [1–337] | 13579 | [1–70] | 13658 | [1–145] | 13706 | [1–474] |
| 13531 | [1–63] | 13580 | [1–51] | 13659 | [1–490] | 13707 | [1–203] |
| 13532 | [1–133] | 13581 | [1–272] | 13660 | [1–481] | 13708 | [1–486] |
| 13533 | [1–97] | 13582 | [1–111] | 13661 | [1–202] | 13709 | [1–431] |
| 13534 | [1–115] | 13583 | [1–152] | 13662 | [1–102] | 13710 | [1–425] |
| 13535 | [1–374] | 13584 | [1–412] | 13663 | [1–440] | 13711 | [1–468] |
| 13536 | [1–254] | 13585 | [1–118] | 13664 | [1–447] | 13712 | [158–358] |
| 13537 | [1–344] | 13586 | [1–504] | 13665 | [1–471] | 13713 | [1–498] |
| 13538 | [1–200] | 13587 | [1–374] | 13666 | [1–55] | 13714 | [1–237],[383–465] |
| 13539 | [1–112] | 13588 | [1–313] | 13667 | [1–253] | 13715 | [1–467] |
| 13540 | [1–354] | 13589 | [1–175] | 13668 | [1–475] | 13716 | [1–499] |
| 13541 | [1–309] | 13590 | [1–366] | 13669 | [1–456] | 13717 | [1–504] |
| 13542 | [1–348] | 13591 | [1–175] | 13670 | [1–230] | 13718 | [1–489] |
| 13543 | [1–361] | 13592 | [1–91] | 13671 | [1–371] | 13719 | [1–420] |
| 13544 | [1–161] | 13593 | [1–235] | 13720 | [1–507] | 13768 | [1–392] |
| 13545 | [1–200] | 13594 | [1–144] | 13721 | [1–487] | 13769 | [1–97] |
| 13546 | [1–186] | 13595 | [1–173] | 13722 | [1–468] | 13770 | [1–178] |
| 13547 | [1–129] | 13596 | [1–111] | 13723 | [1–372] | 13771 | [1–463] |
| 13548 | [1–232] | 13597 | [1–270] | 13724 | [1–116] | 13772 | [1–396] |
| 13549 | [1–134] | 13598 | [1–306] | 13725 | [1–483] | 13773 | [1–313] |
| 13550 | [1–170] | 13599 | [1–225] | 13726 | [1–454] | 13774 | [1–582] |
| 13551 | [1–225] | 13600 | [1–157] | 13727 | [1–510] | 13775 | [1–507] |
| 13552 | [1–97] | 13601 | [1–81] | 13728 | [1–458] | 13776 | [1–342] |
| 13553 | [1–162] | 13602 | [1–375] | 13729 | [1–417] | 13777 | [1–407] |
| 13554 | [1–78] | 13603 | [1–125] | 13730 | [1–137] | 13778 | [1–475] |
| 13555 | [1–338] | 13604 | [1–312] | 13731 | [1–370] | 13779 | [1–534] |
| 13556 | [1–446] | 13605 | [1–342] | 13732 | [1–113] | 13780 | [1–348] |
| 13557 | [1–419] | 13606 | [1–183] | 13733 | [45–408] | 13781 | [1–196] |
| 13558 | [1–125] | 13607 | [1–112] | 13734 | [168–472] | 13782 | [1–485] |
| 13559 | [1–129] | 13608 | [1–120] | 13735 | [1–263] | 13783 | [1–134] |
| 13560 | [1–380] | 13609 | [1–108] | 13736 | [1–70],[418–483] | 13784 | [1–266] |
| 13561 | [1–285] | 13610 | [1–399] | 13737 | [1–476] | 13785 | [137–417] |
| 13563 | [1–383] | 13611 | [1–377] | 13738 | [1–282] | 13786 | [1–499] |
| 13564 | [1–310] | 13612 | [1–303] | 13739 | [1–469] | 13787 | [1–478] |
| 13566 | [1–93] | 13613 | [1–506] | 13740 | [1–348] | 13788 | [1–605] |
| 13567 | [1–119] | 13614 | [1–165] | 13741 | [132–357] | 13789 | [1–472] |
| 13568 | [1–297] | 13615 | [1–504] | 13742 | [1–483] | 13790 | [1–83] |
| 13569 | [1–156] | 13617 | [1–108],[159–246] | 13743 | [132–396] | 13791 | [1–500] |
| 13570 | [1–324] | 13618 | [1–494] | 13744 | [1–468] | 13792 | [395–449] |
| 13571 | [1–115] | 13619 | [1–436] | 13745 | [1–480] | 13793 | [1–433] |
| 13620 | [1–92] | 13672 | [1–173] | 13746 | [1–191],[239–449] | 13794 | [1–394] |
| 13621 | [1–522] | 13673 | [1–460] | 13747 | [1–462] | 13795 | [1–507] |
| 13622 | [1–443] | 13674 | [1–447] | 13748 | [1–491] | 13796 | [1–363] |
|  |  |  |  | 13749 | [1–361] | 13797 | [1–146] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 13750 | [1–287] | 13798 | [1–518] | 13920 | [1–64] | 13969 | [1–485] |
| 13751 | [1–436] | 13799 | [1–294] | 13921 | [1–463] | 13970 | [1–178] |
| 13752 | [1–59] | 13800 | [1–343] | 13922 | [1–691] | 13971 | [1–435] |
| 13753 | [1–63] | 13801 | [1–420] | 13923 | [1–381] | 13972 | [1–542] |
| 13755 | [1–461] | 13802 | [1–465] | 13924 | [1–450] | 13973 | [1–491] |
| 13756 | [1–93] | 13803 | [1–369] | 13925 | [1–356] | 13974 | [1–55] |
| 13757 | [110–493] | 13804 | [124–477] | 13927 | [1–477] | 13975 | [1–180] |
| 13758 | [1–433] | 13805 | [1–139] | 13929 | [1–388] | 13976 | [1–77] |
| 13759 | [1–61] | 13806 | [59–316] | 13930 | [1–221] | 13977 | [1–266] |
| 13760 | [1–437] | 13807 | [1–348] | 13931 | [1–111],[151–189], [272–463] | 13978 | [1–327] |
| 13761 | [1–60] | 13808 | [1–72] | | | | |
| 13762 | [1–136] | 13809 | [1–125],[157–471] | 13932 | [1–457] | 13979 | [1–387] |
| 13763 | [250–335] | 13810 | [53–193],[294–333] | 13933 | [1–127] | 13980 | [1–339] |
| 13764 | [1–493] | 13811 | [1–466] | 13934 | [1–154] | 13982 | [1–417] |
| 13765 | [1–115] | 13812 | [1–320] | 13935 | [1–173] | 13983 | [50–481] |
| 13766 | [1–459] | 13813 | [1–294] | 13936 | [31–187] | 13984 | [1–241] |
| 13767 | [1–543] | 13814 | [1–475] | 13937 | [1–57] | 13985 | [1–447] |
| 13815 | [1–481] | 13863 | [1–480] | 13938 | [1–340] | 13986 | [1–145] |
| 13816 | [1–41] | 13864 | [1–315] | 13939 | [1–451] | 13987 | [1–100] |
| 13817 | [1–369],[431–472] | 13865 | [1–516] | 13940 | [1–413] | 13988 | [1–499] |
| 13818 | [1–443] | 13866 | [1–491] | 13941 | [1–426] | 13989 | [1–150] |
| 13819 | [1–372] | 13867 | [81–479] | 13942 | [1–218] | 13990 | [1–459] |
| 13820 | [1–105] | 13868 | [1–468] | 13943 | [1–395] | 13991 | [1–501] |
| 13821 | [1–428] | 13869 | [1–382] | 13944 | [1–507] | 13992 | [61–132] |
| 13822 | [1–485] | 13870 | [183–268] | 13945 | [1–487] | 13993 | [1–376] |
| 13823 | [1–257] | 13871 | [81–534] | 13946 | [1–223] | 13994 | [1–480] |
| 13824 | [1–139] | 13872 | [1–278] | 13947 | [1–456] | 13995 | [1–485] |
| 13825 | [1–477] | 13873 | [1–386] | 13948 | [1–395] | 13996 | [1–343] |
| 13826 | [1–460] | 13874 | [70–379] | 13949 | [1–488] | 13997 | [1–466] |
| 13827 | [1–481] | 13875 | [1–502] | 13950 | [1–508] | 13998 | [1–415] |
| 13828 | [1–52] | 13876 | [1–239] | 13951 | [1–443] | 13999 | [1–479] |
| 13829 | [1–471] | 13878 | [1–248] | 13952 | [1–449] | 14000 | [1–467] |
| 13830 | [1–428] | 13879 | [1–480] | 13953 | [1–89] | 14001 | [1–368] |
| 13831 | [1–84] | 13880 | [1–481] | 13954 | [1–511] | 14002 | [1–325] |
| 13832 | [1–84],[224–496] | 13881 | [1–433] | 13955 | [1–36],[134–347] | 14003 | [1–115] |
| 13833 | [1–402] | 13882 | [1–242] | 13956 | [1–200] | 14004 | [1–132],[395–447] |
| 13834 | [1–479] | 13883 | [1–387] | 13957 | [1–330] | 14005 | [1–418] |
| 13835 | [1–487] | 13884 | [1–85] | 13958 | [1–94] | 14006 | [1–492] |
| 13836 | [1–71] | 13885 | [1–403] | 13959 | [1–399] | 14007 | [1–447] |
| 13837 | [99–537] | 13886 | [1–343] | 14008 | [1–478] | 14058 | [1–201] |
| 13838 | [1–481] | 13887 | [1–211] | 14009 | [1–336] | 14059 | [1–322] |
| 13839 | [66–227],[259–452] | 13888 | [1–513] | 14011 | [1–281] | 14060 | [85–176] |
| 13840 | [1–177] | 13889 | [1–447] | 14012 | [1–524] | 14061 | [1–129] |
| 13841 | [1–353] | 13890 | [1–488] | 14013 | [1–529] | 14062 | [1–421] |
| 13842 | [1–63] | 13891 | [1–574] | 14014 | [1–343] | 14063 | [50–119] |
| 13843 | [1–494] | 13892 | [1–289] | 14015 | [1–231] | 14064 | [1–444] |
| 13844 | [1–429] | 13893 | [1–503] | 14016 | [1–518] | 14065 | [1–477] |
| 13845 | [1–472] | 13894 | [1–100] | 14017 | [1–57] | 14066 | [238–282] |
| 13846 | [1–268] | 13895 | [37–138] | 14018 | [1–440] | 14067 | [1–170] |
| 13847 | [1–316] | 13896 | [1–388] | 14019 | [1–496] | 14068 | [1–242] |
| 13848 | [69–108],[214–390] | 13897 | [75–543] | 14020 | [1–499] | 14069 | [1–484] |
| 13849 | [1–147] | 13898 | [1–521] | 14021 | [1–428] | 14071 | [1–207],[255–487] |
| 13850 | [1–544] | 13899 | [1–133] | 14022 | [1–387] | 14072 | [1–243] |
| 13851 | [1–234] | 13900 | [73–127] | 14023 | [1–382] | 14073 | [1–289] |
| 13852 | [1–52] | 13901 | [1–103] | 14024 | [1–87] | 14074 | [1–439] |
| 13853 | [1–304] | 13902 | [73–131] | 14025 | [1–255] | 14075 | [1–468] |
| 13854 | [1–486] | 13903 | [89–176] | 14026 | [1–502] | 14076 | [184–298] |
| 13855 | [1–354] | 13904 | [1–74] | 14027 | [1–317] | 14077 | [1–258] |
| 13856 | [1–464] | 13905 | [1–259] | 14028 | [1–119] | 14078 | [1–314] |
| 13858 | [1–127],[156–187], [226–451] | 13906 | [1–159] | 14029 | [53–399] | 14079 | [1–509] |
| | | | | 14030 | [1–228] | 14080 | [1–489] |
| 13859 | [1–667] | 13907 | [1–276] | 14031 | [1–483] | 14081 | [1–497] |
| 13860 | [1–353] | 13908 | [1–181] | 14032 | [1–89] | 14082 | [1–204] |
| 13861 | [1–419] | 13909 | [1–69] | 14033 | [1–77] | 14083 | [1–392] |
| 13862 | [1–506] | 13910 | [33–186] | 14034 | [1–458] | 14084 | [1–267] |
| 13911 | [1–600] | 13960 | [53–441] | 14035 | [1–440] | 14085 | [1–473] |
| 13912 | [1–183] | 13961 | [1–512] | 14036 | [1–312] | 14086 | [1–113],[232–414] |
| 13913 | [1–327] | 13962 | [1–526] | 14037 | [1–460] | 14087 | [1–445] |
| 13914 | [1–254] | 13963 | [1–62] | 14038 | [1–490] | 14088 | [239–503] |
| 13915 | [1–75] | 13964 | [1–510] | 14039 | [1–475] | 14089 | [1–441] |
| 13916 | [1–181] | 13965 | [1–112] | 14040 | [1–478] | 14090 | [1–394] |
| 13917 | [1–67] | 13966 | [1–162],[199–288] | 14041 | [1–510] | 14091 | [1–508] |
| 13918 | [1–108] | 13967 | [1–422] | 14042 | [232–472] | 14092 | [1–501] |
| 13919 | [1–437] | 13968 | [1–512] | 14043 | [1–535] | 14093 | [180–326] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 14044 | [1–319] | 14094 | [1–514] | 14217 | [1–466] | 14265 | [1–345] |
| 14045 | [1–479] | 14095 | [1–504] | 14218 | [1–462] | 14266 | [1–394] |
| 14046 | [1–485] | 14096 | [1–186] | 14219 | [1–503] | 14267 | [1–467] |
| 14048 | [1–371] | 14097 | [1–174] | 14220 | [1–460] | 14268 | [1–295] |
| 14049 | [1–473] | 14098 | [1–225] | 14221 | [1–446] | 14269 | [1–476] |
| 14050 | [1–111] | 14099 | [81–382] | 14222 | [1–370] | 14270 | [1–440] |
| 14051 | [1–499] | 14100 | [287–432] | 14223 | [1–67],[164–456] | 14271 | [1–467] |
| 14053 | [1–333] | 14102 | [1–354] | 14224 | [1–333],[373–475] | 14272 | [84–263] |
| 14054 | [1–195],[247–486] | 14103 | [1–454] | 14225 | [1–312] | 14273 | [1–62] |
| 14055 | [1–513] | 14104 | [1–607] | 14226 | [1–457] | 14274 | [1–278] |
| 14056 | [1–383] | 14105 | [1–69] | 14227 | [1–457] | 14275 | [1–396] |
| 14057 | [1–485] | 14106 | [36–429] | 14228 | [1–191],[327–354] | 14276 | [1–164] |
| 14107 | [1–379] | 14156 | [1–333] | 14229 | [1–455] | 14277 | [1–479] |
| 14108 | [1–488] | 14157 | [1–503] | 14231 | [1–113] | 14278 | [1–523] |
| 14109 | [1–240] | 14158 | [1–166],[286–328],[380–460] | 14232 | [1–334] | 14279 | [218–458] |
| 14110 | [1–171] | 14159 | [1–354] | 14233 | [1–413] | 14280 | [1–316] |
| 14112 | [1–74] | 14160 | [1–147] | 14234 | [1–338] | 14281 | [1–500] |
| 14113 | [1–481] | 14161 | [1–337] | 14235 | [1–458] | 14282 | [1–398] |
| 14114 | [1–194] | 14162 | [1–69] | 14236 | [1–407] | 14283 | [1–267] |
| 14115 | [1–259] | 14163 | [37–472] | 14237 | [160–367] | 14284 | [1–409] |
| 14116 | [1–309] | 14164 | [1–461] | 14238 | [1–477] | 14285 | [1–75] |
| 14117 | [1–483] | 14165 | [1–543] | 14239 | [1–213] | 14286 | [1–157] |
| 14118 | [1–473] | 14166 | [1–424] | 14240 | [1–216],[256–487] | 14287 | [72–165] |
| 14119 | [1–487] | 14167 | [1–538] | 14241 | [1–464] | 14288 | [1–445] |
| 14120 | [1–430] | 14168 | [1–372] | 14242 | [1–454] | 14289 | [1–434] |
| 14121 | [1–56] | 14169 | [1–392] | 14243 | [1–474] | 14290 | [1–391] |
| 14122 | [1–403] | 14170 | [75–347] | 14244 | [1–470] | 14291 | [1–339] |
| 14123 | [1–481] | 14171 | [1–448] | 14245 | [1–367] | 14292 | [1–418] |
| 14124 | [1–315] | 14172 | [1–106] | 14246 | [1–81] | 14293 | [1–305] |
| 14125 | [1–417] | 14173 | [1–487] | 14247 | [1–262] | 14294 | [1–491] |
| 14126 | [1–503] | 14174 | [1–491] | 14248 | [1–227] | 14295 | [1–433] |
| 14127 | [1–493] | 14175 | [1–600] | 14249 | [1–410] | 14296 | [1–356] |
| 14128 | [1–182] | 14176 | [1–77] | 14250 | [1–27],[221–502] | 14297 | [1–445] |
| 14129 | [1–385] | 14177 | [1–529] | 14298 | [69–113] | 14347 | [1–383] |
| 14130 | [1–62] | 14178 | [48–564] | 14299 | [1–379] | 14348 | [1–313] |
| 14131 | [1–295] | 14179 | [1–498] | 14300 | [1–454] | 14349 | [1–418] |
| 14132 | [1–496] | 14180 | [1–301] | 14301 | [1–363] | 14350 | [1–428] |
| 14133 | [1–452] | 14181 | [1–439] | 14302 | [1–456] | 14351 | [1–325] |
| 14134 | [60–372] | 14182 | [1–203] | 14303 | [1–431] | 14352 | [1–182] |
| 14135 | [1–449] | 14183 | [1–436] | 14304 | [1–453] | 14353 | [1–162] |
| 14136 | [1–438] | 14184 | [1–413] | 14305 | [1–425] | 14354 | [1–514] |
| 14137 | [1–181] | 14185 | [102–483] | 14306 | [1–436] | 14355 | [1–96] |
| 14138 | [1–472] | 14186 | [1–391] | 14307 | [1–405] | 14356 | [1–352] |
| 14139 | [1–444] | 14187 | [1–468] | 14308 | [1–260] | 14357 | [1–498] |
| 14140 | [1–236] | 14188 | [1–97] | 14309 | [1–477] | 14358 | [1–198] |
| 14141 | [59–235] | 14189 | [1–74] | 14310 | [1–496] | 14359 | [1–550] |
| 14142 | [1–52] | 14190 | [1–323] | 14311 | [1–378] | 14360 | [1–56] |
| 14143 | [1–439] | 14191 | [1–453] | 14312 | [116–409] | 14361 | [1–334] |
| 14144 | [1–316] | 14192 | [1–489] | 14313 | [1–442] | 14362 | [1–453] |
| 14145 | [1–509] | 14193 | [237–392] | 14314 | [1–459] | 14363 | [1–230],[260–347] |
| 14146 | [1–497] | 14194 | [1–497] | 14315 | [1–66] | 14364 | [1–495] |
| 14147 | [1–67] | 14195 | [1–180] | 14316 | [1–371] | 14365 | [68–161] |
| 14148 | [155–291] | 14196 | [1–452] | 14317 | [1–458] | 14366 | [62–478] |
| 14149 | [1–100] | 14197 | [1–474] | 14318 | [1–429] | 14367 | [1–437] |
| 14151 | [1–456] | 14198 | [116–184],[252–353] | 14319 | [1–299] | 14368 | [1–310] |
| 14152 | [1–406] | 14199 | [1–444] | 14320 | [1–452] | 14369 | [1–454],[491–566] |
| 14153 | [1–443] | 14200 | [77–390] | 14322 | [1–156] | 14370 | [1–297] |
| 14154 | [1–156],[194–328] | 14201 | [1–317] | 14323 | [1–392] | 14371 | [1–430] |
| 14155 | [187–267] | 14202 | [1–101] | 14324 | [1–277] | 14372 | [1–462] |
| 14203 | [1–275] | 14251 | [1–272] | 14325 | [1–420] | 14373 | [1–512] |
| 14204 | [1–200] | 14252 | [1–462] | 14326 | [1–461] | 14374 | [1–73] |
| 14205 | [1–484] | 14253 | [1–431] | 14327 | [1–452] | 14375 | [1–81] |
| 14206 | [1–434] | 14254 | [1–100] | 14328 | [1–423] | 14376 | [1–449] |
| 14207 | [1–300] | 14255 | [1–391] | 14329 | [1–218] | 14377 | [1–193] |
| 14208 | [1–367] | 14256 | [1–288] | 14331 | [1–277] | 14378 | [1–307] |
| 14209 | [1–465] | 14257 | [1–171] | 14332 | [1–402] | 14379 | [1–477] |
| 14210 | [110–357] | 14258 | [1–364] | 14333 | [1–82] | 14380 | [1–126],[173–231] |
| 14211 | [1–341] | 14259 | [1–436] | 14334 | [1–420] | 14381 | [1–269] |
| 14212 | [1–106] | 14260 | [1–425] | 14335 | [1–410] | 14383 | [1–483] |
| 14213 | [1–466] | 14261 | [1–359] | 14336 | [1–426] | 14384 | [1–412] |
| 14214 | [1–327] | 14262 | [1–269] | 14337 | [1–434] | 14385 | [1–239] |
| 14215 | [1–458] | 14263 | [1–138] | 14338 | [310–406] | 14386 | [1–46],[99–372] |
| 14216 | [1–494] | 14264 | [1–491] | 14339 | [1–448] | 14387 | [1–451] |
|  |  |  |  | 14340 | [74–466] | 14388 | [1–467] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 14341 | [166–314] | 14389 | [1–443] | 14512 | [1–322] | 14561 | [1–229] |
| 14342 | [1–481] | 14390 | [1–145] | 14513 | [1–249] | 14562 | [1–382] |
| 14343 | [1–416] | 14391 | [1–115] | 14514 | [1–418] | 14563 | [1–424] |
| 14344 | [1–464] | 14392 | [1–451] | 14515 | [1–373] | 14565 | [1–464] |
| 14345 | [1–274] | 14393 | [1–470] | 14516 | [164–402] | 14566 | [1–301] |
| 14346 | [1–289] | 14394 | [1–474] | 14517 | [1–440] | 14567 | [1–187] |
| 14395 | [1–442] | 14442 | [1–231],[295–336] | 14519 | [1–461] | 14568 | [1–75] |
| 14396 | [1–372] | 14443 | [1–482] | 14520 | [1–448] | 14569 | [1–347] |
| 14397 | [1–122] | 14444 | [1–469] | 14521 | [1–437] | 14570 | [1–324] |
| 14398 | [1–457] | 14445 | [1–419] | 14522 | [1–333] | 14571 | [1–84] |
| 14399 | [1–457] | 14446 | [1–326] | 14523 | [1–384] | 14572 | [1–483] |
| 14400 | [1–296] | 14447 | [1–435] | 14524 | [1–240] | 14573 | [1–477] |
| 14401 | [1–170] | 14448 | [1–310] | 14525 | [1–386],[427–466] | 14574 | [1–341] |
| 14402 | [1–379] | 14449 | [1–458] | 14526 | [1–140] | 14575 | [1–287],[322–424] |
| 14403 | [1–477] | 14450 | [1–432] | 14527 | [1–129] | 14576 | [1–56],[122–308] |
| 14404 | [239–419] | 14451 | [72–443] | 14528 | [1–360] | 14577 | [1–84] |
| 14405 | [1–481] | 14452 | [51–94],[139–415] | 14529 | [1–504] | 14578 | [1–408] |
| 14406 | [1–477] | 14453 | [1–433] | 14530 | [1–457] | 14579 | [1–469] |
| 14407 | [1–474] | 14454 | [1–447] | 14531 | [1–424] | 14580 | [1–413] |
| 14408 | [104–356] | 14455 | [1–461] | 14532 | [1–61] | 14581 | [1–488] |
| 14409 | [1–478] | 14456 | [59–322] | 14533 | [1–62] | 14582 | [1–322] |
| 14410 | [1–460] | 14457 | [1–473] | 14534 | [1–392] | 14583 | [1–399] |
| 14411 | [1–220] | 14458 | [1–374] | 14535 | [1–55] | 14584 | [1–482] |
| 14412 | [1–320] | 14459 | [1–457] | 14536 | [1–72] | 14585 | [1–325] |
| 14413 | [1–441] | 14460 | [1–128],[225–292] | 14537 | [1–321] | 14586 | [1–399] |
| 14414 | [1–476] | 14462 | [1–337] | 14538 | [1–425] | 14587 | [1–332] |
| 14415 | [1–301] | 14463 | [1–463] | 14588 | [1–280] | 14637 | [1–288] |
| 14416 | [1–169] | 14464 | [1–449] | 14589 | [1–284] | 14638 | [1–222] |
| 14417 | [1–439] | 14465 | [1–96] | 14590 | [1–357] | 14639 | [1–251] |
| 14418 | [1–343] | 14466 | [1–444] | 14591 | [1–364] | 14640 | [1–498] |
| 14419 | [1–404] | 14467 | [1–461] | 14592 | [1–109] | 14641 | [1–397] |
| 14420 | [1–171],[200–463] | 14468 | [1–448] | 14593 | [1–478] | 14642 | [1–424] |
| 14421 | [1–129],[180–402] | 14469 | [1–233] | 14594 | [1–507] | 14644 | [1–217] |
| 14422 | [1–497] | 14470 | [1–28],[324–466] | 14595 | [1–238] | 14645 | [1–501] |
| 14423 | [1–447] | 14471 | [1–448] | 14596 | [1–433] | 14646 | [1–470] |
| 14424 | [1–455] | 14472 | [1–375] | 14597 | [1–492] | 14647 | [1–293] |
| 14425 | [1–173] | 14473 | [1–369] | 14598 | [1–371] | 14648 | [1–298] |
| 14426 | [1–373] | 14474 | [1–451] | 14599 | [1–167] | 14649 | [1–322] |
| 14427 | [1–415] | 14475 | [1–458] | 14600 | [50–483] | 14650 | [1–486] |
| 14428 | [1–213] | 14476 | [1–197] | 14601 | [1–407] | 14651 | [1–478] |
| 14429 | [1–442] | 14477 | [1–441] | 14603 | [1–510] | 14652 | [1–447] |
| 14430 | [1–465] | 14478 | [1–61] | 14604 | [67–109],[153–598] | 14653 | [1–438] |
| 14431 | [1–256] | 14479 | [1–151] | 14605 | [1–440] | 14654 | [1–388] |
| 14432 | [1–295] | 14480 | [1–422] | 14606 | [1–416] | 14655 | [1–79] |
| 14433 | [1–398] | 14481 | [1–329] | 14608 | [1–502] | 14656 | [1–482] |
| 14434 | [1–477] | 14482 | [1–93] | 14609 | [1–361] | 14657 | [1–508] |
| 14435 | [1–343] | 14483 | [1–118] | 14610 | [1–335] | 14658 | [1–329] |
| 14436 | [1–119] | 14484 | [1–401] | 14611 | [1–206] | 14659 | [1–398] |
| 14437 | [1–200] | 14485 | [1–344] | 14612 | [1–50] | 14660 | [1–116] |
| 14438 | [1–116] | 14486 | [1–143] | 14613 | [1–410] | 14661 | [1–274] |
| 14439 | [1–470] | 14488 | [1–441] | 14614 | [1–423] | 14662 | [183–497] |
| 14440 | [1–280] | 14489 | [1–334] | 14615 | [1–163] | 14663 | [1–484] |
| 14441 | [1–435] | 14490 | [1–443] | 14616 | [1–495] | 14664 | [1–461] |
| 14491 | [1–420] | 14539 | [424–453] | 14617 | [1–430] | 14665 | [1–481] |
| 14492 | [1–103] | 14540 | [1–498] | 14618 | [1–352] | 14666 | [1–126] |
| 14493 | [141–324] | 14541 | [1–480] | 14619 | [1–83] | 14667 | [1–323] |
| 14494 | [1–408] | 14542 | [1–507] | 14620 | [1–321] | 14668 | [1–90] |
| 14495 | [1–417] | 14543 | [1–226] | 14621 | [1–491] | 14669 | [1–425] |
| 14496 | [1–446] | 14544 | [1–541] | 14622 | [40–492] | 14670 | [1–448] |
| 14497 | [1–306] | 14545 | [1–523] | 14623 | [1–483] | 14671 | [1–172] |
| 14498 | [1–433] | 14546 | [178–317],[363–583] | 14624 | [61–347],[405–472] | 14672 | [1–308] |
| 14499 | [1–453] | 14547 | [1–487] | 14625 | [1–484] | 14673 | [1–236] |
| 14500 | [1–171] | 14548 | [1–367] | 14626 | [1–359] | 14674 | [100–158],[189–464] |
| 14501 | [1–453] | 14549 | [1–505] | 14627 | [1–52] | 14676 | [1–275] |
| 14502 | [1–374] | 14550 | [1–166] | 14628 | [1–511] | 14677 | [1–111] |
| 14503 | [1–298] | 14551 | [1–487] | 14629 | [1–233] | 14678 | [1–472] |
| 14504 | [1–475] | 14552 | [1–451] | 14630 | [1–129] | 14679 | [1–168] |
| 14505 | [1–416] | 14553 | [1–359] | 14631 | [1–82] | 14680 | [1–61] |
| 14506 | [1–276],[307–432] | 14554 | [1–447] | 14632 | [1–475] | 14681 | [1–61] |
| 14507 | [1–350] | 14555 | [1–498] | 14633 | [1–520] | 14682 | [1–59] |
| 14508 | [1–342] | 14556 | [1–56] | 14634 | [1–316] | 14683 | [1–419] |
| 14509 | [1–369] | 14558 | [1–464] | 14635 | [1–308] | 14684 | [48–448] |
| 14510 | [1–450] | 14559 | [1–471] | 14636 | [1–465] | 14685 | [1–320] |
| 14511 | [1–89] | 14560 | [1–87] | 14687 | [1–314] | 14736 | [1–474] |

TABLE IVb-continued (Novelty: 100%)

| Seq Id No | Positions of preferred fragments | Seq Id No | Positions of preferred fragments | Seq Id No | Positions of preferred fragments | Seq Id No | Positions of preferred fragments |
|---|---|---|---|---|---|---|---|
| 14688 | [1–97] | 14737 | [1–148] | 14815 | [1–72] | 14863 | [1–166] |
| 14689 | [1–92] | 14738 | [1–411] | 14816 | [1–340] | 14864 | [39–470] |
| 14690 | [1–340] | 14739 | [1–517] | 14817 | [1–508] | 14865 | [1–495] |
| 14691 | [1–157] | 14740 | [1–308] | 14818 | [1–195] | 14866 | [1–217] |
| 14692 | [109–444] | 14741 | [1–85] | 14819 | [1–66] | 14867 | [38–377] |
| 14693 | [1–77] | 14742 | [1–60] | 14820 | [1–54] | 14868 | [1–473] |
| 14694 | [1–75] | 14743 | [1–65] | 14821 | [1–436] | 14869 | [1–69] |
| 14695 | [1–406] | 14744 | [1–404] | 14822 | [1–343] | 14870 | [1–276] |
| 14697 | [1–368] | 14745 | [1–498] | 14823 | [1–317] | 14871 | [1–93] |
| 14698 | [37–73] | 14746 | [1–463] | 14824 | [1–78] | 14872 | [1–330] |
| 14699 | [1–365] | 14747 | [1–413] | 14825 | [1–62] | 14873 | [1–417] |
| 14700 | [1–288] | 14748 | [109–195] | 14826 | [1–386] | 14874 | [1–197] |
| 14701 | [1–124] | 14749 | [1–89] | 14827 | [1–58] | 14875 | [1–112] |
| 14702 | [1–357] | 14750 | [1–70] | 14829 | [1–478] | 14876 | [1–154] |
| 14703 | [1–60] | 14751 | [1–83] | 14830 | [1–103] | 14877 | [1–435] |
| 14704 | [1–195] | 14752 | [1–284] | 14831 | [1–76] | 14879 | [1–323] |
| 14705 | [1–74] | 14753 | [1–67] | 14832 | [39–464] | 14880 | [1–302] |
| 14706 | [1–293] | 14754 | [1–61] | 14833 | [1–405] | 14881 | [1–221] |
| 14707 | [252–470] | 14755 | [1–195] | 14834 | [1–61] | 14882 | [1–269] |
| 14708 | [1–345] | 14756 | [1–63] | 14883 | [1–432] | 14931 | [1–91] |
| 14709 | [1–509] | 14757 | [1–90] | 14884 | [1–60] | 14932 | [1–234] |
| 14710 | [1–449] | 14758 | [1–209] | 14885 | [1–462] | 14933 | [1–434] |
| 14711 | [1–339] | 14759 | [1–527] | 14886 | [1–114] | 14934 | [1–313] |
| 14712 | [1–59] | 14760 | [1–62] | 14887 | [1–481] | 14935 | [1–449] |
| 14713 | [1–216] | 14761 | [1–189] | 14888 | [1–389] | 14936 | [1–62] |
| 14714 | [1–217] | 14762 | [1–365] | 14889 | [1–194] | 14937 | [1–144] |
| 14715 | [1–50] | 14763 | [1–317] | 14890 | [1–240] | 14938 | [1–216] |
| 14716 | [1–95] | 14764 | [1–63] | 14891 | [1–301] | 14940 | [1–157] |
| 14717 | [1–80] | 14765 | [1–495] | 14892 | [1–75] | 14941 | [1–431] |
| 14718 | [1–406] | 14766 | [1–508] | 14893 | [1–357] | 14942 | [1–77],[174–255] |
| 14719 | [1–274] | 14767 | [1–379] | 14894 | [1–386] | 14943 | [45–328] |
| 14720 | [1–492] | 14768 | [1–393] | 14895 | [1–481] | 14944 | [1–91] |
| 14721 | [1–433] | 14769 | [1–474] | 14896 | [1–181] | 14945 | [1–62] |
| 14722 | [1–135] | 14770 | [1–263] | 14897 | [1–485] | 14946 | [1–95] |
| 14723 | [1–420] | 14771 | [1–528] | 14898 | [1–330] | 14947 | [1–94] |
| 14724 | [1–94] | 14772 | [126–510] | 14899 | [99–330] | 14948 | [1–61] |
| 14725 | [1–483] | 14773 | [1–514] | 14900 | [1–285] | 14949 | [1–85] |
| 14726 | [1–465] | 14774 | [1–298] | 14901 | [1–78] | 14950 | [1–195] |
| 14728 | [1–217] | 14775 | [1–281] | 14903 | [1–435] | 14951 | [1–224] |
| 14729 | [1–73] | 14776 | [1–457] | 14904 | [101–279] | 14952 | [1–486] |
| 14730 | [130–407] | 14777 | [1–162] | 14905 | [1–71] | 14953 | [1–94] |
| 14731 | [43–184] | 14778 | [1–445] | 14906 | [1–297] | 14954 | [1–249] |
| 14732 | [1–433] | 14779 | [1–268] | 14907 | [1–370] | 14955 | [37–491] |
| 14733 | [1–304] | 14781 | [61–269] | 14908 | [1–413] | 14956 | [1–501] |
| 14734 | [1–437] | 14782 | [1–162] | 14909 | [1–386] | 14957 | [1–216] |
| 14735 | [1–461] | 14783 | [1–83] | 14910 | [1–119] | 14958 | [1–83] |
| 14784 | [1–417] | 14835 | [1–86] | 14911 | [1–302] | 14959 | [1–83] |
| 14785 | [50–240] | 14836 | [1–494] | 14912 | [1–152] | 14960 | [1–88] |
| 14786 | [1–83] | 14837 | [1–458] | 14913 | [1–52] | 14961 | [1–427] |
| 14787 | [1–75] | 14838 | [1–69] | 14914 | [1–50] | 14962 | [1–89] |
| 14788 | [1–442] | 14839 | [1–344] | 14915 | [1–76] | 14963 | [1–73] |
| 14790 | [1–264] | 14840 | [1–217] | 14916 | [1–78] | 14964 | [1–30] |
| 14791 | [1–301] | 14841 | [1–328] | 14917 | [1–482] | 14965 | [1–458] |
| 14792 | [1–72] | 14842 | [1–72] | 14918 | [1–293] | 14966 | [1–63] |
| 14793 | [62–348],[380–432] | 14843 | [1–430] | 14919 | [1–496] | 14967 | [1–118] |
| 14795 | [1–356] | 14844 | [1–65],[199–270] | 14920 | [1–59] | 14968 | [1–58] |
| 14796 | [1–278] | 14845 | [1–253] | 14921 | [1–474] | 14969 | [167–223] |
| 14797 | [1–328] | 14846 | [1–66] | 14922 | [1–195] | 14970 | [1–105] |
| 14798 | [61–259] | 14847 | [1–109] | 14923 | [1–113] | 14971 | [1–235] |
| 14799 | [1–61] | 14848 | [1–187],[268–387] | 14924 | [1–328] | 14972 | [1–469] |
| 14800 | [1–55] | 14849 | [1–87] | 14925 | [1–91] | 14973 | [1–180] |
| 14801 | [1–474] | 14850 | [1–480] | 14926 | [1–84] | 14974 | [1–89] |
| 14802 | [39–427] | 14851 | [1–196] | 14927 | [1–112] | 14975 | [50–146] |
| 14803 | [1–54] | 14852 | [1–423] | 14928 | [1–122] | 14976 | [1–178] |
| 14804 | [1–102] | 14853 | [1–65] | 14929 | [1–216] | 14977 | [91–403] |
| 14805 | [1–81] | 14854 | [1–480] | 14930 | [1–477] | 14978 | [32–185] |
| 14806 | [1–110] | 14855 | [1–138] | 14979 | [1–71],[132–214] | 15028 | [1–91] |
| 14807 | [1–430] | 14856 | [1–309] | 14980 | [1–413] | 15029 | [1–216] |
| 14808 | [1–430] | 14857 | [1–323] | 14981 | [1–448] | 15030 | [1–381] |
| 14809 | [1–292] | 14858 | [1–64] | 14982 | [1–380] | 15031 | [1–82] |
| 14811 | [1–441] | 14859 | [1–85] | 14983 | [1–217] | 15032 | [1–432] |
| 14812 | [1–77] | 14860 | [1–71] | 14984 | [1–305] | 15033 | [1–302] |
| 14813 | [1–69] | 14861 | [1–470] | 14985 | [1–507] | 15034 | [1–422] |
| 14814 | [1–456] | 14862 | [1–103] | 14986 | [1–470] | 15035 | [1–492] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 14987 | [1–484] | 15036 | [1–284] | 15112 | [1–255],[322–391] | 15164 | [1–533] |
| 14988 | [1–363] | 15037 | [1–154] | 15113 | [1–406] | 15166 | [1–484] |
| 14989 | [1–53] | 15038 | [1–454] | 15114 | [1–539] | 15167 | [79–120],[266–291] |
| 14990 | [1–120] | 15039 | [1–338] | 15115 | [1–339] | 15168 | [1–294] |
| 14991 | [1–433] | 15040 | [1–431] | 15116 | [1–558] | 15169 | [1–107] |
| 14992 | [1–125] | 15041 | [1–90] | 15117 | [1–529] | 15170 | [1–478] |
| 14993 | [1–113] | 15042 | [1–503] | 15118 | [1–407] | 15171 | [1–50],[278–416] |
| 14994 | [1–54] | 15043 | [1–301] | 15119 | [1–495] | 15172 | [1–437] |
| 14995 | [1–487] | 15044 | [1–248] | 15120 | [1–478] | 15173 | [1–475] |
| 14996 | [1–92] | 15045 | [1–329] | 15121 | [1–483] | 15174 | [1–508] |
| 14997 | [1–447] | 15046 | [1–174] | 15122 | [1–525] | 15175 | [1–127] |
| 14998 | [1–387] | 15047 | [1–134] | 15123 | [1–478] | 15176 | [1–445] |
| 14999 | [1–166] | 15048 | [1–431] | 15177 | [1–64],[129–478] | 15225 | [1–484] |
| 15000 | [1–156] | 15049 | [1–84] | 15178 | [1–312] | 15226 | [1–86] |
| 15001 | [1–155] | 15050 | [1–465] | 15179 | [1–473] | 15227 | [1–417] |
| 15002 | [1–114] | 15051 | [1–284] | 15180 | [1–101] | 15228 | [1–523] |
| 15003 | [1–169] | 15052 | [37–474] | 15181 | [1–591] | 15229 | [1–511] |
| 15004 | [1–67] | 15053 | [1–548] | 15182 | [1–250] | 15230 | [1–348] |
| 15005 | [115–245] | 15054 | [1–349] | 15183 | [1–377] | 15231 | [1–517] |
| 15006 | [1–217] | 15055 | [1–310] | 15184 | [1–454] | 15232 | [1–300] |
| 15008 | [1–419] | 15056 | [1–113] | 15185 | [1–376] | 15233 | [1–398] |
| 15009 | [1–192] | 15057 | [1–74] | 15186 | [1–436] | 15234 | [1–389] |
| 15010 | [1–446] | 15058 | [1–464] | 15187 | [1–382] | 15235 | [1–285] |
| 15011 | [1–365] | 15059 | [1–468] | 15188 | [1–494] | 15236 | [1–74],[202–311] |
| 15012 | [39–442] | 15060 | [1–91] | 15189 | [1–521] | 15237 | [1–514] |
| 15013 | [1–580] | 15061 | [1–162] | 15190 | [1–503] | 15238 | [1–442] |
| 15014 | [37–481] | 15062 | [1–399] | 15191 | [1–433] | 15239 | [72–394] |
| 15015 | [1–408] | 15063 | [1–126] | 15192 | [1–567] | 15240 | [1–475] |
| 15016 | [1–434] | 15064 | [1–72] | 15193 | [35–92] | 15241 | [1–435] |
| 15017 | [1–162] | 15065 | [130–477] | 15194 | [1–264] | 15242 | [1–394] |
| 15018 | [1–83],[113–228] | 15066 | [1–70] | 15195 | [1–451] | 15243 | [191–276] |
| 15019 | [1–167] | 15067 | [1–445] | 15196 | [1–368] | 15244 | [1–601] |
| 15020 | [1–500] | 15068 | [1–281] | 15197 | [1–302] | 15245 | [1–506] |
| 15021 | [1–195] | 15069 | [1–436] | 15198 | [1–459] | 15246 | [1–521] |
| 15022 | [1–419] | 15071 | [1–478] | 15199 | [1–431] | 15247 | [1–468] |
| 15023 | [1–444] | 15072 | [1–425] | 15200 | [1–460] | 15248 | [1–345] |
| 15024 | [1–81] | 15073 | [1–75] | 15201 | [1–464] | 15249 | [1–293] |
| 15026 | [1–422] | 15074 | [1–406] | 15202 | [1–496] | 15251 | [1–577] |
| 15027 | [1–93] | 15075 | [1–177] | 15203 | [1–397] | 15252 | [1–425] |
| 15076 | [1–418] | 15124 | [1–309],[350–375] | 15204 | [1–394] | 15253 | [1–185] |
| 15077 | [1–349] | 15127 | [124–165] | 15205 | [1–436] | 15254 | [1–434] |
| 15078 | [1–75] | 15129 | [1–235] | 15206 | [1–435] | 15255 | [1–159] |
| 15079 | [1–177] | 15130 | [1–421] | 15207 | [138–278],[315–386] | 15256 | [1–501] |
| 15081 | [1–409] | 15131 | [1–617] | 15208 | [1–437] | 15257 | [1–493] |
| 15082 | [1–189] | 15132 | [1–540] | 15209 | [1–435] | 15258 | [1–454] |
| 15083 | [1–50],[81–321] | 15133 | [1–232] | 15210 | [1–435] | 15259 | [1–466] |
| 15084 | [1–77] | 15134 | [1–351] | 15211 | [1–474] | 15260 | [1–199] |
| 15085 | [1–436] | 15135 | [1–440] | 15212 | [1–509] | 15261 | [1–402] |
| 15086 | [1–255] | 15136 | [1–493] | 15213 | [1–490] | 15262 | [1–448] |
| 15087 | [1–132] | 15137 | [1–89],[122–348] | 15214 | [1–472] | 15263 | [1–492] |
| 15088 | [1–373] | 15138 | [1–399] | 15215 | [1–461] | 15264 | [1–381] |
| 15089 | [1–162] | 15139 | [1–225] | 15216 | [1–406] | 15266 | [187–332],[373–437] |
| 15090 | [1–79] | 15140 | [1–535] | 15217 | [1–469] | 15267 | [1–277] |
| 15091 | [1–98] | 15141 | [1–375] | 15218 | [1–460] | 15268 | [141–201] |
| 15092 | [1–78] | 15142 | [226–289] | 15219 | [1–519] | 15269 | [141–201] |
| 15093 | [1–342] | 15143 | [1–479] | 15220 | [1–337],[487–544] | 15270 | [1–180] |
| 15094 | [1–64],[290–445] | 15144 | [1–447] | 15221 | [1–311] | 15271 | [1–163] |
| 15095 | [1–351] | 15145 | [1–457] | 15223 | [1–544] | 15272 | [52–226] |
| 15096 | [1–371] | 15146 | [1–462] | 15224 | [1–494] | 15273 | [1–512] |
| 15097 | [1–278],[338–506] | 15147 | [1–311] | 15274 | [1–187] | 15323 | [137–179] |
| 15098 | [1–520] | 15148 | [1–486] | 15275 | [47–155] | 15324 | [1–450] |
| 15099 | [1–450] | 15149 | [1–437] | 15276 | [1–106] | 15325 | [1–573] |
| 15100 | [1–440] | 15150 | [1–570] | 15278 | [1–157] | 15326 | [1–381] |
| 15101 | [1–573] | 15151 | [1–464] | 15279 | [1–533] | 15327 | [1–490] |
| 15102 | [1–290] | 15152 | [1–107],[166–201] | 15280 | [1–459] | 15328 | [1–267],[414–504] |
| 15103 | [1–489] | 15154 | [1–484] | 15281 | [1–460] | 15329 | [1–315] |
| 15104 | [1–368] | 15155 | [1–896] | 15282 | [1–506] | 15330 | [1–407] |
| 15105 | [1–454] | 15156 | [1–475] | 15283 | [1–641] | 15331 | [1–167] |
| 15106 | [1–405] | 15158 | [1–172],[204–315] | 15284 | [1–295] | 15332 | [1–443] |
| 15107 | [1–406] | 15159 | [85–357] | 15285 | [1–445] | 15333 | [91–454] |
| 15108 | [1–337] | 15160 | [83–495] | 15286 | [1–292] | 15334 | [1–457] |
| 15109 | [1–568] | 15161 | [1–203] | 15287 | [1–378] | 15335 | [1–278] |
| 15110 | [122–314] | 15162 | [1–420] | 15288 | [1–503] | 15336 | [1–94],[140–361] |
| 15111 | [48–372] | 15163 | [227–436] | 15289 | [1–377] | 15337 | [1–186] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 15290 | [1–533] | 15338 | [1–489] | 15412 | [1–153],[232–348] | 15462 | [1–468] |
| 15291 | [40–404] | 15339 | [1–200] | 15413 | [1–144] | 15463 | [1–569] |
| 15292 | [1–230] | 15340 | [1–522] | 15414 | [1–445] | 15464 | [1–410] |
| 15293 | [1–534] | 15341 | [1–197] | 15415 | [1–362] | 15465 | [1–208] |
| 15294 | [1–142] | 15342 | [1–350] | 15416 | [1–221] | 15466 | [1–114],[231–291] |
| 15295 | [1–73] | 15343 | [1–121] | 15417 | [1–201],[333–471] | 15467 | [1–392] |
| 15296 | [40–412] | 15344 | [1–428] | 15468 | [1–393] | 15519 | [1–457] |
| 15297 | [1–254],[390–564] | 15345 | [1–482] | 15469 | [1–406] | 15520 | [1–202],[320–463] |
| 15298 | [1–172] | 15346 | [1–499] | 15470 | [1–208] | 15521 | [1–442] |
| 15299 | [1–491] | 15347 | [1–447] | 15471 | [1–376] | 15522 | [1–415] |
| 15300 | [1–416] | 15348 | [1–395] | 15472 | [1–446] | 15523 | [30–497] |
| 15301 | [1–412] | 15349 | [93–263] | 15473 | [1–461] | 15524 | [1–510] |
| 15302 | [1–53] | 15350 | [1–392] | 15474 | [1–466] | 15525 | [1–542] |
| 15303 | [1–784] | 15351 | [1–517] | 15475 | [1–447] | 15526 | [1–287] |
| 15304 | [1–488] | 15352 | [1–390] | 15476 | [1–478] | 15527 | [1–406] |
| 15305 | [1–445] | 15353 | [1–95],[135–258] | 15477 | [378–403] | 15528 | [48–352] |
| 15306 | [1–491] | 15354 | [1–485] | 15478 | [1–453] | 15529 | [1–447] |
| 15307 | [1–480] | 15355 | [1–444] | 15480 | [1–297] | 15530 | [1–454] |
| 15308 | [1–490] | 15356 | [1–500] | 15481 | [1–340] | 15531 | [112–290] |
| 15309 | [1–606] | 15357 | [1–426] | 15482 | [1–476] | 15532 | [1–507] |
| 15310 | [1–511] | 15358 | [1–415] | 15483 | [1–506] | 15533 | [1–272] |
| 15311 | [1–497] | 15359 | [1–413] | 15484 | [1–272],[331–500] | 15534 | [86–463] |
| 15313 | [137–210] | 15360 | [1–416] | 15485 | [1–470] | 15535 | [48–352] |
| 15314 | [113–195] | 15361 | [1–412] | 15486 | [1–512] | 15536 | [1–585] |
| 15315 | [1–490] | 15362 | [1–416] | 15487 | [1–444] | 15537 | [1–515] |
| 15316 | [1–168] | 15363 | [1–433] | 15488 | [1–355] | 15538 | [1–50] |
| 15317 | [113–194] | 15364 | [1–414] | 15489 | [1–352] | 15539 | [1–424] |
| 15318 | [114–166] | 15365 | [1–454] | 15490 | [1–607] | 15540 | [1–499] |
| 15319 | [113–173] | 15366 | [1–425] | 15491 | [1–553] | 15541 | [1–72] |
| 15320 | [113–180] | 15367 | [1–413] | 15492 | [1–465] | 15542 | [1–188] |
| 15321 | [114–215] | 15368 | [1–442] | 15493 | [1–497] | 15543 | [1–184] |
| 15322 | [1–178] | 15369 | [1–549] | 15494 | [1–488] | 15544 | [1–499] |
| 15370 | [1–487] | 15418 | [1–472] | 15495 | [1–485] | 15545 | [1–476] |
| 15371 | [1–501] | 15419 | [1–83],[134–414],[445–504],[544–593] | 15496 | [1–352] | 15546 | [1–358] |
| | | | | 15497 | [1–493] | 15547 | [1–501] |
| 15372 | [1–495] | 15420 | [1–116],[162–280] | 15498 | [1–489] | 15548 | [1–490] |
| 15373 | [1–136] | 15421 | [1–515] | 15499 | [1–477] | 15549 | [1–469] |
| 15374 | [1–420] | 15422 | [1–416] | 15500 | [1–436] | 15550 | [1–508] |
| 15375 | [1–526] | 15423 | [1–479] | 15501 | [1–432] | 15551 | [1–231] |
| 15376 | [1–496] | 15424 | [1–250],[295–462] | 15502 | [1–367] | 15552 | [1–456] |
| 15377 | [1–569] | 15425 | [1–490] | 15503 | [1–516] | 15553 | [1–162] |
| 15378 | [52–189] | 15426 | [1–801] | 15504 | [161–208] | 15554 | [1–242] |
| 15379 | [1–125] | 15427 | [1–216] | 15506 | [1–321],[357–401] | 15555 | [1–406] |
| 15380 | [1–506] | 15428 | [1–495] | 15507 | [1–417] | 15556 | [1–418] |
| 15381 | [1–487] | 15429 | [1–291] | 15508 | [1–383] | 15557 | [1–583] |
| 15382 | [1–413] | 15430 | [1–508] | 15509 | [1–360] | 15558 | [149–276] |
| 15383 | [1–39],[128–491] | 15431 | [1–88],[130–361] | 15510 | [1–261] | 15559 | [1–109] |
| 15385 | [1–71],[117–465] | 15432 | [1–314] | 15511 | [1–400] | 15560 | [1–501] |
| 15386 | [144–172] | 15433 | [1–488] | 15513 | [1–168],[377–444] | 15561 | [1–420] |
| 15387 | [1–274] | 15434 | [1–241] | 15514 | [1–44] | 15562 | [1–387] |
| 15388 | [32–543] | 15435 | [1–410] | 15515 | [1–479] | 15563 | [1–476] |
| 15389 | [33–313] | 15436 | [1–179] | 15516 | [1–343] | 15564 | [1–408] |
| 15390 | [1–417] | 15439 | [78–164] | 15517 | [1–180] | 15565 | [1–307] |
| 15391 | [1–442] | 15440 | [129–163] | 15566 | [1–96] | 15613 | [1–220] |
| 15392 | [1–128] | 15442 | [1–384] | 15567 | [1–476] | 15614 | [1–133],[235–485] |
| 15393 | [1–76],[122–224] | 15443 | [1–200] | 15568 | [121–217] | 15615 | [1–450] |
| 15394 | [1–444] | 15444 | [1–498] | 15569 | [1–407] | 15616 | [1–124] |
| 15395 | [1–482] | 15445 | [1–568] | 15570 | [1–524] | 15617 | [74–372] |
| 15396 | [1–472] | 15446 | [1–477] | 15571 | [49–420] | 15618 | [1–456] |
| 15397 | [1–490] | 15447 | [1–148] | 15572 | [1–577] | 15619 | [1–597] |
| 15398 | [1–431] | 15448 | [1–504] | 15573 | [1–171],[439–580] | 15620 | [1–162] |
| 15399 | [1–486] | 15449 | [1–402] | 15574 | [1–484] | 15621 | [391–462] |
| 15400 | [1–575] | 15450 | [1–483] | 15575 | [1–433] | 15622 | [1–348],[437–566] |
| 15401 | [1–490] | 15451 | [367–511] | 15576 | [1–98],[183–424] | 15623 | [1–504] |
| 15402 | [1–483] | 15452 | [1–377] | 15577 | [1–504] | 15624 | [1–336] |
| 15403 | [1–486] | 15453 | [1–114] | 15578 | [1–821] | 15625 | [1–47] |
| 15404 | [1–275] | 15454 | [1–411] | 15579 | [1–65],[132–446] | 15626 | [205–348] |
| 15405 | [1–216],[245–313] | 15455 | [1–153],[189–540] | 15580 | [1–488] | 15627 | [1–576] |
| 15406 | [1–48] | 15456 | [1–390] | 15581 | [1–389] | 15628 | [1–476] |
| 15407 | [1–295] | 15457 | [1–457] | 15582 | [1–126],[219–243],[347–389] | 15629 | [1–381] |
| 15408 | [1–221] | 15458 | [1–313] | 15583 | [1–519] | 15630 | [37–324] |
| 15409 | [1–166] | 15459 | [1–492] | 15584 | [1–331] | 15631 | [1–503] |
| 15410 | [1–506] | 15460 | [1–410] | 15585 | [57–252],[315–399] | 15632 | [1–63] |
| 15411 | [1–57] | 15461 | [1–378] | 15586 | [1–561] | 15633 | [1–396] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 15587 | [1–195] | 15634 | [1–403] | 15707 | [1–211] | 15792 | [1–99] |
| 15588 | [1–311] | 15635 | [1–507] | 15708 | [1–62] | 15793 | [1–82] |
| 15589 | [1–405] | 15636 | [1–508] | 15794 | [1–97] | 15993 | [1–203] |
| 15590 | [1–513] | 15637 | [1–372] | 15797 | [1–97] | 15994 | [1–197] |
| 15591 | [1–569] | 15638 | [1–419] | 15801 | [1–101] | 15995 | [1–151] |
| 15592 | [1–368] | 15639 | [1–505] | 15802 | [1–541] | 15996 | [1–446] |
| 15593 | [82–393] | 15640 | [1–224] | 15804 | [1–97] | 15997 | [1–151] |
| 15594 | [148–493] | 15641 | [1–510] | 15806 | [1–102] | 15998 | [1–150] |
| 15595 | [1–436] | 15642 | [298–324] | 15816 | [1–100] | 15999 | [1–151] |
| 15596 | [1–443] | 15643 | [1–418] | 15823 | [1–199] | 16000 | [1–153] |
| 15597 | [1–504] | 15644 | [37–78],[177–422] | 15834 | [1–80] | 16001 | [1–151] |
| 15598 | [1–410] | 15645 | [1–322] | 15837 | [1–97] | 16002 | [1–310] |
| 15599 | [1–362] | 15646 | [1–316] | 15843 | [1–98] | 16003 | [1–424] |
| 15600 | [180–446] | 15647 | [1–525] | 15844 | [1–448] | 16004 | [1–498] |
| 15601 | [1–31],[175–246] | 15648 | [1–240] | 15846 | [1–67] | 16005 | [1–369] |
| 15602 | [1–31],[175–246],[343–405] | 15649 | [1–241],[283–466] | 15853 | [1–100] | 16006 | [1–125] |
| 15603 | [1–544] | 15650 | [1–526] | 15855 | [1–151],[319–451] | 16007 | [1–272] |
| 15604 | [1–489] | 15651 | [1–425] | 15856 | [1–97] | 16008 | [1–359] |
| 15605 | [1–214] | 15652 | [60–373] | 15880 | [1–97] | 16009 | [1–292] |
| 15606 | [1–487] | 15654 | [60–371] | 15881 | [1–97] | 16010 | [1–362] |
| 15607 | [1–406] | 15655 | [60–370] | 15885 | [71–127] | 16011 | [1–281] |
| 15608 | [1–500] | 15656 | [60–370] | 15886 | [1–98] | 16012 | [1–329] |
| 15609 | [1–251] | 15657 | [1–467] | 15889 | [1–104] | 16013 | [1–336] |
| 15610 | [1–601] | 15658 | [1–130],[176–202],[320–397] | 15896 | [1–98] | 16014 | [1–306] |
| 15611 | [39–172],[276–317] | 15659 | [1–221] | 15902 | [1–102] | 16015 | [1–339] |
| 15612 | [1–481] | 15660 | [1–215] | 15904 | [1–86] | 16016 | [1–282] |
| 15661 | [1–308] | 15710 | [1–328] | 15908 | [1–101] | 16017 | [1–302] |
| 15663 | [1–207] | 15711 | [1–197],[315–458] | 15909 | [1–98] | 16018 | [1–327] |
| 15664 | [178–210] | 15713 | [1–150] | 15915 | [1–83] | 16019 | [1–359] |
| 15665 | [1–482] | 15714 | [1–489] | 15917 | [1–83] | 16020 | [1–305] |
| 15666 | [1–26] | 15715 | [1–456] | 15919 | [1–75] | 16021 | [1–296] |
| 15667 | [1–324] | 15716 | [1–222] | 15921 | [1–53] | 16022 | [1–297] |
| 15668 | [1–374] | 15717 | [1–409] | 15930 | [1–69] | 16023 | [1–279] |
| 15669 | [1–234] | 15718 | [439–551] | 15931 | [1–97] | 16024 | [1–326] |
| 15670 | [1–464] | 15719 | [1–393] | 15932 | [1–84] | 16025 | [1–458] |
| 15671 | [1–227] | 15720 | [100–178] | 15933 | [1–97] | 16026 | [1–347] |
| 15672 | [1–300] | 15721 | [1–420] | 15936 | [1–97] | 16027 | [1–324] |
| 15673 | [1–560] | 15722 | [103–410] | 15940 | [40–103] | 16028 | [1–315] |
| 15674 | [1–493] | 15723 | [1–26],[181–331] | 15945 | [1–101] | 16029 | [1–282] |
| 15675 | [1–505] | 15724 | [1–36],[191–341] | 15956 | [1–386] | 16030 | [1–307] |
| 15676 | [155–434] | 15725 | [1–178] | 15967 | [1–100] | 16031 | [1–332] |
| 15677 | [1–163] | 15726 | [1–340] | 15968 | [81–108] | 16032 | [1–333] |
| 15678 | [1–402] | 15727 | [1–448] | 15975 | [1–60] | 16033 | [1–297] |
| 15679 | [1–470] | 15728 | [1–184] | 15977 | [1–443] | 16034 | [1–281] |
| 15680 | [1–532] | 15729 | [154–184],[225–471] | 15982 | [1–97] | 16035 | [1–306] |
| 15681 | [1–471] | 15730 | [1–408] | 15986 | [1–98] | 16036 | [1–526] |
| 15682 | [1–122] | 15731 | [1–42],[106–423] | 15990 | [1–439] | 16037 | [1–279] |
| 15683 | [1–239] | 15732 | [1–246] | 15991 | [1–390] | 16038 | [1–335] |
| 15684 | [1–475] | 15733 | [1–179] | 15992 | [1–151] | 16039 | [1–276] |
| 15685 | [1–428],[459–532] | 15734 | [1–476] | 16040 | [1–318] | 16089 | [1–529] |
| 15686 | [1–419] | 15735 | [1–397] | 16041 | [1–338] | 16090 | [1–165] |
| 15687 | [1–428] | 15736 | [1–505] | 16042 | [1–365] | 16091 | [1–302] |
| 15688 | [1–438] | 15737 | [1–271] | 16043 | [1–280] | 16092 | [1–270] |
| 15689 | [204–349] | 15738 | [1–92],[149–263],[433–494] | 16044 | [1–334] | 16093 | [1–200],[318–378] |
| | | | | 16045 | [1–333] | 16094 | [1–572] |
| | | | | 16046 | [1–280] | 16095 | [148–188],[229–280] |
| | | | | 16047 | [1–175] | 16096 | [115–164],[247–288] |
| 15690 | [114–438] | 15739 | [1–423] | 16048 | [1–371] | 16097 | [1–51] |
| 15691 | [1–497] | 15741 | [1–259] | 16049 | [1–296] | 16098 | [1–556] |
| 15692 | [1–386] | 15742 | [1–323] | 16050 | [1–332] | 16099 | [1–65],[246–304] |
| 15693 | [1–587] | 15743 | [1–370] | 16051 | [1–336] | 16100 | [246–331] |
| 15694 | [1–201] | 15744 | [1–380] | 16052 | [1–329] | 16101 | [1–93] |
| 15695 | [1–296] | 15745 | [1–142],[434–503] | 16053 | [1–332] | 16102 | [1–321] |
| 15696 | [1–525] | 15746 | [1–459] | 16054 | [1–281] | 16103 | [1–470] |
| 15697 | [1–466] | 15747 | [70–134] | 16055 | [1–319] | 16104 | [1–569] |
| 15698 | [1–284] | 15748 | [1–623] | 16056 | [1–320] | 16105 | [1–351] |
| 15699 | [1–464] | 15749 | [107–257] | 16057 | [1–306] | 16106 | [1–517] |
| 15700 | [1–372] | 15754 | [1–101] | 16058 | [1–357] | 16107 | [41–83],[295–466] |
| 15701 | [1–118] | 15755 | [1–86] | 16059 | [1–281] | 16108 | [1–272] |
| 15702 | [1–502] | 15760 | [107–273] | 16060 | [1–281] | 16109 | [1–255] |
| 15703 | [1–482] | 15768 | [1–98] | 16061 | [1–335] | 16110 | [1–233] |
| 15704 | [1–503] | 15770 | [1–99] | 16062 | [1–110] | 16111 | [1–271] |
| 15705 | [1–503] | 15773 | [1–101] | 16063 | [96–167] | 16112 | [122–440] |
| 15706 | [1–401] | 15791 | [1–483] | 16064 | [99–450] | 16115 | [82–146] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16065 | [1–227] | 16116 | [1–485] | 16239 | [1–87] | 16288 | [1–246] |
| 16066 | [1–405] | 16117 | [1–528] | 16240 | [1–122] | 16289 | [1–200] |
| 16067 | [1–516] | 16118 | [1–530] | 16241 | [1–317] | 16290 | [1–198] |
| 16068 | [1–234] | 16119 | [1–740] | 16242 | [1–97] | 16291 | [1–249] |
| 16069 | [1–404] | 16120 | [1–327] | 16243 | [1–502] | 16292 | [1–249] |
| 16070 | [1–399] | 16121 | [1–395] | 16244 | [1–401] | 16293 | [1–222] |
| 16071 | [1–26],[194–482] | 16122 | [1–281] | 16245 | [1–496] | 16294 | [1–259] |
| 16073 | [1–75],[131–500] | 16123 | [1–45],[111–272] | 16246 | [1–337] | 16295 | [1–217] |
| 16074 | [125–276] | 16124 | [1–512] | 16248 | [1–57],[88–192],[253–300], [355–514],[561–631] | 16296 | [1–363] |
| 16075 | [1–470] | 16125 | [1–313] | | | 16297 | [1–575] |
| 16076 | [1–219],[303–328] | 16126 | [1–418] | 16249 | [1–63] | 16298 | [1–319] |
| 16077 | [1–191] | 16127 | [1–153],[187–293] | 16250 | [1–56] | 16299 | [1–491] |
| 16078 | [1–357] | 16128 | [1–153],[187–326] | 16251 | [1–63] | 16300 | [1–474] |
| 16079 | [1–430] | 16129 | [1–153],[187–319] | 16252 | [1–203],[321–445] | 16301 | [1–449] |
| 16080 | [1–265] | 16130 | [1–153],[187–301] | 16253 | [1–63] | 16302 | [1–585] |
| 16081 | [1–415] | 16131 | [1–153],[187–323] | 16255 | [1–56] | 16303 | [1–348] |
| 16082 | [1–415] | 16132 | [1–153],[187–306] | 16256 | [1–56] | 16304 | [1–114] |
| 16084 | [1–52] | 16133 | [1–153],[187–310] | 16257 | [1–56] | 16305 | [1–300] |
| 16085 | [1–388] | 16134 | [1–153],[187–310] | 16258 | [1–369] | 16306 | [1–297] |
| 16086 | [1–376] | 16135 | [1–153],[187–341] | 16259 | [1–57] | 16307 | [1–495] |
| 16087 | [1–499] | 16136 | [1–153],[187–347] | 16260 | [1–56] | 16308 | [1–457] |
| 16088 | [1–422] | 16137 | [1–153],[187–348] | 16261 | [1–64] | 16309 | [1–176] |
| 16138 | [1–153],[187–351] | 16186 | [1–431] | 16263 | [1–322] | 16311 | [1–655] |
| 16139 | [1–153],[187–300] | 16187 | [1–144] | 16264 | [61–226] | 16312 | [254–542] |
| 16140 | [1–153],[187–351] | 16188 | [1–407] | 16265 | [1–490] | 16313 | [254–420] |
| 16141 | [1–153],[187–327] | 16190 | [1–96],[263–458] | 16266 | [1–353] | 16314 | [1–415] |
| 16142 | [1–322] | 16191 | [1–477] | 16267 | [1–461] | 16317 | [161–231] |
| 16143 | [1–153],[187–328] | 16192 | [1–488] | 16268 | [1–451] | 16320 | [1–83],[162–242] |
| 16144 | [1–153],[187–328] | 16193 | [1–211] | 16269 | [1–430] | 16324 | [161–242] |
| 16145 | [1–153],[187–354] | 16194 | [1–132] | 16270 | [155–408] | 16325 | [1–155],[288–413] |
| 16146 | [1–479] | 16195 | [1–447] | 16271 | [155–508] | 16326 | [1–389] |
| 16147 | [1–410] | 16196 | [1–493] | 16272 | [169–281] | 16327 | [1–587] |
| 16148 | [1–183] | 16197 | [1–369] | 16273 | [1–450] | 16328 | [1–559] |
| 16149 | [1–393] | 16198 | [1–441] | 16274 | [1–337] | 16329 | [1–489] |
| 16150 | [1–434] | 16199 | [1–478] | 16275 | [1–127] | 16330 | [1–482] |
| 16151 | [1–353] | 16200 | [1–435] | 16276 | [112–459] | 16331 | [1–396] |
| 16152 | [1–110] | 16201 | [1–451] | 16277 | [1–412] | 16332 | [1–504] |
| 16153 | [1–559] | 16202 | [1–492] | 16278 | [1–454] | 16333 | [1–146] |
| 16154 | [1–193] | 16203 | [1–364] | 16279 | [1–459] | 16334 | [1–487] |
| 16155 | [1–498] | 16204 | [1–146] | 16280 | [1–422] | 16335 | [1–493] |
| 16156 | [1–390] | 16205 | [1–467] | 16281 | [1–268] | 16336 | [1–442] |
| 16157 | [1–512] | 16206 | [1–463] | 16282 | [1–506] | 16337 | [1–513] |
| 16158 | [1–476] | 16207 | [1–430] | 16338 | [1–205] | 16387 | [1–391] |
| 16159 | [1–523] | 16208 | [1–444] | 16339 | [1–212] | 16388 | [1–490] |
| 16160 | [1–157] | 16209 | [1–453] | 16340 | [1–241] | 16389 | [80–161] |
| 16161 | [1–201] | 16210 | [1–204] | 16341 | [1–216] | 16390 | [1–440] |
| 16162 | [1–202] | 16211 | [1–393] | 16342 | [1–210] | 16391 | [1–456] |
| 16163 | [1–201] | 16212 | [1–343] | 16343 | [1–219] | 16392 | [1–407] |
| 16164 | [1–201] | 16213 | [1–440] | 16344 | [1–229] | 16393 | [1–406] |
| 16165 | [1–201] | 16214 | [1–478] | 16345 | [1–221] | 16394 | [1–376] |
| 16166 | [1–200] | 16215 | [1–478] | 16346 | [1–239] | 16395 | [1–449] |
| 16167 | [1–202] | 16216 | [1–363] | 16347 | [1–314] | 16396 | [1–141],[217–331], [560–611] |
| 16168 | [1–527] | 16217 | [1–322] | | | | |
| 16170 | [1–409] | 16218 | [1–359] | 16348 | [1–499] | 16397 | [262–472] |
| 16171 | [1–492] | 16219 | [1–348] | 16349 | [1–306] | 16398 | [1–419] |
| 16172 | [1–395] | 16220 | [1–536] | 16350 | [1–447] | 16399 | [1–60],[116–508] |
| 16173 | [1–479] | 16221 | [1–291] | 16351 | [1–304] | 16400 | [1–433] |
| 16174 | [1–333] | 16222 | [1–493] | 16352 | [1–64],[97–416] | 16401 | [1–848] |
| 16175 | [236–342] | 16223 | [230–313] | 16353 | [1–53],[146–289] | 16402 | [1–257] |
| 16176 | [1–81],[229–316] | 16224 | [1–585] | 16354 | [104–139],[253–312], [418–447] | 16403 | [1–421] |
| 16177 | [1–363] | 16225 | [1–112],[427–498] | | | | |
| 16178 | [1–531] | 16226 | [1–184],[220–299] | 16355 | [104–139],[253–436] | 16404 | [1–496] |
| 16179 | [1–403] | 16227 | [1–184],[220–300] | 16356 | [1–534] | 16405 | [1–432] |
| 16180 | [1–494] | 16228 | [1–409] | 16357 | [1–304] | 16407 | [1–180] |
| 16181 | [1–396] | 16229 | [1–416] | 16358 | [1–473] | 16408 | [1–204] |
| 16182 | [1–547] | 16230 | [1–516] | 16359 | [1–494] | 16409 | [1–222] |
| 16183 | [1–99],[288–481] | 16231 | [1–483] | 16360 | [1–432] | 16410 | [1–569] |
| 16184 | [1–409] | 16232 | [1–385] | 16361 | [1–281] | 16411 | [1–526] |
| 16185 | [75–413] | 16233 | [1–161] | 16362 | [1–97] | 16412 | [1–372] |
| 16234 | [1–182] | 16283 | [1–210] | 16363 | [1–506] | 16413 | [1–457] |
| 16235 | [78–312] | 16284 | [1–47],[80–441] | 16364 | [1–457] | 16414 | [1–423] |
| 16236 | [1–598] | 16285 | [1–492] | 16365 | [1–438] | 16415 | [1–402] |
| 16237 | [1–249] | 16286 | [1–202] | 16366 | [1–290] | 16416 | [1–442] |
| 16238 | [1–124] | 16287 | [1–512] | 16367 | [1–315] | 16417 | [1–442] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16368 | [1–391] | 16418 | [1–395] | 16544 | [1–410] | 16592 | [1–506] |
| 16369 | [116–267],[365–452] | 16419 | [1–400] | 16545 | [1–173] | 16593 | [1–187] |
| 16370 | [1–478] | 16420 | [1–403] | 16546 | [1–191] | 16594 | [1–62] |
| 16371 | [1–406] | 16421 | [1–371] | 16547 | [1–168] | 16595 | [1–510] |
| 16372 | [1–449],[486–542] | 16422 | [1–392] | 16548 | [1–170] | 16596 | [1–422] |
| 16373 | [1–515] | 16423 | [1–464] | 16549 | [1–442] | 16597 | [1–574] |
| 16374 | [1–495] | 16424 | [1–413] | 16550 | [1–235] | 16598 | [1–355] |
| 16375 | [1–436] | 16425 | [1–193] | 16551 | [1–201] | 16599 | [1–404] |
| 16376 | [1–491] | 16426 | [1–317] | 16552 | [1–192] | 16600 | [1–110] |
| 16377 | [1–83],[132–364] | 16427 | [1–504] | 16553 | [1–184] | 16601 | [1–487] |
| 16380 | [1–400] | 16428 | [1–317] | 16554 | [1–44],[89–539] | 16602 | [1–275] |
| 16381 | [1–167] | 16429 | [1–295] | 16555 | [1–179] | 16603 | [1–343] |
| 16382 | [1–82] | 16430 | [1–319] | 16556 | [1–231] | 16604 | [1–468] |
| 16383 | [1–497] | 16431 | [1–294] | 16557 | [1–234] | 16605 | [1–72] |
| 16384 | [1–472] | 16432 | [1–293] | 16558 | [1–182] | 16606 | [1–399] |
| 16385 | [1–72] | 16433 | [1–292] | 16559 | [1–233] | 16607 | [1–352] |
| 16386 | [1–490] | 16434 | [1–334] | 16560 | [1–472] | 16608 | [1–348] |
| 16435 | [1–298] | 16484 | [1–441] | 16561 | [1–903] | 16609 | [1–377] |
| 16436 | [1–139] | 16485 | [1–108] | 16562 | [1–436] | 16610 | [1–224] |
| 16437 | [1–379] | 16486 | [1–94],[125–154] | 16563 | [1–438] | 16611 | [1–276] |
| 16438 | [1–384] | 16487 | [1–92] | 16564 | [1–165] | 16612 | [1–440] |
| 16439 | [1–505] | 16488 | [1–568] | 16565 | [1–222] | 16613 | [1–467] |
| 16440 | [1–424] | 16489 | [1–297] | 16566 | [1–381] | 16614 | [1–83],[145–201],[232–285],[346–523] |
| 16441 | [1–474] | 16490 | [1–419] | | | | |
| 16442 | [1–278] | 16491 | [1–297] | 16567 | [1–112] | 16615 | [1–110],[172–228],[259–439] |
| 16444 | [1–492] | 16492 | [1–298] | | | | |
| 16445 | [88–388] | 16493 | [1–189] | 16568 | [1–324],[375–606] | 16616 | [1–434] |
| 16446 | [1–485] | 16494 | [1–296] | 16569 | [1–161] | 16617 | [1–298] |
| 16447 | [1–155],[203–363] | 16495 | [1–297] | 16570 | [1–186],[219–469] | 16618 | [1–469] |
| 16448 | [1–489] | 16496 | [1–298] | 16571 | [134–333],[393–445] | 16619 | [1–111],[141–452] |
| 16449 | [1–413],[446–486] | 16497 | [1–513] | 16572 | [1–461] | 16620 | [1–116],[146–326] |
| 16450 | [1–71],[122–274] | 16498 | [1–513] | 16573 | [178–222] | 16621 | [1–96] |
| 16451 | [56–93] | 16499 | [1–503] | 16574 | [1–495] | 16622 | [248–431] |
| 16452 | [192–355] | 16500 | [1–503] | 16575 | [1–471] | 16623 | [1–60] |
| 16453 | [122–175] | 16501 | [1–503] | 16576 | [34–300] | 16624 | [1–458] |
| 16454 | [122–203] | 16502 | [1–429] | 16577 | [34–403] | 16625 | [1–488] |
| 16455 | [48–115] | 16503 | [1–61] | 16578 | [1–458] | 16626 | [1–473] |
| 16456 | [164–192] | 16504 | [1–305] | 16580 | [1–127],[219–342] | 16627 | [1–490] |
| 16457 | [48–115] | 16505 | [1–439] | 16581 | [1–256],[295–356] | 16628 | [1–334] |
| 16458 | [48–115],[148–204] | 16506 | [43–484] | 16629 | [71–325] | 16676 | [1–398],[428–609] |
| 16459 | [1–166],[251–374] | 16507 | [1–555] | 16630 | [1–381] | 16677 | [1–387] |
| 16460 | [1–198],[332–486] | 16508 | [1–477] | 16631 | [1–340] | 16678 | [1–394] |
| 16461 | [1–521] | 16509 | [1–362] | 16632 | [192–239] | 16679 | [1–216] |
| 16462 | [1–495] | 16510 | [1–169] | 16633 | [1–259] | 16680 | [1–113],[230–290] |
| 16463 | [372–454] | 16511 | [58–509] | 16634 | [1–182] | 16681 | [1–531] |
| 16464 | [1–473] | 16512 | [1–421] | 16635 | [1–399] | 16682 | [1–571] |
| 16465 | [1–441] | 16514 | [1–193] | 16636 | [1–129],[320–460] | 16684 | [229–361] |
| 16466 | [1–489] | 16515 | [1–198] | 16637 | [1–443] | 16685 | [85–112] |
| 16468 | [49–131],[180–271] | 16516 | [1–197] | 16638 | [330–402] | 16686 | [85–146] |
| 16469 | [69–160] | 16517 | [1–403] | 16639 | [1–367] | 16688 | [85–145] |
| 16470 | [1–392] | 16518 | [52–446] | 16640 | [1–361] | 16689 | [85–120] |
| 16471 | [1–486] | 16519 | [1–382] | 16641 | [1–482] | 16690 | [84–118] |
| 16472 | [1–113],[230–290] | 16520 | [1–465] | 16642 | [1–464] | 16691 | [85–145] |
| 16473 | [1–462] | 16521 | [1–304] | 16643 | [1–67] | 16692 | [83–164] |
| 16474 | [1–415] | 16522 | [1–126] | 16644 | [1–348] | 16694 | [85–111] |
| 16475 | [1–448] | 16524 | [1–374] | 16645 | [1–414] | 16695 | [85–146] |
| 16476 | [1–124] | 16525 | [1–413] | 16646 | [1–293],[446–488] | 16696 | [81–127] |
| 16477 | [1–98],[129–162] | 16526 | [1–496] | 16647 | [1–373] | 16697 | [1–394] |
| 16478 | [1–119] | 16528 | [1–59],[120–439] | 16648 | [1–466] | 16698 | [1–472] |
| 16479 | [1–95] | 16529 | [1–430] | 16649 | [1–359] | 16699 | [81–498] |
| 16480 | [1–104] | 16530 | [1–59],[120–470] | 16650 | [1–381] | 16700 | [1–513] |
| 16481 | [1–134] | 16531 | [1–59],[120–503] | 16651 | [1–516] | 16701 | [1–155] |
| 16482 | [1–137] | 16532 | [1–350] | 16652 | [1–436] | 16702 | [1–498] |
| 16483 | [1–154] | 16533 | [1–422] | 16653 | [1–518] | 16703 | [1–241] |
| 16534 | [1–159] | 16582 | [1–382] | 16654 | [342–375] | 16704 | [1–481] |
| 16535 | [1–193] | 16583 | [315–488] | 16655 | [1–367] | 16705 | [1–366] |
| 16536 | [1–213] | 16584 | [1–130] | 16656 | [1–430] | 16706 | [1–189],[257–330],[379–408] |
| 16537 | [1–194] | 16585 | [1–447] | | | | |
| 16538 | [1–185] | 16586 | [57–157] | 16657 | [1–545],[576–877] | 16707 | [1–369] |
| 16539 | [1–187] | 16587 | [1–365] | 16658 | [1–121] | 16708 | [93–326] |
| 16540 | [1–190] | 16588 | [1–381] | 16659 | [1–457] | 16709 | [1–162],[238–484] |
| 16541 | [1–165] | 16589 | [1–499] | 16660 | [1–188],[314–463] | 16710 | [1–189],[257–413] |
| 16542 | [1–188] | 16590 | [1–421] | 16661 | [1–475] | 16711 | [1–189],[257–430] |
| 16543 | [1–168] | 16591 | [1–515] | 16662 | [1–348],[419–452] | 16712 | [379–425] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16663 | [1–475] | 16713 | [1–160] | 16835 | [1–291] | 16885 | [1–514] |
| 16664 | [1–285] | 16714 | [1–329],[378–407] | 16836 | [1–267] | 16886 | [1–470] |
| 16665 | [1–375] | 16715 | [1–443] | 16837 | [1–459] | 16887 | [1–602] |
| 16666 | [1–488] | 16716 | [1–496] | 16839 | [1–526] | 16888 | [1–85] |
| 16667 | [1–528] | 16717 | [141–176] | 16840 | [1–515] | 16889 | [108–342] |
| 16668 | [1–472] | 16718 | [1–527] | 16841 | [1–343] | 16890 | [1–431] |
| 16669 | [1–435] | 16719 | [1–303] | 16842 | [1–460] | 16891 | [1–69] |
| 16670 | [1–234],[330–550] | 16720 | [1–488] | 16843 | [1–200],[318–458] | 16892 | [171–298] |
| 16671 | [1–519] | 16721 | [52–152] | 16844 | [1–417] | 16893 | [45–379] |
| 16672 | [1–479] | 16722 | [1–39],[70–214] | 16845 | [1–501] | 16894 | [1–513] |
| 16673 | [1–529] | 16723 | [1–485] | 16846 | [1–471] | 16895 | [1–496] |
| 16674 | [1–527] | 16724 | [1–458] | 16847 | [1–197] | 16896 | [1–561] |
| 16675 | [1–395] | 16725 | [1–373] | 16848 | [1–432] | 16897 | [1–347] |
| 16726 | [1–581] | 16774 | [1–256] | 16849 | [1–495] | 16898 | [36–540] |
| 16727 | [1–339] | 16775 | [1–359] | 16850 | [1–429] | 16899 | [1–473] |
| 16728 | [1–492] | 16776 | [1–132] | 16851 | [1–843] | 16900 | [1–681] |
| 16729 | [1–44],[291–381] | 16777 | [1–253] | 16852 | [1–449] | 16901 | [1–368] |
| 16730 | [1–76],[231–344] | 16778 | [1–135] | 16854 | [202–323],[384–409] | 16902 | [1–50],[89–576] |
| 16731 | [1–176] | 16779 | [1–185] | 16855 | [1–517] | 16903 | [1–366] |
| 16732 | [1–55],[176–433] | 16780 | [1–134] | 16856 | [1–275] | 16904 | [1–286],[316–397],[431–456] |
| 16733 | [1–316] | 16781 | [1–157] | | | | |
| 16734 | [1–130] | 16782 | [1–129] | 16857 | [1–478] | 16905 | [1–527] |
| 16735 | [1–331] | 16783 | [1–140] | 16858 | [196–418] | 16906 | [1–431] |
| 16736 | [1–298] | 16784 | [1–190] | 16859 | [1–436] | 16907 | [1–451] |
| 16737 | [1–527] | 16785 | [1–139] | 16860 | [1–419] | 16908 | [1–449] |
| 16738 | [1–128] | 16786 | [1–140] | 16861 | [43–167],[287–445] | 16909 | [1–349] |
| 16739 | [1–82] | 16787 | [1–36],[129–213] | 16862 | [1–284] | 16910 | [1–40] |
| 16740 | [1–85],[118–146] | 16788 | [1–26],[128–157] | 16863 | [1–430] | 16911 | [1–435] |
| 16741 | [1–292] | 16789 | [1–131],[322–455] | 16864 | [1–57],[255–436] | 16912 | [1–472] |
| 16742 | [1–565] | 16790 | [1–577],[608–639] | 16865 | [1–400] | 16913 | [1–439] |
| 16743 | [1–342] | 16791 | [1–77],[112–280] | 16866 | [1–302] | 16914 | [1–449] |
| 16744 | [1–432] | 16792 | [1–71],[324–382] | 16868 | [1–122] | 16915 | [1–510] |
| 16745 | [1–536] | 16793 | [1–78],[113–281] | 16869 | [1–156] | 16916 | [1–193] |
| 16746 | [1–402] | 16794 | [1–482] | 16870 | [1–168] | 16917 | [1–503] |
| 16747 | [1–461] | 16795 | [1–429] | 16918 | [1–445] | 16981 | [215–242] |
| 16748 | [1–474] | 16796 | [1–423] | 16919 | [1–505] | 16982 | [1–236] |
| 16749 | [1–503] | 16797 | [1–426] | 16920 | [292–478] | 16983 | [1–277] |
| 16750 | [1–530] | 16798 | [1–108] | 16921 | [1–491] | 16985 | [1–162] |
| 16751 | [77–625],[753–794] | 16799 | [1–176] | 16922 | [1–526] | 16986 | [216–242] |
| 16752 | [78–350] | 16800 | [1–134] | 16923 | [1–531] | 16987 | [215–253] |
| 16753 | [1–490] | 16801 | [1–175] | 16924 | [1–154] | 16988 | [1–74],[213–256] |
| 16754 | [1–488] | 16802 | [1–175] | 16925 | [1–219] | 16989 | [215–283] |
| 16755 | [49–431] | 16803 | [1–174] | 16926 | [1–235] | 16990 | [216–241] |
| 16757 | [1–248] | 16804 | [1–175] | 16927 | [1–224] | 16991 | [215–254] |
| 16758 | [38–222] | 16805 | [1–214] | 16929 | [1–97] | 16992 | [1–161] |
| 16759 | [1–180] | 16806 | [1–241] | 16930 | [1–75] | 16993 | [216–242] |
| 16760 | [1–191] | 16807 | [1–175] | 16931 | [1–75] | 16996 | [1–237] |
| 16761 | [1–525] | 16808 | [1–447] | 16932 | [1–74],[215–272] | 16997 | [216–242] |
| 16762 | [1–514] | 16809 | [100–457] | 16933 | [1–266] | 16998 | [1–237] |
| 16763 | [1–474] | 16810 | [1–69],[307–400] | 16934 | [1–23]] | 17000 | [1–372] |
| 16764 | [1–247],[325–498] | 16811 | [1–528] | 16935 | [1–236] | 17003 | [1–235] |
| 16765 | [1–330] | 16812 | [1–190] | 16936 | [1–74],[213–269] | 17004 | [1–97] |
| 16766 | [185–233] | 16813 | [1–266] | 16937 | [1–75] | 17005 | [216–241] |
| 16767 | [427–470] | 16814 | [1–214] | 16939 | [1–162] | 17008 | [216–243] |
| 16768 | [1–304] | 16815 | [1–55],[91–574] | 16940 | [1–79] | 17010 | [213–241] |
| 16769 | [50–464] | 16816 | [1–34],[171–506] | 16941 | [1–236] | 17011 | [93–474] |
| 16770 | [1–358] | 16817 | [1–455] | 16942 | [1–75],[216–243] | 17012 | [1–97] |
| 16771 | [1–412] | 16818 | [242–290] | 16943 | [1–236] | 17013 | [1–162] |
| 16772 | [1–542] | 16819 | [151–270] | 16945 | [1–162] | 17014 | [1–236] |
| 16773 | [1–389] | 16820 | [1–524] | 16946 | [215–253] | 17015 | [216–242] |
| 16821 | [1–559] | 16871 | [1–182] | 16947 | [1–528] | 17016 | [215–240] |
| 16822 | [1–504] | 16872 | [1–179] | 16948 | [1–153],[221–425] | 17018 | [1–75] |
| 16823 | [1–73],[145–531] | 16873 | [1–233] | 16950 | [215–250] | 17019 | [215–254] |
| 16824 | [1–371] | 16874 | [1–461] | 16952 | [216–242] | 17020 | [1–75] |
| 16825 | [1–405] | 16875 | [1–122] | 16953 | [1–161] | 17022 | [215–253] |
| 16826 | [1–448] | 16876 | [35–183] | 16954 | [215–253] | 17023 | [1–237] |
| 16827 | [1–417] | 16877 | [1–454] | 16955 | [1–162] | 17025 | [1–75] |
| 16828 | [316–499] | 16878 | [1–583] | 16958 | [216–242] | 17027 | [1–161] |
| 16829 | [1–476] | 16879 | [1–209] | 16959 | [1–93],[209–387] | 17029 | [1–162] |
| 16830 | [158–450] | 16880 | [1–25],[86–548] | 16960 | [1–74] | 17030 | [216–242] |
| 16831 | [1–310] | 16881 | [1–602] | 16962 | [1–232] | 17032 | [1–491] |
| 16832 | [1–349] | 16882 | [1–424] | 16965 | [208–293] | 17033 | [215–254] |
| 16833 | [1–140] | 16883 | [1–313] | 16969 | [1–160] | 17034 | [1–236] |
| 16834 | [1–141] | 16884 | [1–293],[438–482] | 16970 | [1–162] | 17035 | [1–162] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 16972 | [216–243] | 17036 | [1–161] | 17173 | [1–407] | 17220 | [1–158],[198–535] |
| 16973 | [1–161],[215–241] | 17039 | [216–247] | 17174 | [1–347] | 17221 | [1–565] |
| 16974 | [215–244] | 17040 | [1–74] | 17175 | [223–477] | 17222 | [1–571] |
| 16975 | [216–243] | 17042 | [216–242] | 17176 | [1–853] | 17223 | [1–362] |
| 16976 | [1–75] | 17043 | [1–75],[158–487] | 17177 | [41–498] | 17225 | [1–285] |
| 16978 | [215–253] | 17044 | [1–220] | 17178 | [117–142] | 17226 | [1–462] |
| 16980 | [1–234] | 17046 | [216–242] | 17179 | [1–571] | 17227 | [1–126] |
| 17047 | [1–161],[215–241] | 17106 | [1–92] | 17180 | [1–165] | 17228 | [1–377] |
| 17048 | [30–161],[214–253] | 17107 | [1–246],[326–477] | 17181 | [1–433] | 17229 | [1–65],[204–382] |
| 17049 | [215–270] | 17108 | [1–411] | 17182 | [1–159] | 17232 | [1–391] |
| 17051 | [1–161] | 17109 | [1–332] | 17183 | [1–109] | 17233 | [1–387] |
| 17052 | [1–161] | 17110 | [1–139] | 17184 | [1–137] | 17235 | [1–422] |
| 17053 | [216–245] | 17111 | [229–402] | 17185 | [1–110] | 17236 | [1–286] |
| 17054 | [1–500] | 17112 | [1–449] | 17186 | [1–354] | 17237 | [1–463] |
| 17055 | [1–75] | 17113 | [1–510] | 17187 | [1–339] | 17238 | [1–134],[308–415] |
| 17056 | [215–253] | 17114 | [71–143],[340–389] | 17188 | [1–323] | 17239 | [1–276] |
| 17057 | [1–76] | 17115 | [1–458] | 17189 | [1–491] | 17240 | [1–324] |
| 17062 | [1–174] | 17116 | [1–136] | 17190 | [1–98],[278–375] | 17241 | [35–455],[493–523] |
| 17063 | [215–253] | 17117 | [1–91] | 17191 | [1–450] | 17242 | [1–329] |
| 17064 | [1–256] | 17118 | [1–147],[226–507] | 17192 | [1–527] | 17243 | [1–510] |
| 17066 | [216–242] | 17119 | [1–426] | 17193 | [1–443] | 17244 | [1–468] |
| 17067 | [217–261] | 17120 | [1–421] | 17194 | [1–519] | 17245 | [94–194],[250–424] |
| 17069 | [1–236] | 17121 | [1–255],[370–471] | 17195 | [1–261] | 17246 | [1–318] |
| 17070 | [1–236] | 17122 | [1–452] | 17196 | [1–348] | 17247 | [261–311] |
| 17071 | [1–174],[217–241] | 17123 | [149–312] | 17197 | [1–565] | 17248 | [1–384] |
| 17072 | [1–235] | 17124 | [1–426] | 17198 | [1–54] | 17249 | [1–457] |
| 17073 | [216–242] | 17125 | [1–562] | 17199 | [1–430] | 17250 | [32–291] |
| 17074 | [215–253] | 17126 | [120–410] | 17251 | [1–274] | 17299 | [1–438] |
| 17076 | [1–487] | 17127 | [1–505] | 17252 | [1–164],[206–443] | 17300 | [1–325] |
| 17077 | [215–253] | 17128 | [1–379] | 17253 | [1–560] | 17301 | [1–130] |
| 17078 | [1–235] | 17129 | [1–415] | 17254 | [1–433] | 17302 | [1–209] |
| 17081 | [1–236] | 17130 | [1–547] | 17255 | [73–194] | 17303 | [1–235] |
| 17084 | [1–418] | 17131 | [1–470] | 17256 | [1–722] | 17304 | [1–348] |
| 17085 | [1–249] | 17132 | [1–520] | 17257 | [1–447] | 17305 | [1–456] |
| 17086 | [1–513] | 17133 | [1–371] | 17258 | [1–479] | 17306 | [1–442] |
| 17087 | [1–43],[94–223] | 17134 | [1–510] | 17259 | [1–34] | 17307 | [1–235],[468–499] |
| 17088 | [1–308] | 17135 | [1–476] | 17260 | [1–480] | 17308 | [1–137] |
| 17089 | [1–487] | 17136 | [1–474] | 17262 | [1–536] | 17309 | [51–149],[301–478] |
| 17090 | [1–506] | 17137 | [1–447] | 17263 | [1–466] | 17310 | [1–124] |
| 17091 | [1–214] | 17138 | [1–346] | 17264 | [1–212],[299–454] | 17313 | [1–181] |
| 17092 | [1–256] | 17139 | [1–503] | 17265 | [1–489] | 17314 | [1–471] |
| 17093 | [1–508] | 17140 | [1–374] | 17266 | [1–472] | 17315 | [1–412] |
| 17094 | [1–414] | 17141 | [1–123] | 17267 | [1–544] | 17316 | [1–520] |
| 17095 | [1–235] | 17142 | [1–75],[183–258] | 17268 | [1–384],[415–443],[478–555] | 17318 | [1–84] |
| 17096 | [1–261] | 17143 | [1–169] | | | | |
| 17097 | [1–83] | 17144 | [1–133] | 17269 | [1–586] | 17319 | [1–526] |
| 17098 | [1–72] | 17145 | [1–144] | 17270 | [116–464] | 17320 | [1–250] |
| 17099 | [1–449] | 17146 | [1–149] | 17271 | [222–294] | 17321 | [87–490] |
| 17100 | [1–710] | 17147 | [1–147] | 17272 | [1–366] | 17322 | [90–253] |
| 17101 | [1–482] | 17148 | [1–144] | 17273 | [1–199] | 17323 | [1–425] |
| 17102 | [175–534] | 17149 | [1–146] | 17274 | [1–321] | 17324 | [1–498] |
| 17103 | [1–434] | 17150 | [1–505] | 17275 | [1–473] | 17325 | [1–517] |
| 17104 | [1–442] | 17151 | [1–149] | 17276 | [1–222] | 17326 | [1–396] |
| 17105 | [1–542] | 17152 | [1–114] | 17277 | [1–191] | 17327 | [1–542] |
| 17153 | [65–269] | 17200 | [1–248] | 17278 | [1–486] | 17328 | [1–77],[111–207],[247–441],[549–595] |
| 17154 | [1–498] | 17201 | [1–401] | | | | |
| 17155 | [1–449] | 17202 | [1–364] | 17279 | [1–421] | 17329 | [1–541] |
| 17156 | [1–43],[129–356] | 17203 | [1–414] | 17280 | [1–524] | 17330 | [1–334],[473–683],[917–1137],[1267–1549] |
| 17157 | [1–515] | 17204 | [1–398] | | | | |
| 17158 | [1–576] | 17205 | [1–369] | 17281 | [1–448] | | |
| 17159 | [1–441] | 17206 | [1–465] | 17282 | [1–223] | 17331 | [1–346] |
| 17160 | [75–502] | 17207 | [1–580] | 17283 | [1–468] | 17332 | [1–492] |
| 17161 | [293–417] | 17208 | [1–450] | 17284 | [1–499] | 17333 | [1–447] |
| 17162 | [1–416] | 17209 | [1–510] | 17285 | [1–512] | 17334 | [1–499] |
| 17163 | [1–520] | 17210 | [1–478] | 17286 | [1–53] | 17335 | [1–437] |
| 17164 | [192–501] | 17211 | [1–462] | 17287 | [1–369] | 17336 | [1–411] |
| 17165 | [1–147],[226–474] | 17212 | [103–447] | 17288 | [1–510] | 17337 | [1–447] |
| 17166 | [1–477] | 17213 | [1–373] | 17289 | [1–460] | 17338 | [1–169] |
| 17167 | [1–591] | 17214 | [1–423] | 17290 | [1–559] | 17339 | [1–354],[384–481] |
| 17168 | [1–473] | 17215 | [1–404] | 17291 | [1–450] | 17340 | [1–536] |
| 17169 | [1–396] | 17216 | [1–343],[389–439] | 17292 | [1–415] | 17341 | [1–204],[239–443] |
| 17170 | [1–506] | 17217 | [1–432] | 17293 | [1–471] | 17342 | [1–171],[205–392] |
| 17171 | [1–564] | 17218 | [1–157] | 17294 | [1–403] | 17343 | [1–301] |
| 17172 | [1–431] | 17219 | [1–400] | 17295 | [1–217] | 17344 | [1–249] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 17296 | [1–344] | 17345 | [1–391] | 17469 | [1–65],[242–356] | 17517 | [1–492] |
| 17297 | [1–330] | 17346 | [1–417] | 17470 | [1–365] | 17518 | [1–578] |
| 17298 | [1–488] | 17347 | [1–470] | 17471 | [282–550] | 17519 | L1–512] |
| 17348 | [1–116],[224–672] | 17396 | [1–464] | 17472 | [1–113] | 17520 | [1–104],[225–394] |
| 17349 | [1–543] | 17398 | [1–457] | 17473 | [154–246] | 17521 | [1–567] |
| 17350 | [1–257] | 17399 | [1–532] | 17474 | [1–440] | 17522 | [1–561] |
| 17352 | [1–476] | 17400 | [1–493] | 17475 | [1–460] | 17523 | [1–415] |
| 17353 | [51–414] | 17401 | [1–560] | 17476 | [1–318] | 17524 | [1–305],[434–458] |
| 17354 | [1–502] | 17402 | [1–620] | 17477 | [1–67] | 17525 | [1–580] |
| 17355 | [1–402] | 17403 | [1–412] | 17478 | [1–55] | 17526 | [1–514] |
| 17356 | [1–507] | 17404 | [1–285] | 17479 | [1–536] | 17527 | [1–487] |
| 17357 | [1–291] | 17405 | [1–398] | 17480 | [1–416] | 17528 | [1–209] |
| 17358 | [1–503] | 17406 | [86–386] | 17481 | [1–523] | 17529 | [68–381] |
| 17359 | [1–482] | 17407 | [1–174] | 17482 | [1–466] | 17530 | [1–425] |
| 17360 | [1–483] | 17408 | [1–375] | 17483 | [1–300] | 17531 | [139–449] |
| 17361 | [1–468] | 17409 | [1–547] | 17484 | [1–491] | 17532 | [1–236] |
| 17362 | [1–328] | 17410 | [1–321],[426–473] | 17485 | [1–470] | 17533 | [1–517] |
| 17363 | [1–535] | 17411 | [1–452] | 17486 | [1–490] | 17534 | [1–485] |
| 17364 | [1–416] | 17412 | [1–240] | 17487 | [1–415] | 17535 | [1–243] |
| 17365 | [1–472] | 17413 | [1–223] | 17488 | [1–612] | 17536 | [1–352] |
| 17366 | [1–87] | 17414 | [1–225] | 17489 | [1–432] | 17537 | [179–278],[340–589] |
| 17367 | [1–437] | 17415 | [1–228] | 17490 | [244–317] | 17538 | [333–483] |
| 17368 | [1–460] | 17416 | [1–225] | 17491 | [1–362] | 17539 | [1–544] |
| 17369 | [1–267],[544–591] | 17417 | [1–225] | 17540 | [1–394] | 17588 | [1–480] |
| 17370 | [1–443] | 17418 | [1–224] | 17541 | [102–251],[383–424] | 17589 | [1–194] |
| 17371 | [1–66],[162–250] | 17419 | [1–225] | 17542 | [1–481] | 17590 | [1–364] |
| 17372 | [1–50] | 17420 | [1–225] | 17543 | [1–400] | 17591 | [1–478] |
| 17373 | [1–502] | 17421 | [1–225] | 17544 | [1–468] | 17592 | [1–475] |
| 17374 | [1–34],[87–479] | 17422 | [1–225] | 17545 | [1–257] | 17593 | [1–68],[294–472] |
| 17375 | [1–501] | 17423 | [1–224] | 17546 | [1–502] | 17594 | [1–344] |
| 17376 | [1–434] | 17424 | [184–504] | 17547 | [1–293] | 17595 | [1–503] |
| 17377 | [1–441] | 17425 | [507–578] | 17548 | [102–147],[383–437] | 17596 | [40–106],[162–439] |
| 17378 | [1–222],[408–504] | 17426 | [1–432] | 17549 | [37–405] | 17597 | [1–412] |
| 17379 | [1–111] | 17427 | [56–399] | 17550 | [1–460] | 17598 | [1–385] |
| 17380 | [1–446] | 17429 | [1–249] | 17551 | [1–393] | 17599 | [1–639] |
| 17381 | [1–116] | 17430 | [33–337] | 17552 | [1–165] | 17600 | [1–487] |
| 17382 | [1–488] | 17431 | [1–391] | 17553 | [1–432] | 17601 | [1–41],[100–425] |
| 17383 | [1–481] | 17432 | [1–427] | 17554 | [1–251] | 17602 | [1–329] |
| 17384 | [1–474] | 17433 | [1–391] | 17555 | [1–378] | 17604 | [1–352] |
| 17385 | [52–149] | 17434 | [1–82] | 17556 | [1–186] | 17605 | [65–435] |
| 17386 | [80–481] | 17435 | [1–448] | 17557 | [1–416] | 17606 | [1–504] |
| 17387 | [1–480] | 17436 | [1–353] | 17558 | [1–369] | 17607 | [104–228] |
| 17388 | [1–318] | 17437 | [1–81],[141–497] | 17559 | [1–250] | 17608 | [223–261] |
| 17389 | [1–304] | 17438 | [1–507] | 17560 | [1–822] | 17610 | [223–269] |
| 17390 | [1–232] | 17439 | [1–447] | 17561 | [1–424] | 17611 | [1–345] |
| 17391 | [1–28],[144–376] | 17440 | [1–383] | 17562 | [1–433] | 17612 | [1–204] |
| 17392 | [1–221] | 17441 | [1–404] | 17563 | [1–40],[82–260] | 17613 | [71–441] |
| 17393 | [101–333] | 17442 | [1–131] | 17564 | [1–435] | 17614 | [1–442] |
| 17394 | [1–579] | 17443 | [1–349] | 17565 | [1–284] | 17615 | [50–169] |
| 17395 | [1–97] | 17444 | [1–118] | 17566 | [1–224],[321–390] | 17616 | [1–458] |
| 17445 | [1–471] | 17492 | [1–379] | 17567 | [1–325] | 17618 | [1–476] |
| 17446 | [1–141] | 17493 | [1–382] | 17568 | [1–442] | 17619 | [1–199] |
| 17447 | [1–148] | 17494 | [1–467] | 17569 | [1–628] | 17620 | [1–462] |
| 17448 | [1–159] | 17495 | [1–407] | 17570 | [59–281] | 17621 | [1–597] |
| 17449 | [1–140] | 17496 | [1–483] | 17571 | [1–283],[329–547] | 17622 | [1–249] |
| 17450 | [1–148] | 17497 | [1–281] | 17572 | [1–390] | 17623 | [61]–221] |
| 17451 | [1–153] | 17498 | [1–521] | 17573 | [1–70] | 17624 | [1–243] |
| 17452 | [1–144] | 17499 | [1–403] | 17574 | [1–1157] | 17625 | [1–81],[115–215] |
| 17453 | [1–131] | 17500 | [1–92] | 17576 | [1–421] | 17626 | [1–279] |
| 17454 | [1–129] | 17501 | [1–103] | 17577 | [1–554] | 17627 | [1–367] |
| 17455 | [1–130] | 17502 | [1–137] | 17578 | [1–80],[112–183] | 17628 | [1–33],[65–107], [227–397],[436–700] |
| 17456 | [1–346] | 17503 | [1–126] | | | | |
| 17457 | [1–140] | 17504 | [1–492] | 17579 | [105–253] | 17629 | [1–388] |
| 17458 | [1–596] | 17506 | [1–92] | 17580 | [1–336] | 17630 | [1–381] |
| 17459 | [1–478] | 17507 | [1–530] | 17581 | [1–556] | 17631 | [1–443] |
| 17460 | [1–466] | 17508 | [1–367],[402–446] | 17582 | [1–224] | 17632 | [1–145] |
| 17461 | [1–454] | 17509 | [1–514] | 17583 | [1–341] | 17633 | [1–510] |
| 17462 | [1–364] | 17510 | [1–120] | 17584 | [61–247] | 17634 | [1–471] |
| 17463 | [1–477] | 17511 | [1–522] | 17585 | [1–239] | 17635 | [1–440] |
| 17464 | [1–874] | 17512 | [1–546] | 17586 | [1–379] | 17636 | [162–461] |
| 17465 | [80–147],[181–424] | 17513 | [181–483] | 17587 | [1–472] | 17637 | [1–340] |
| 17466 | [1–167] | 17514 | [1–415] | 17638 | [1–518] | 17687 | [1–382] |
| 17467 | [144–176] | 17515 | [144–490] | 17639 | [1–534] | 17688 | [1–491] |
| 17468 | [1–521] | 17516 | [1–444] | 17640 | [1–667] | 17689 | [1–476] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 17641 | [1–351] | 17690 | [1–140],[172–439] | 17766 | [1–364] | 17813 | [1–434] |
| 17642 | [1–459] | 17691 | [1–348] | 17767 | [1–298] | 17814 | [1–481] |
| 17643 | [1–515] | 17692 | [1–447] | 17768 | [1–210],[247–336],[367–431] | 17815 | [1–573] |
| 17644 | [1–66] | 17693 | [1–446] | 17769 | [1–510] | 17816 | [1–384] |
| 17645 | [1–64] | 17694 | [1–32],[94–216] | 17770 | [1–491] | 17817 | [78–123],[326–495] |
| 17646 | [1–537] | 17695 | [1–428] | 17771 | [1–455] | 17818 | [1–296] |
| 17647 | [1–501] | 17696 | [1–59] | 17772 | [1–418] | 17819 | [1–355] |
| 17648 | [1–159] | 17697 | [1–249] | 17773 | [1–486] | 17820 | [1–65],[242–542] |
| 17649 | [1–140] | 17698 | [1–245] | 17774 | [1–257],[373–413] | 17821 | [1–269] |
| 17650 | [1–593] | 17699 | [1–153] | 17775 | [1–195] | 17822 | [1–204] |
| 17651 | [1–604] | 17700 | [1–531] | 17776 | [1–285] | 17823 | [30–204],[265–449] |
| 17652 | [1–333] | 17701 | [1–232] | 17777 | [1–123] | 17824 | [119–211] |
| 17653 | [1–98] | 17702 | [158–448] | 17778 | [1–458] | 17825 | [1–246] |
| 17654 | [1–322] | 17703 | [1–387] | 17779 | [1–498] | 17826 | [168–193] |
| 17655 | [1–396] | 17704 | [1–274] | 17780 | [120–335] | 17827 | [1–444] |
| 17656 | [1–487] | 17705 | [1–474] | 17781 | [1–348] | 17828 | [1–329] |
| 17657 | [31–170] | 17706 | [1–143] | 17782 | [1–392] | 17829 | [1–464] |
| 17658 | [86–127],[214–511] | 17707 | [1–536] | 17830 | [1–229] | 17877 | [1–201] |
| 17659 | [1–475] | 17708 | [1–449] | 17831 | [1–388] | 17878 | [1–512] |
| 17660 | [1–314] | 17709 | [1–404] | 17832 | [1–396] | 17879 | [1–420] |
| 17661 | [1–400] | 17710 | [1–230] | 17833 | [1–445] | 17880 | [1–114] |
| 17662 | [1–443] | 17711 | [1–489] | 17834 | [1–515] | 17881 | [1–504] |
| 17663 | [1–399] | 17712 | [1–566] | 17835 | [1–414] | 17882 | [1–636] |
| 17664 | [1–404] | 17713 | [1–220] | 17836 | [1–377] | 17883 | [1–472] |
| 17665 | [1–200] | 17714 | [1–483] | 17837 | [1–308] | 17884 | [1–386] |
| 17666 | [1–509] | 17715 | [1–223] | 17838 | [1–451] | 17885 | [1–432] |
| 17667 | [1–483] | 17716 | [1–500] | 17839 | [1–381] | 17886 | [1–508] |
| 17668 | [1–416] | 17717 | [1–173],[310–383] | 17840 | [1–421] | 17887 | [1–433] |
| 17669 | [1–255] | 17718 | [74–324] | 17841 | [1–416] | 17888 | [1–196],[240–494] |
| 17670 | [1–286] | 17719 | [1–375] | 17842 | [1–428] | 17889 | [1–478] |
| 17671 | [1–493] | 17720 | [1–265] | 17843 | [1–377] | 17890 | [1–462] |
| 17672 | [56–382] | 17721 | [118–448] | 17844 | [1–432] | 17891 | [1–183] |
| 17673 | [1–500] | 17722 | [1–398] | 17845 | [1–257] | 17892 | [1–86],[301–426] |
| 17674 | [1–495] | 17723 | [1–35],[161–405] | 17846 | [1–387] | 17893 | [1–399] |
| 17675 | [1–435] | 17724 | [1–499] | 17847 | [1–343] | 17894 | [32–519] |
| 17676 | [1–475] | 17725 | [1–497] | 17848 | [1–577] | 17895 | [1–43],[127–315] |
| 17678 | [1–154] | 17726 | [1–60] | 17849 | [1–173] | 17896 | [1–255],[294–424] |
| 17680 | [1–273],[350–433] | 17727 | [1–406] | 17850 | [1–347] | 17897 | [1–162],[332–448] |
| 17681 | [64–497] | 17728 | [1–490] | 17851 | [1–355] | 17898 | [1–484] |
| 17682 | [64–510] | 17729 | [1–267] | 17852 | [1–585] | 17899 | [1–501] |
| 17683 | [1–160] | 17730 | [1–322] | 17853 | [1–562] | 17900 | [1–288] |
| 17684 | [1–139] | 17731 | [1–438] | 17854 | [1–711] | 17901 | [1–402] |
| 17685 | [1–410] | 17732 | [1–137],[241–500] | 17855 | [1–182] | 17902 | [1–380] |
| 17686 | [1–220] | 17734 | [1–486] | 17856 | [1–436] | 17903 | [1–483] |
| 17735 | [1–499] | 17783 | [1–469] | 17857 | [1–405] | 17904 | [1–258] |
| 17736 | [1–68] | 17784 | [1–212] | 17858 | [247–334] | 17905 | [1–453] |
| 17737 | [1–382] | 17785 | [1–481] | 17859 | [1–397] | 17906 | [1–435] |
| 17738 | [1–512] | 17786 | [1–441] | 17860 | [1–307] | 17907 | [1–299] |
| 17739 | [1–516] | 17787 | [1–483] | 17861 | [1–435] | 17908 | [1–464] |
| 17740 | [1–491] | 17788 | [1–433] | 17862 | [1–414] | 17909 | [1–295] |
| 17741 | [1–362] | 17789 | [282–343] | 17863 | [1–127] | 17910 | [1–447] |
| 17742 | [1–502] | 17790 | [59–424] | 17864 | [1–395] | 17912 | [1–500] |
| 17743 | [1–102] | 17791 | [1–501] | 17865 | [1–65] | 17913 | [1–117] |
| 17744 | [1–149] | 17792 | [50–383] | 17866 | [1–361] | 17914 | [1–107] |
| 17745 | [1–432] | 17793 | [57–517] | 17867 | [1–408] | 17915 | [1–481] |
| 17746 | [1–459] | 17794 | [1–253] | 17868 | [1–223] | 17916 | [1–546] |
| 17747 | [1–97] | 17795 | [1–419] | 17869 | [45–349] | 17917 | [1–512] |
| 17748 | [1–401] | 17796 | [1–364] | 17870 | [1–122] | 17918 | [1–293] |
| 17749 | [1–300] | 17797 | [1–504] | 17871 | [1–283] | 17919 | [1–207] |
| 17750 | [1–410] | 17798 | [1–50] | 17872 | [1–275] | 17920 | [1–215] |
| 17751 | [1–495] | 17799 | [1–525] | 17873 | [1–470] | 17921 | [1–246] |
| 17753 | [1–163],[280–477] | 17800 | [1–448] | 17874 | [1–379] | 17922 | [1–218] |
| 17754 | [74–342],[459–488] | 17801 | [1–506] | 17875 | [1–357] | 17923 | [1–266] |
| 17755 | [64–475] | 17802 | [1–459] | 17876 | [1–442] | 17924 | [1–241] |
| 17756 | [1–380] | 17803 | [1–413] | 17925 | [1–262] | 17972 | [1–336] |
| 17757 | [1–399] | 17804 | [1–477] | 17926 | [1–259] | 17973 | [1–503] |
| 17758 | [1–217],[402–517] | 17805 | [1–426] | 17927 | [1–270] | 17974 | [1–472] |
| 17759 | [1–236] | 17806 | [1–365] | 17928 | [1–217] | 17975 | [1–447] |
| 17760 | [1–495] | 17807 | [1–314] | 17929 | [1–235] | 17976 | [1–480] |
| 17761 | [1–522] | 17808 | [1–432] | 17930 | [1–225] | 17977 | [1–435] |
| 17762 | [1–384] | 17809 | [1–441] | 17931 | [1–248] | 17978 | [1–427] |
| 17763 | [1–490] | 17810 | [1–66],[297–374] | 17932 | [1–225] | 17979 | [1–508] |
| 17764 | [34–448] | 17811 | [75–217],[259–435] | 17933 | [1–226] | 17980 | [1–510] |
| 17765 | [1–505] | 17812 | [1–404] | | | | |

TABLE IVb-continued (Novelty: 100%)

| Seq Id No. | Positions of preferred fragments | Seq Id No. | Positions of preferred fragments |
|---|---|---|---|
| 17934 | [1–218] | 17981 | [1–464] |
| 17935 | [1–228] | 17982 | [1–55],[91–442] |
| 17936 | [1–241] | 17983 | [1–178] |
| 17937 | [1–242] | 17984 | [1–532] |
| 17938 | [1–247] | 17985 | [1–456] |
| 17939 | [1–243] | 17986 | [1–63] |
| 17940 | [1–243] | 17987 | [1–138] |
| 17941 | [1–237] | 17988 | [1–304] |
| 17942 | [1–236] | 17989 | [1–381] |
| 17943 | [1–248] | 17990 | [1–212] |
| 17944 | [1–214] | 17991 | [1–387] |
| 17945 | [1–245] | 17993 | [1–439] |
| 17946 | [1–216] | 17994 | [1–469] |
| 17947 | [1–225] | 17995 | [1–461] |
| 17948 | [1–229] | 17996 | [1–352] |
| 17949 | [1–219] | 17997 | [181–287] |
| 17950 | [1–520] | 17998 | [1–147] |
| 17951 | [1–444] | 17999 | [1–317] |
| 17952 | [44–489] | 18000 | [1–446] |
| 17953 | [1–495] | 18001 | [1–417] |
| 17954 | [1–437] | 18002 | [1–514] |
| 17955 | [1–538] | 18003 | [1–293] |
| 17956 | [1–219] | 18004 | [1–510] |
| 17957 | [1–487] | 18005 | [1–302] |
| 17958 | [1–400] | 18006 | [1–322] |
| 17959 | [1–440] | 18007 | [1–431] |
| 17960 | [144–302],[437–478] | 18008 | [1–484] |
| 17961 | [1–427] | 18009 | [1–472] |
| 17962 | [1–202] | 18010 | [1–198] |
| 17963 | [1–43],[108–364] | 18011 | [1–497] |
| 17964 | [1–43],[108–360] | 18012 | [1–189] |
| 17965 | [1–43],[108–378] | 18013 | [1–375] |
| 17966 | [1–43],[108–516] | 18014 | [1–124],[208–337] |
| 17967 | [1–468] | 18015 | [1–484] |
| 17968 | [1–63] | 18016 | [1–442] |
| 17969 | [1–412] | 18017 | [1–71] |
| 17970 | [1–232] | 18018 | [1–167] |
| 17971 | [1–68] | 18019 | [1–174] |
| 18020 | [1–278] | 18069 | [1–54] |
| 18021 | [1–502] | 18070 | [1–427] |
| 18022 | [1–59] | 18071 | [1–160] |
| 18023 | [1–64] | 18072 | [130–250],[422–450] |
| 18024 | [1–505] | 18073 | [1–518] |
| 18025 | [1–341] | 18074 | [1–198] |
| 18026 | [1–451] | 18075 | [1–120] |
| 18027 | [1–181] | 18076 | [1–209] |
| 18028 | [1–187] | 18077 | [144–304] |
| 18029 | [1–425] | 18078 | [1–483] |
| 18031 | [1–521] | 18079 | [1–33] |
| 18032 | [1–424] | 18080 | [1–458] |
| 18033 | [1–474] | 18081 | [1–512] |
| 18034 | [1–191] | 18082 | [1–217] |
| 18035 | [1–206] | 18083 | [63–475] |
| 18036 | [1–381] | 18084 | [1–114] |
| 18037 | [1–208] | 18085 | [1–42],[87–220] |
| 18038 | [1–67] | 18086 | [63–456] |
| 18039 | [1–145] | 18087 | [1–335] |
| 18040 | [1–389] | 18088 | [1–407] |
| 18041 | [1–245] | 18089 | [1–259] |
| 18042 | [1–406] | 18090 | [1–87] |
| 18043 | [1–462] | 18091 | [63–270] |
| 18044 | [1–91] | 18092 | [1–480] |
| 18045 | [1–86] | 18093 | [128–426] |
| 18046 | [1–433] | 18094 | [1–473] |
| 18047 | [1–400] | 18095 | [1–448] |
| 18048 | [1–106] | 18096 | [1–193] |
| 18049 | [1–318] | 18097 | [1–189] |
| 18050 | [1–363] | 18098 | [1–160],[238–411] |
| 18051 | [1–235] | 18099 | [58–103] |
| 18052 | [1–454] | 18100 | [1–312] |
| 18053 | [1–477] | 18101 | [41–441] |
| 18054 | [1–179] | 18102 | [1–63] |
| 18055 | [1–74] | 18103 | [64–311] |
| 18056 | [1–125] | 18104 | [1–64] |
| 18058 | [1–153] | 18105 | [1–458] |
| 18059 | [75–218],[282–477] | 18106 | [175–233],[319–428] |
| 18060 | [1–552] | 18107 | [1–620] |
| 18061 | [1–392] | 18108 | [1–825] |
| 18062 | [1–195] | 18109 | [1–96] |
| 18063 | [1–364] | 18110 | [1–553] |
| 18064 | [1–443] | 18111 | [1–482] |
| 18065 | [1–109] | 18112 | [1–424] |
| 18066 | [1–160] | 18113 | [1–507] |
| 18067 | [91–393] | 18114 | [173–338] |
| 18068 | [1–162] | 18115 | [1–497] |
| 18116 | [1–467] | 18163 | [1–44],[149–348] |
| 18117 | [1–175] | 18164 | [1–44],[148–344] |
| 18118 | [1–270] | 18165 | [1–44],[148–320] |
| 18119 | [1–509] | 18166 | [1–45],[149–321] |
| 18120 | [1–403] | 18167 | [167–266] |
| 18121 | [1–493] | 18168 | [1–44],[148–356] |
| 18122 | [1–62] | 18169 | [1–44],[148–320] |
| 18123 | [1–366] | 18170 | [1–88],[160–196],[397–423] |
| 18124 | [1–69] | 18171 | [1–46],[150–357] |
| 18125 | [1–372] | 18172 | [1–86] |
| 18126 | [164–201],[368–4]2] | 18173 | [1–331] |
| 18127 | [1–268],[327–488] | 18174 | [1–46],[95–240],[276–469],[501–631] |
| 18128 | [1–169],[252–292] | 18175 | [1–178] |
| 18129 | [1–486] | 18176 | [1–406] |
| 18130 | [1–192] | 18177 | [1–325] |
| 18131 | [1–314] | 18178 | [192–498] |
| 18132 | [1–191],[221–519] | 18179 | [1–353] |
| 18133 | [1–394] | 18180 | [1–364] |
| 18134 | [1–68] | 18181 | [1–494] |
| 18135 | [1–387] | 18182 | [1–363] |
| 18136 | [1–63],[102–259],[345–446] | 18183 | [1–333] |
| 18137 | [1–445] | 18184 | [1–196] |
| 18138 | [1–410] | 18185 | [1–203] |
| 18139 | [1–45],[149–356] | 18186 | [1–189] |
| 18140 | [1–72] | 18187 | [51–202] |
| 18141 | [1–336] | 18188 | [83–367] |
| 18142 | [1–44],[171–319] | 18189 | [1–249] |
| 18143 | [1–44],[149–375] | 18190 | [1–492] |
| 18144 | [1–45],[150–321] | 18191 | [1–493] |
| 18145 | [1–44],[148–350] | 18192 | [1–296] |
| 18146 | [1–44],[148–344] | 18193 | [1–495] |
| 18147 | [1–322] | 18194 | [1–420] |
| 18148 | [163–200],[268–403] | 18195 | [1–266] |
| 18149 | [1–113],[148–362] | 18196 | [1–537] |
| 18150 | [1–44],[148–343] | 18197 | [1–437] |
| 18151 | [1–44],[149–365] | 18198 | [1–436] |
| 18152 | [1–72],[142–199] | 18199 | [50–476] |
| 18153 | [1–44],[172–357] | 18200 | [33–256] |
| 18154 | [1–44],[148–340] | 18201 | [1–250] |
| 18155 | [1–44],[149–360] | 18202 | [1–247] |
| 18156 | [1–45],[150–350] | 18203 | [1–207] |
| 18157 | [1–44],[148–348] | 18204 | [1–345] |
| 18158 | [156–221],[271–406] | 18205 | [33–336] |
| 18159 | [1–44],[148–348] | 18206 | [33–512] |
| 18160 | [1–44],[149–361] | 18207 | [33–339] |
| 18161 | [1–44],[149–362] | 18208 | [33–428] |
| 18162 | [1–44],[149–320] | 18209 | [33–418] |
| 18210 | [1–487] | 18260 | [1–467] |
| 18211 | [1–244] | 18261 | [1–577] |
| 18212 | [1–442] | 18262 | [1–430] |
| 18213 | [1–263] | 18263 | [1–445] |
| 18214 | [1–419] | 18264 | [1–551] |
| 18215 | [33–448] | 18265 | [1–513] |
| 18216 | [33–219] | 18266 | [1–546] |
| 18217 | [33–365] | 18267 | [1–476] |
| 18218 | [1–555] | 18268 | [1–106] |
| 18219 | [1–466] | 18269 | [1–403] |
| 18220 | [85–172] | 18270 | [1–270] |
| 18221 | [1–254] | 18271 | [1–385] |
| 18222 | [1–430] | 18272 | [1–318] |
| 18223 | [1–505] | 18273 | [1–387] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 18224 | [1–343] | 18274 | [1–169] | 18348 | [1–440] | 18396 | [1–348] |
| 18225 | [1–306] | 18275 | [1–592] | 18349 | [1–71] | 18397 | [1–258],[298–361] |
| 18226 | [1–538] | 18276 | [1–453] | 18350 | [1–544] | 18398 | [66–448] |
| 18227 | [1–546] | 18277 | [1–204] | 18351 | [1–465] | 18399 | [1–439] |
| 18228 | [1–409] | 18278 | [63–371] | 18352 | [1–464] | 18400 | [90–183] |
| 18229 | [1–461] | 18279 | [1–365] | 18353 | [1–244] | 18401 | [1–96] |
| 18231 | [70–395] | 18280 | [1–397] | 18354 | [1–495] | 18402 | [1–356] |
| 18232 | [1–71] | 18281 | [1–204] | 18355 | [1–503] | 18403 | [1–137] |
| 18233 | [1–436] | 18282 | [1–438] | 18404 | [1–391] | 18451 | [54–353] |
| 18235 | [1–418] | 18283 | [1–559] | 18405 | [1–533] | 18452 | [54–282] |
| 18236 | [1–337] | 18284 | [84–363] | 18406 | [1–145] | 18453 | [1–215] |
| 18237 | [1–661] | 18285 | [1–446] | 18407 | [1–187] | 18454 | [159–235],[339–373] |
| 18238 | [1–457] | 18286 | [1–86],[187–355] | 18408 | [1–503] | 18455 | [1–406] |
| 18239 | [1–453] | 18287 | [1–151] | 18409 | [1–315] | 18456 | [1–421] |
| 18240 | [162–293] | 18288 | [1–433] | 18410 | [1–499] | 18457 | [1–55] |
| 18241 | [1–402] | 18289 | [1–418] | 18411 | [1–369] | 18458 | [1–148] |
| 18242 | [1–413] | 18290 | [1–368] | 18412 | [1–50],[377–408] | 18460 | [1–338] |
| 18243 | [1–396] | 18291 | [1–387] | 18413 | [159–389] | 18461 | [1–107] |
| 18244 | [1–509] | 18292 | [1–354] | 18414 | [1–340] | 18462 | [1–56] |
| 18245 | [1–200],[230–418] | 18293 | [39–439] | 18415 | [1–367] | 18463 | [1–462] |
| 18246 | [1–380],[441–540] | 18294 | [1–400] | 18416 | [1–377] | 18465 | [1–414] |
| 18248 | [1–148] | 18295 | [1–340] | 18417 | [1–522] | 18466 | [1–398] |
| 18249 | [1–383] | 18296 | [1–465] | 18418 | [1–483] | 18467 | [1–394] |
| 18250 | [1–472] | 18297 | [1–426] | 18419 | [1–547] | 18468 | [1–289] |
| 18251 | [1–581] | 18298 | [1–128] | 18420 | [1–97] | 18469 | [1–439] |
| 18252 | [1–414] | 18299 | [1–73],[157–425] | 18421 | [1–228] | 18470 | [1–412] |
| 18253 | [1–429] | 18300 | [1–494] | 18422 | [1–102] | 18471 | [1–410] |
| 18254 | [1–513] | 18302 | [1–239] | 18423 | [1–476] | 18472 | [1–440] |
| 18255 | [1–407] | 18303 | [1–519] | 18424 | [1–412] | 18473 | [1–417] |
| 18256 | [1–153] | 18304 | [1–535] | 18425 | [1–478] | 18474 | [1–426] |
| 18257 | [1–438] | 18305 | [1–512] | 18426 | [1–143] | 18475 | [1–271] |
| 18258 | [1–341] | 18306 | [1–438] | 18427 | [1–64] | 18476 | [1–324] |
| 18259 | [1–496] | 18307 | [1–115] | 18428 | [1–186] | 18477 | [1–237] |
| 18308 | [1–100],[192–349],[419–503] | 18356 | [1–518] | 18429 | [1–509] | 18478 | [39–478] |
| 18309 | [1–426] | 18357 | [1–165] | 18430 | [1–427] | 18479 | [1–46] |
| 18310 | [1–380] | 18358 | [131–240],[400–521] | 18431 | [1–93] | 18480 | [1–46] |
| 18311 | [1–168] | 18359 | [1–424] | 18432 | [78–115] | 18481 | [1–326] |
| 18312 | [1–444] | 18360 | [1–404] | 18433 | [78–134] | 18482 | [1–437] |
| 18313 | [1–452] | 18361 | [137–224] | 18434 | [78–137] | 18483 | [1–353] |
| 18314 | [1–422] | 18362 | [64–141] | 18435 | [1–55] | 18484 | [1–102] |
| 18315 | [1–362] | 18363 | [1–250] | 18436 | [60–358] | 18485 | [1–472] |
| 18316 | [1–472] | 18364 | [39–389] | 18437 | [1–96],[253–414] | 18486 | [1–577] |
| 18318 | [1–301] | 18365 | [39–315] | 18438 | [1–61] | 18487 | [1–493] |
| 18319 | [1–590] | 18366 | [36–358] | 18439 | [1–129],[259–443] | 18488 | [1–286] |
| 18320 | [1–478] | 18367 | [1–203] | 18440 | [1–269] | 18489 | [1–435] |
| 18321 | [1–154] | 18368 | [1–183] | 18441 | [1–464] | 18490 | [1–405] |
| 18322 | [1–436] | 18369 | [1–111] | 18442 | [1–518] | 18491 | [1–680] |
| 18323 | [1–517] | 18370 | [35–401] | 18443 | [1–377] | 18492 | [1–553] |
| 18324 | [1–461] | 18371 | [1–183] | 18444 | [1–387] | 18493 | [1–216] |
| 18325 | [1–402] | 18372 | [1–285] | 18445 | [1–275] | 18494 | [55–101],[162–407] |
| 18326 | [39–109] | 18373 | [1–279] | 18446 | [1–278] | 18495 | [124–447] |
| 18327 | [1–139] | 18374 | [1–58] | 18447 | [1–216] | 18496 | [46–465] |
| 18328 | [1–242] | 18375 | [1–172] | 18448 | [1–396] | 18497 | [1–469] |
| 18329 | [1–276] | 18376 | [1–202] | 18449 | [1–425] | 18498 | [1–422] |
| 18330 | [1–261] | 18377 | [1–116] | 18450 | [54–353] | 18500 | [1–508] |
| 18331 | [1–283] | 18378 | [1–460] | 18501 | [1–476] | 18548 | [1–509] |
| 18332 | [1–191] | 18379 | [1–437] | 18502 | [1–473] | 18549 | [1–93],[136–194],[255–563] |
| 18333 | [1–173] | 18380 | [1–492] | 18503 | [1–445] | 18550 | [45–105],[164–457] |
| 18334 | [1–98] | 18381 | [1–498] | 18504 | [1–289] | 18551 | [1–462] |
| 18335 | [1–473] | 18382 | [1–250] | 18505 | [1–554] | 18552 | [1–472] |
| 18336 | [329–468] | 18384 | [1–103],[134–159] | 18506 | [146–446] | 18553 | [1–350] |
| 18337 | [1–552] | 18385 | [1–97] | 18507 | [1–563] | 18554 | [1–247],[356–459] |
| 18338 | [1–237] | 18386 | [1–478] | 18508 | [1–485] | 18555 | [1–509] |
| 18339 | [1–206],[435–490] | 18387 | [175–244] | 18509 | [1–505] | 18556 | [1–567] |
| 18340 | [1–172],[218–592] | 18388 | [1–497] | 18510 | [1–510] | 18557 | [1–467] |
| 18341 | [1–413] | 18389 | [1–485] | 18511 | [1–488] | 18558 | [1–513] |
| 18342 | [1–72] | 18390 | [1–166] | 18512 | [1–564] | 18559 | [1–515] |
| 18343 | [1–60] | 18391 | [1–95] | 18513 | [1–450] | 18560 | [1–511] |
| 18344 | [1–115] | 18392 | [1–427] | 18514 | [1–523] | 18561 | [1–377] |
| 18345 | [1–478] | 18393 | [1–388] | 18515 | [1–190] | 18562 | [1–541] |
| 18346 | [1–391] | 18394 | [1–65],[101–432] | 18516 | [1–541] | 18563 | [1–378] |
| 18347 | [1–55],[146–190],[267–351] | 18395 | [1–392] | 18517 | [1–259],[321–387] | 18564 | [1–427] |
|  |  |  |  | 18518 | [1–513] | 18566 | [167–449] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 18519 | [1–259],[371–416] | 18567 | [1–495] | 18641 | [1–540] | 18689 | [1–399] |
| 18520 | [1–487] | 18568 | [1–414] | 18642 | [1–313] | 18690 | [1–368] |
| 18521 | [1–471] | 18569 | [1–352] | 18643 | [1–459] | 18691 | [1–70] |
| 18522 | [1–400] | 18570 | [1–359] | 18692 | [1–373] | 18758 | [1–109] |
| 18523 | [1–403] | 18571 | [1–397] | 18693 | [1–137] | 18759 | [1–3 1],[125–343],[389–426] |
| 18524 | [1–406],[468–508] | 18572 | [1–359] | | | | |
| 18525 | [1–461] | 18573 | [1–388] | 18694 | [1–94],[222–337] | 18760 | [1–461] |
| 18526 | [1–402],[464–507] | 18574 | [51–400] | 18695 | [1–81] | 18761 | [1–70] |
| 18527 | [1–404] | 18575 | [1–341] | 18696 | [1–161] | 18762 | [140–249],[325–487] |
| 18528 | [1–450] | 18576 | [1–499] | 18697 | [1–66],[194–255] | 18763 | [1–44],[110–405] |
| 18529 | [1–432] | 18577 | [1–497] | 18701 | [1–177],[228–393] | 18764 | [1–94],[174–220],[294–359] |
| 18530 | [1–393] | 18578 | [1–494] | | | | |
| 18531 | [1–400] | 18579 | [295–427] | 18704 | [1–178],[225–385] | 18765 | [1–182],[255–376] |
| 18532 | [1–407],[469–493] | 18580 | [53–266] | 18706 | [1–525] | 18766 | [94–367] |
| 18533 | [1–404],[466–492] | 18581 | [37–507] | 18707 | [1–94] | 18768 | [1–68] |
| 18534 | [1–401] | 18582 | [1–364] | 18709 | [1–93],[139–218],[292–388] | 18769 | [1–216],[327–404] |
| 18535 | [1–59] | 18583 | [1–231],[274–434] | | | | |
| 18536 | [1–401] | 18584 | [1–205] | 18710 | [1–236] | 18770 | [1–59] |
| 18537 | [1–403] | 18585 | [1–386] | 18711 | [1–94],[140–232],[322–387] | 18771 | [1–266] |
| 18538 | [1–360],[422–478] | 18586 | [1–67] | | | | |
| 18539 | [1–400] | 18587 | [1–180] | 18715 | [1–94],[140–204] | 18772 | [1–97],[225–271],[326–391] |
| 18540 | [1–401] | 18588 | [1–193] | | | | |
| 18541 | [1–425] | 18589 | [1–147] | 18716 | [1–314] | 18773 | [95–361],[413–457] |
| 18542 | [1–400] | 18590 | [1–498] | 18717 | [1–94] | 18774 | [1–228],[302–339] |
| 18543 | [1–475] | 18591 | [1–452] | 18718 | [1–62] | 18775 | [1–71] |
| 18544 | [1–416] | 18592 | [1–584] | 18719 | [1–69] | 18777 | [1–109] |
| 18545 | [1–472] | 18593 | [1–288] | 18720 | [1–235] | 18778 | [1–94] |
| 18546 | [1–402] | 18594 | [1–450] | 18721 | [1–341] | 18779 | [1–390] |
| 18547 | [1–434] | 18595 | [52–510] | 18722 | [1–94] | 18780 | [94–346] |
| 18596 | [1–422] | 18644 | [1–30],[73–179] | 18725 | [1–94] | 18781 | [1–93] |
| 18597 | [1–437] | 18645 | [105–477] | 18726 | [1–486] | 18783 | [1–94] |
| 18598 | [1–406] | 18647 | [1–335] | 18727 | [1–50] | 18784 | [1–66] |
| 18599 | [1–531] | 18648 | [171–282] | 18728 | [84–110],[173–221] | 18786 | [1–67] |
| 18600 | [1–516] | 18649 | [1–516] | 18730 | [1–63] | 18787 | [1–67] |
| 18601 | [1–496] | 18650 | [1–263] | 18731 | [1–44],[84–110],[225–403] | 18788 | [140–229] |
| 18602 | [1–314] | 18651 | [1–518] | 18732 | [1–70] | 18789 | [94–435] |
| 18603 | [1–433] | 18652 | [1–507] | 18733 | [1–63] | 18791 | [1–527] |
| 18604 | [1–419] | 18653 | [250–397] | 18734 | [1–70] | 18792 | [1–466] |
| 18605 | [1–176] | 18654 | [117–218] | 18735 | [31–374] | 18793 | [1–510] |
| 18606 | [1–208] | 18655 | [1–284] | 18736 | [1–89],[170–384] | 18794 | [1–453] |
| 18607 | [1–85],[121–396] | 18656 | [1–159] | 18737 | [1–109] | 18795 | [1–465] |
| 18608 | [1–469] | 18657 | [1–727] | 18740 | [31–406] | 18796 | [1–503] |
| 18609 | [46–168] | 18658 | [1–180] | 18742 | [1–63] | 18797 | [1–444] |
| 18610 | [136–190],[246–417] | 18659 | [1–431] | 18743 | [231–255] | 18798 | [1–482] |
| 18612 | [1–346] | 18660 | [67–411] | 18745 | [227–289] | 18799 | [1–403] |
| 18613 | [228–293],[354–480] | 18661 | [1–209] | 18746 | [1–93] | 18800 | [1–506] |
| 18614 | [1–410] | 18662 | [1–501] | 18747 | [1–51] | 18801 | [1–600] |
| 18615 | [1–269] | 18663 | [1–485] | 18748 | [1–64] | 18802 | [73–245],[423–499] |
| 18616 | [1–517] | 18664 | [37–389] | 18749 | [1–181],[296–431] | 18803 | [97–204],[445–487] |
| 18617 | [1–500] | 18665 | [1–348] | 18750 | [1–93],[220–247] | 18804 | [1–83] |
| 18618 | [1–508] | 18666 | [1–83],[212–483] | 18752 | [1–365] | 18805 | [1–490] |
| 18619 | [1–483] | 18667 | [1–83],[212–403] | 18753 | [1–50] | 18806 | [1–447] |
| 18620 | [1–63] | 18668 | [1–512] | 18754 | [111–221],[295–319] | 18807 | [1–447] |
| 18621 | [1–492] | 18669 | [1–174],[216–297] | 18756 | [1–304],[350–386] | 18808 | [1–495] |
| 18622 | [1–470] | 18670 | [1–463] | 18757 | [1–44],[84–389] | 18810 | [1–297] |
| 18623 | [1–437] | 18671 | [1–332],[394–421] | 18811 | [1–87] | 18862 | [1–501] |
| 18624 | [1–28],[138–331],[362–479] | 18672 | [38–315] | 18812 | [1–506] | 18863 | [1–353] |
| | | | | 18813 | [1–484] | 18864 | [1–132] |
| 18625 | [1–28],[137–405] | 18673 | [37–314] | 18814 | [1–176],[208–896] | 18865 | [186–228] |
| 18626 | [108–325] | 18674 | [1–270] | 18815 | [1–509] | 18866 | [1–177] |
| 18627 | [109–331] | 18675 | [1–493] | 18816 | [1–561] | 18867 | [1–446] |
| 18628 | [1–474] | 18676 | [1–179] | 18817 | [1–487] | 18869 | [1–716] |
| 18629 | [108–307] | 18677 | [1–405] | 18818 | [1–504] | 18870 | [1–250] |
| 18630 | [1–493] | 18678 | [104–357] | 18819 | [1–533] | 18871 | [1–238] |
| 18631 | [118–222],[424–471] | 18679 | [1–474] | 18820 | [1–440] | 18872 | [1–269] |
| 18632 | [1–160],[300–441] | 18680 | [1–498] | 18821 | [1–593] | 18873 | [1–300] |
| 18633 | [62–442] | 18681 | [1–501] | 18825 | [1–490] | 18874 | [1–490] |
| 18634 | [62–160],[300–441] | 18682 | [1–458] | 18826 | [1–402] | 18875 | [1–482] |
| 18635 | [1–104] | 18683 | [1–377] | 18827 | [1–433] | 18876 | [105–425] |
| 18636 | [1–433] | 18684 | [1–354] | 18828 | [43–445] | 18877 | [1–501] |
| 18637 | [1–489] | 18685 | [1–509] | 18830 | [1–282] | 18878 | [1–476] |
| 18638 | [1–332] | 18686 | [1–360] | 18831 | [1–399],[486–522] | 18879 | [1–319] |
| 18639 | [1–405] | 18687 | [1–510] | 18832 | [1–522] | 18880 | [1–463],[498–563] |
| 18640 | [157–474] | 18688 | [1–503] | 18833 | [40–445] | 18881 | [1–460] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 18834 | [101–394] | 18882 | [1–461] | 18956 | [1–790] | 19003 | [1–354] |
| 18835 | [1–532] | 18883 | [1–485] | 18957 | [1–517] | 19004 | [1–415] |
| 18836 | [1–464] | 18884 | [1–496] | 18958 | [1–1030] | 19005 | [1–407] |
| 18837 | [1–188] | 18885 | [253–936] | 19006 | [1–701] | 19053 | [1–450] |
| 18838 | [1–265] | 18886 | [1–138],[207–410] | 19007 | [1–508] | 19054 | [1–482] |
| 18839 | [1–374] | 18887 | [1–49],[110–138] | 19008 | [1–478] | 19055 | [176–465] |
| 18840 | [1–439] | 18889 | [1–449] | 19009 | [1–508] | 19056 | [1–337] |
| 18841 | [1–452] | 18890 | [1–467] | 19010 | [1–436] | 19057 | [1–465] |
| 18842 | [1–225] | 18891 | [1–170] | 19011 | [1–481] | 19058 | [1–478] |
| 18843 | [1–438] | 18892 | [1–524] | 19012 | [1–142],[288–483] | 19059 | [1–468] |
| 18844 | [1–141],[173–208],[305–412] | 18893 | [1–250] | 19013 | [1–216],[289–448] | 19060 | [1–132],[170–384] |
| 18845 | [1–494] | 18894 | [1–409] | 19014 | [1–51],[289–428] | 19061 | [1–403] |
| 18846 | [1–401] | 18895 | [1–426] | 19015 | [1–51] | 19062 | [1–500] |
| 18847 | [1–352] | 18896 | [1–284] | 19016 | [1–67] | 19063 | [1–472] |
| 18848 | [1–416] | 18897 | [60–89],[136–344] | 19017 | [1–484] | 19064 | [1–515] |
| 18849 | [1–489] | 18898 | [1–154],[189–218],[265–301] | 19018 | [1–142] | 19065 | [1–396] |
|  |  |  |  | 19019 | [1–428] | 19066 | [1–413] |
|  |  |  |  | 19020 | [1–451] | 19067 | [1–381] |
| 18850 | [1–80] | 18899 | [1–35],[89–378] | 19021 | [1–325] | 19068 | [1–580] |
| 18851 | [1–357] | 18900 | [1–351] | 19022 | [1–490] | 19069 | [1–526] |
| 18852 | [1–360] | 18901 | [1–507] | 19023 | [97–350],[388–509] | 19070 | [1–501] |
| 18853 | [1–360] | 18903 | [1–479] | 19024 | [97–350],[388–514] | 19071 | [1–436] |
| 18854 | [1–377] | 18904 | [256–304] | 19025 | [1–501] | 19072 | [1–412] |
| 18855 | [1–382] | 18905 | [1–51] | 19026 | [1–293] | 19073 | [1–426] |
| 18856 | [1–383] | 18906 | [1–155] | 19027 | [1–470] | 19074 | [1–489] |
| 18857 | [1–427] | 18907 | [1–155] | 19028 | [1–69],[110–440] | 19075 | [1–433] |
| 18858 | [1–391] | 18908 | [179–424] | 19029 | [1–550] | 19076 | [1–87],[239–465] |
| 18859 | [1–485] | 18909 | [1–51] | 19030 | [1–470] | 19077 | [1–518] |
| 18860 | [1–335] | 18910 | [1–150],[214–361] | 19031 | [1–531] | 19078 | [1–423] |
| 18861 | [1–453] | 18911 | [1–42],[129–381] | 19032 | [1–505] | 19079 | [1–387] |
| 18912 | [1–52] | 18959 | [1–38],[237–419] | 19033 | [1–252] | 19080 | [1–586] |
| 18913 | [1–44],[131–273] | 18960 | [1–324] | 19034 | [1–253] | 19081 | [1–507] |
| 18914 | [1–51] | 18961 | [1–379] | 19035 | [1–447] | 19082 | [1–468] |
| 18915 | [1–41],[128–333] | 18962 | [1–403] | 19036 | [131–368] | 19083 | [1–481] |
| 18916 | [1–447] | 18963 | [1–384] | 19037 | [72–516] | 19084 | [1–429] |
| 18917 | [1–506] | 18964 | [1–527] | 19038 | [238–426] | 19085 | [1–474] |
| 18918 | [1–215] | 18965 | [1–458] | 19039 | [57–580] | 19086 | [1–192] |
| 18919 | [1–485] | 18966 | [1–516] | 19040 | [1–309] | 19087 | [1–516] |
| 18920 | [1–52] | 18967 | [128–281] | 19041 | [1–70] | 19088 | [1–471] |
| 18921 | [1–411] | 18968 | [1–496] | 19042 | [1–424] | 19089 | [1–550] |
| 18922 | [1–52] | 18969 | [1–569] | 19043 | [238–295],[419–449] | 19090 | [1–469] |
| 18923 | [1–52] | 18970 | [1–477] | 19044 | [1–62] | 19091 | [1–415] |
| 18924 | [1–421] | 18971 | [1–566] | 19045 | [1–301] | 19092 | [1–839] |
| 18925 | [1–51] | 18972 | [1–457] | 19046 | [1–462] | 19093 | [1–463] |
| 18926 | [1–52] | 18973 | [1–415] | 19047 | [1–326] | 19094 | [1–516] |
| 18927 | [182–307] | 18974 | [1–474] | 19048 | [1–417] | 19095 | [1–484] |
| 18928 | [1–51] | 18975 | [1–449] | 19049 | [1–537] | 19096 | [1–356] |
| 18929 | [1–53] | 18976 | [1–437] | 19050 | [1–518] | 19097 | [1–203] |
| 18930 | [1–485] | 18977 | [1–411] | 19051 | [1–508] | 19098 | [1–348] |
| 18931 | [1–355] | 18978 | [1–659] | 19052 | [1–497] | 19099 | [1–351] |
| 18932 | [1–330] | 18979 | [1–451] | 19100 | [1–184] | 19148 | [1–124],[253–406] |
| 18933 | [120–378] | 18980 | [1–485] | 19101 | [1–528] | 19149 | [1–337] |
| 18934 | [1–582] | 18981 | [379–463] | 19102 | [1–444] | 19150 | [1–515] |
| 18935 | [1–281] | 18982 | [1–493] | 19103 | [1–439] | 19151 | [1–174] |
| 18936 | [60–341] | 18983 | [1–378] | 19104 | [1–556] | 19152 | [1–167],[207–391] |
| 18937 | [194–426] | 18984 | [1–77],[449–507] | 19105 | [1–422] | 19153 | [1–419] |
| 18938 | [1–451] | 18985 | [1–114],[168–509] | 19106 | [1–503] | 19154 | [1–166] |
| 18939 | [1–351] | 18986 | [1–433] | 19107 | [1–168] | 19155 | [1–351] |
| 18940 | [1–424] | 18987 | [1–308] | 19108 | [1–548] | 19156 | [1–167],[207–389] |
| 18941 | [1–469] | 18988 | [1–489] | 19109 | [141–515] | 19157 | [1–167],[207–390] |
| 18942 | [1–325] | 18989 | [1–478] | 19110 | [1–473] | 19158 | [208–427] |
| 18943 | [1–149] | 18990 | [1–460] | 19111 | [1–452] | 19159 | [1–453] |
| 18944 | [1–438] | 18991 | [1–528] | 19112 | [1–480] | 19160 | [1–163],[314–494] |
| 18945 | [39–524] | 18992 | [1–506] | 19113 | [1–394] | 19161 | [1–495] |
| 18946 | [73–518] | 18993 | [1–377] | 19114 | [1–354] | 19162 | [1–495],[533–623] |
| 18947 | [85–409] | 18994 | [1–367] | 19115 | [1–612] | 19163 | [1–505] |
| 18948 | [1–519] | 18995 | [1–188] | 19116 | [1–484] | 19164 | [1–435] |
| 18949 | [1–469] | 18996 | [1–543] | 19117 | [1–493] | 19165 | [1–497] |
| 18950 | [1–468] | 18997 | [1–347] | 19118 | [1–387] | 19166 | [1–150] |
| 18951 | [1–519] | 18998 | [1–518] | 19119 | [1–449] | 19167 | [1–369] |
| 18952 | [1–256] | 18999 | [204–533] | 19120 | [41–456] | 19168 | [1–207] |
| 18953 | [1–73],[221–306] | 19000 | [1–190] | 19121 | [1–203] | 19169 | [1–144] |
| 18954 | [114–470] | 19001 | [1–199] | 19122 | [1–439] | 19170 | [1–362],[391–434] |
| 18955 | [336–458] | 19002 | [1–822] | 19123 | [1–445] | 19171 | [1–151] |

TABLE IVb-continued (Novelty: 100%)

| Seq Id No. | Positions of preferred fragments | Seq Id No. | Positions of preferred fragments | Seq Id No. | Positions of preferred fragments | Seq Id No. | Positions of preferred fragments |
|---|---|---|---|---|---|---|---|
| 19124 | [1–427] | 19172 | [1–170] | 19289 | [1–108] | | |
| 19125 | [1–448] | 19173 | [1–162] | 19290 | [1–101] | | |
| 19126 | [1–406] | 19174 | [1–532] | 19291 | [1–108] | | |
| 19127 | [1–514] | 19175 | [1–519] | 19292 | [1–496] | | |
| 19128 | [1–469] | 19176 | [1–658] | 19293 | [1–108] | | |
| 19130 | [1–517] | 19177 | [1–303] | 19294 | [1–63] | | |
| 19131 | [1–458] | 19178 | [1–369] | 19295 | [1–108] | | |
| 19132 | [1–136] | 19179 | [1–500] | 19296 | [1–108] | | |
| 19133 | [1–500] | 19180 | [1–293] | 19298 | [1–108] | | |
| 19134 | [1–429] | 19181 | [78–558] | 19299 | [1–108] | | |
| 19135 | [1–682] | 19182 | [1–471] | 19300 | [1–108] | | |
| 19136 | [1–484] | 19183 | [1–563] | 19301 | [1–80] | | |
| 19137 | [1–142] | 19184 | [326–385] | 19302 | [1–101] | | |
| 19138 | [1–554] | 19186 | [1–513] | 19303 | [1–489] | | |
| 19139 | [1–466] | 19187 | [1–464] | 19304 | [1–108] | | |
| 19140 | [316–440] | 19188 | [1–472] | 19305 | [1–81] | | |
| 19141 | [1–355] | 19189 | [1–473] | 19306 | [1–29] | | |
| 19142 | [1–400] | 19190 | [1–518] | 19307 | [35–81] | | |
| 19143 | [1–196] | 19191 | [1–380] | 19308 | [1–205] | | |
| 19144 | [1–249] | 19192 | [1–449] | 19309 | [1–102] | | |
| 19145 | [149–327] | 19193 | [1–214] | 19311 | [1–108] | | |
| 19146 | [200–465] | 19194 | [1–550] | 19312 | [1–108] | | |
| 19147 | [1–480] | 19195 | [1–165] | 19313 | [1–109] | | |
| 19196 | [1–444] | 19246 | [1–459] | 19314 | [1–385] | | |
| 19197 | [1–130] | 19247 | [1–522] | 19315 | [1–101] | | |
| 19198 | [1–298],[353–406] | 19248 | [1–492] | 19316 | [1–108] | | |
| 19199 | [1–315] | 19249 | [1–490] | 19317 | [1–169] | | |
| 19200 | [1–552] | 19250 | [1–44],[294–477] | 19318 | [1–63] | | |
| 19201 | [1–424] | 19251 | [1–307] | 19319 | [1–133] | | |
| 19202 | [1–161] | 19252 | [241–519] | 19320 | [35–80] | | |
| 19203 | [1–467] | 19253 | [1–480] | 19321 | [1–108] | | |
| 19204 | [1–420] | 19255 | [1–419] | 19322 | [1–119] | | |
| 19205 | [1–468] | 19256 | [1–375] | 19323 | [1–101] | | |
| 19206 | [1–236] | 19257 | [1–177] | 19325 | [1–390] | | |
| 19208 | [1–184] | 19258 | [1–287] | 19326 | [1–168] | | |
| 19209 | [1–299] | 19259 | [1–266] | 19327 | [1–387] | | |
| 19210 | [1–61] | 19260 | [1–58] | 19328 | [1–169] | | |
| 19211 | [1–423] | 19261 | [1–204] | 19329 | [1–169] | | |
| 19212 | [1–260] | 19262 | [1–329] | 19330 | [1–108] | | |
| 19213 | [86–164] | 19263 | [1–72] | 19331 | [1–101] | | |
| 19214 | [1–164] | 19264 | [1–348] | 19332 | [1–404] | | |
| 19215 | [1–146] | 19265 | [1–439] | 19334 | [1–499] | | |
| 19216 | [1–58] | 19266 | [1–330] | 19335 | [1–63] | | |
| 19217 | [1–103] | 19267 | [1–319] | | | | |
| 19218 | [1–352] | 19268 | [1–313] | | | | |
| 19220 | [1–541] | 19269 | [1–160] | | | | |
| 19221 | [1–467] | 19270 | [1–90] | | | | |
| 19222 | [1–464] | 19271 | [1–110] | | | | |
| 19223 | [1–144],[178–371] | 19272 | [1–132] | | | | |
| 19224 | [1–247] | 19273 | [1–101] | | | | |
| 19225 | [1–321] | 19274 | [1–265] | | | | |
| 19226 | [1–221] | 19275 | [1–325] | | | | |
| 19227 | [99–177] | 19276 | [1–171] | | | | |
| 19228 | [1–469] | 19277 | [1–90] | | | | |
| 19229 | [73–477] | 19278 | [1–182] | | | | |
| 19230 | [1–444] | 19279 | [1–59] | | | | |
| 19231 | [339–419] | 19280 | [1–353] | | | | |
| 19232 | [1–338] | 19281 | [1–107] | | | | |
| 19233 | [1–334] | 19282 | [1–377] | | | | |
| 19234 | [1–196] | 19283 | [1–270] | | | | |
| 19235 | [1–505] | 19284 | [1–348] | | | | |
| 19236 | [1–513] | 19285 | [1–338] | | | | |
| 19237 | [134–246] | 19286 | [1–63] | | | | |
| 19238 | [1–467] | 19288 | [1–101] | | | | |
| 19239 | [1–401] | 19289 | [1–108] | | | | |
| 19240 | [1–476] | 19290 | [1–101] | | | | |
| 19241 | [1–369] | 19291 | [1–108] | | | | |
| 19242 | [1–85] | 19292 | [1–496] | | | | |
| 19244 | [1–453] | 19293 | [1–108] | | | | |
| 19245 | [1–136] | 19294 | [1–63] | | | | |
| 19284 | [1–348] | | | | | | |
| 19285 | [1–338] | | | | | | |
| 19286 | [1–63] | | | | | | |
| 19288 | [1–101] | | | | | | |

TABLE V (Spatial distribution)

| Seq Id No. | Tissue distribution | Seq Id No. | Tissue distribution |
|---|---|---|---|
| 24 | H:1 | 71 | I:3 |
| 25 | C:1 | 72 | D:9 |
| 26 | B:6 | 73 | H:1 |
| 27 | K:1 | 74 | B:3 |
| 28 | B:3 C:1 | 75 | B:1 |
| 29 | F:1 | 76 | K:2 |
| 30 | F:1 K:1 | 77 | I:1 |
| 31 | C:1 | 78 | A:3 C:8 D:1 |
| 32 | C:1 F:1 | 79 | I:1 |
| 33 | I:4 | 80 | K:1 |
| 34 | A:1 | 81 | H:1 |
| 35 | C:1 | 82 | F:1 K:4 |
| 36 | A:1 B:1 | 83 | A:4 |
| 37 | F:1 | 84 | K:1 |
| 38 | F:39 K:20 | 85 | K:1 |
| 39 | K:3 | 86 | I:1 |
| 40 | D:1 K:4 | 87 | D:1 F:2 |
| 41 | A:1 | 88 | A:2 |
| 42 | C:4 H:2 | 89 | B:1 |

TABLE V-continued (Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 43 | F:21 K:7 | 90 | C:5 | 161 | B:1 | 208 | A:1 |
| 44 | H:6 | 91 | A:9 B:8 D:1 H:4 I:8 K:1 | 162 | C:1 F:1 | 209 | A:2 H:1 K:2 |
| 45 | I:13 | 92 | A:1 B:5 C:5 D:3 F:3 K:1 | 163 | A:1 | 210 | I:1 |
| 46 | A:1 | 93 | H:1 | 211 | K:1 | 258 | A:1 |
| 47 | E:1 | 94 | A:2 | 212 | K:2 | 259 | H:2 |
| 48 | A:2 B:1 | 95 | H:2 | 213 | K:1 | 260 | F:3 K:3 |
| 49 | A:1 F:1 | 96 | H:1 | 214 | K:1 | 261 | F:2 K:6 |
| 50 | H:1 | 97 | A:14 | 215 | D:1 | 262 | C:1 |
| 51 | B:4 | 98 | B:1 | 216 | A:1 | 263 | A:6 F:1 |
| 52 | I:1 | 99 | B:4 | 217 | C:2 H:10 | 264 | A:5 C:6 I:1 |
| 53 | F:1 | 100 | B:2 | 218 | I:1 | 265 | C:8 |
| 54 | D:2 | 101 | C:3 | 219 | I:1 | 266 | C:3 |
| 55 | C:1 H:4 | 102 | C:1 | 220 | A:2 | 267 | B:1 |
| 56 | F:6 | 103 | B:2 | 221 | H:1 | 268 | F:15 K:3 |
| 57 | F:1 | 104 | C:1 | 222 | B:1 | 269 | D:1 |
| 58 | H:1 | 105 | C:1 | 223 | B:1 | 270 | D:1 |
| 59 | B:1 | 106 | I:1 | 224 | B:3 | 271 | A:1 B:3 |
| 60 | B:1 | 107 | C:1 | 225 | K:2 | 272 | C:1 H:3 |
| 61 | F:1 | 108 | K:2 | 226 | H:1 | 273 | I:2 |
| 62 | F:1 | 109 | F:1 K:1 | 227 | F:1 K:14 | 274 | D:1 |
| 63 | H:3 | 110 | K:2 | 228 | B:3 | 275 | C:2 H:4 K:1 |
| 64 | F:3 | 111 | A:1 C:10 K:1 | 229 | A:4 | 276 | A:1 |
| 65 | F:11 K:5 | 112 | H:3 | 230 | C:1 | 277 | H:6 |
| 66 | H:1 | 113 | I:1 | 231 | H:2 | 278 | A:1 |
| 67 | K:2 | 114 | A:9 | 232 | A:1 I:10 | 279 | F:3 |
| 68 | F:2 | 115 | C:3 | 233 | F:1 | 280 | A:4 C:1 F:1 J:1 |
| 69 | J:1 | 116 | A:1 | 234 | A:1 | 281 | K:1 |
| 70 | B:2 | 117 | C:1 I:1 | 235 | I:5 | 282 | A:1 |
| 118 | A:6 | 164 | A:1 | 236 | F:1 K:1 | 283 | C:2 I:1 |
| 119 | C:5 | 165 | K:7 | 237 | F:1 K:1 | 284 | F:10 |
| 120 | H:4 | 166 | A:1 | 238 | F:6 K:1 | 285 | F:2 |
| 121 | F:1 | 167 | F:2 K:2 | 239 | H:3 I:1 | 286 | F:1 |
| 122 | H:1 | 168 | K:1 | 240 | K:1 | 287 | F:3 K:2 |
| 123 | K:2 | 169 | B:1 | 241 | A:2 | 288 | K:1 |
| 124 | F:1 | 170 | B:2 D:1 | 242 | I:2 | 289 | F:1 |
| 125 | K:3 | 171 | D:1 | 243 | J:18 | 290 | F:1 |
| 126 | A:1 | 172 | H:3 | 244 | A:1 | 291 | H:1 |
| 127 | H:2 | 173 | F:11 K:9 | 245 | A:1 | 292 | K:3 |
| 128 | A:2 B:13 | 174 | A:5 H:1 | 246 | B:1 | 293 | A:2 F:1 |
| 129 | A:1 | 175 | A:2 D:2 | 247 | F:1 | 294 | F:1 |
| 130 | A:1 | 176 | A:8 | 248 | B:3 | 295 | A:1 |
| 131 | H:1 | 177 | A:1 | 249 | C:3 | 296 | K:1 |
| 132 | A:1 H:1 | 178 | H:3 | 250 | K:1 | 297 | A:2 |
| 133 | F:1 | 179 | F:6 K:1 | 251 | F:1 | 298 | C:8 |
| 134 | A:5 | 180 | A:5 | 252 | F:2 | 299 | F:1 |
| 135 | A:50 B:35 C:24 D:12 F:4 H:29 J:1 K:1 | 181 | A:5 B:3 C:128 H:15 | 253 | F:2 K:4 | 300 | A:2 |
| 136 | C:2 | 182 | C:9 | 254 | A:2 | 301 | I:3 |
| 137 | F:6 K:2 | 183 | E:1 | 255 | D:1 | 302 | F:1 K:2 |
| 138 | F:2 | 184 | F:1 | 256 | B:1 | 303 | B:1 F:1 I:1 |
| 139 | A:1 F:7 K:3 | 185 | I:1 K:1 | 257 | A:1 | 304 | A:31 B:6 F:3 K:2 |
| 140 | A:4 B:5 | 186 | B:2 | 305 | H:1 I:6 | 352 | A:1 |
| 141 | K:1 | 187 | A:1 C:1 F:1 | 306 | A:2 B:3 | 353 | D:1 |
| 142 | K:1 | 188 | A:1 | 307 | K:1 | 354 | A:1 |
| 143 | K:1 | 189 | B:1 | 308 | D:1 | 355 | B:1 |
| 144 | F:4 | 190 | A:6 | 309 | A:1 | 356 | F:1 K:6 |
| 145 | F:1 | 191 | I:1 | 310 | K:1 | 357 | B:1 |
| 146 | D:1 F:1 | 192 | K:1 | 311 | C:1 | 358 | A:1 |
| 147 | A:1 | 193 | A:1 | 312 | K:1 | 359 | H:1 |
| 148 | C:1 | 194 | A:1 | 313 | A:1 C:6 | 360 | D:1 |
| 149 | A:1 K:1 | 195 | A:1 | 314 | K:1 | 361 | K:5 |
| 150 | H:2 | 196 | C:1 | 315 | A:1 | 362 | A:1 |
| 151 | F:1 K:3 | 197 | A:1 | 316 | A:1 | 363 | A:1 |
| 152 | A:4 | 198 | A:1 | 317 | D:1 | 364 | F:8 K:1 |
| 153 | B:5 H:1 | 199 | H:3 | 318 | A:11 | 365 | F:6 K:25 |
| | | 200 | A:6 B:10 C:7 D:3 F:8 H:3 K:14 | 319 | F:2 | 366 | A:1 |
| | | | | 320 | H:3 | 367 | D:1 |
| 154 | K:1 | 201 | C:1 | 321 | K:1 | 368 | H:3 |
| 155 | F:5 K:2 | 202 | K:1 | 322 | K:1 | 369 | C:1 |
| 156 | B:1 | 203 | H:2 | 323 | K:1 | 370 | B:1 C:2 D:1 H:6 |
| 157 | K:1 | 204 | I:2 | 324 | A:4 | 371 | B:1 |
| 158 | A:5 | 205 | K:1 | 325 | H:1 | 372 | B:1 |
| 159 | C:34 | 206 | I:4 | 326 | K:1 | 373 | K:1 |
| 160 | C:1 K:1 | 207 | A:1 F:1 H:1 | 327 | A:1 | 374 | H:1 |

TABLE V-continued (Spatial distribution)

| Seq Id No. | Tissue distribution | Seq Id No. | Tissue distribution |
|---|---|---|---|
| 328 | A:7 C:1 | 375 | K:1 |
| 329 | K:1 | 376 | F:2 K:2 |
| 330 | F:2 I:1 | 377 | I:1 |
| 331 | K:1 | 378 | F:1 |
| 332 | K:1 | 379 | A:1 |
| 333 | I:1 | 380 | K:2 |
| 334 | H:1 | 381 | H:1 K:1 |
| 335 | F:1 | 382 | H:1 |
| 336 | B:1 | 383 | B:4 |
| 337 | H:2 | 384 | F:1 |
| 338 | B:3 H:1 | 385 | C:1 |
| 339 | A:1 | 386 | C:1 |
| 340 | K:1 | 387 | F:1 K:7 |
| 341 | B:5 | 388 | C:1 |
| 342 | A:1 K:1 | 389 | C:1 |
| 343 | A:1 | 390 | B:1 |
| 344 | H:2 I:1 | 391 | F:1 |
| 345 | K:1 | 392 | I:1 |
| 346 | F:8 | 393 | C:1 |
| 347 | D:1 K:2 | 394 | C:1 |
| 348 | A:1 B:1 | 395 | I:1 |
| 349 | B:3 H:2 | 396 | H:7 |
| 350 | F:1 | 397 | I:1 |
| 351 | B:1 | 398 | I:1 |
| 399 | I:1 | 446 | C:1 |
| 400 | F:1 | 447 | D:1 |
| 401 | B:1 | 448 | K:1 |
| 402 | B:1 | 449 | H:1 I:3 |
| 403 | C:1 | 450 | C:1 |
| 404 | C:1 | 451 | F:2 |
| 405 | B:1 | 452 | D:1 |
| 406 | I:1 | 453 | B:1 |
| 407 | B:2 | 454 | B:1 |
| 408 | B:1 | 455 | D:1 |
| 409 | I:1 | 456 | D:1 |
| 410 | B:1 | 457 | D:1 |
| 411 | F:1 | 458 | D:1 |
| 412 | F:1 | 459 | A:6 |
| 413 | B:1 | 460 | C:2 |
| 414 | F:1 | 461 | F:1 |
| 415 | I:1 | 462 | F:1 |
| 416 | F:1 | 463 | D:1 |
| 417 | C:1 | 464 | F:1 |
| 418 | F:2 K:2 | 465 | F:1 |
| 419 | I:1 | 466 | F:1 |
| 420 | D:1 | 467 | D:2 |
| 421 | D:1 | 468 | F:1 |
| 422 | H:1 | 469 | A:1 |
| 423 | D:1 | 470 | F:1 K:1 |
| 424 | K:1 | 471 | F:1 |
| 425 | D:1 | 472 | F:1 K:3 |
| 426 | F:17 K:3 | 473 | I:4 |
| 427 | I:3 | 474 | A:1 |
| 428 | D:1 | 475 | K:1 |
| 429 | I:1 | 476 | A:1 |
| 430 | D:1 | 477 | C:1 |
| 431 | D:1 | 478 | A:1 |
| 432 | D:1 | 479 | A:1 |
| 433 | F:1 | 480 | B:3 |
| 434 | D:1 | 481 | A:1 |
| 435 | B:1 | 482 | F:1 |
| 436 | D:1 | 483 | D:1 |
| 437 | D:1 | 484 | K:1 |
| 438 | F:1 | 485 | K:1 |
| 439 | K:4 | 486 | A:1 |
| 440 | K:4 | 487 | A:1 |
| 441 | F:1 | 488 | A:1 |
| 442 | B:1 | 489 | A:1 |
| 443 | D:1 | 490 | A:1 |
| 444 | D:1 | 491 | D:1 |
| 445 | D:1 | 492 | A:1 |
| 493 | A:1 | 540 | A:1 |
| 494 | K:1 | 541 | A:1 |

TABLE V-continued (Spatial distribution)

| Seq Id No. | Tissue distribution | Seq Id No. | Tissue distribution |
|---|---|---|---|
| 495 | D:1 | 542 | K:1 |
| 496 | B:1 | 543 | A:1 |
| 497 | A:1 | 544 | K:1 |
| 498 | A:1 | 545 | A:1 |
| 499 | A:1 | 546 | A:1 |
| 500 | B:1 | 547 | A:1 |
| 501 | K:1 | 548 | K:1 |
| 502 | A:1 | 549 | A:1 |
| 503 | A:1 | 550 | A:1 |
| 504 | A:2 | 551 | A:1 |
| 505 | B:1 | 552 | A:1 |
| 506 | A:1 | 553 | K:1 |
| 507 | A:1 | 554 | A:1 |
| 508 | A:1 | 555 | A:1 |
| 509 | B:1 | 556 | K:1 |
| 510 | D:1 | 557 | A:1 |
| 511 | A:1 | 558 | A:1 |
| 512 | K:1 | 559 | K:1 |
| 513 | F:1 K:1 | 560 | B:1 |
| 514 | A:1 | 561 | A:1 F:2 H:1 |
| 515 | K:1 | 562 | K:4 |
| 516 | K:1 | 563 | K:1 |
| 517 | A:1 | 564 | B:3 |
| 518 | B:1 | 565 | B:1 |
| 519 | D:1 | 566 | F:30 K:14 |
| 520 | A:1 | 567 | K:1 |
| 521 | B:3 | 568 | A:1 |
| 522 | K:1 | 569 | K:1 |
| 523 | F:1 | 570 | F:1 K:1 |
| 524 | K:1 | 571 | A:4 K:1 |
| 525 | A:1 | 572 | F:1 |
| 526 | K:1 | 573 | H:3 |
| 527 | K:1 | 574 | A:2 H:1 |
| 528 | F:1 | 575 | H:2 |
| 529 | A:1 | 576 | K:1 |
| 530 | F:1 | 577 | B:1 |
| 531 | A:1 | 578 | C:1 F:9 |
| 532 | K:1 | 579 | F:5 K:22 |
| 533 | A:1 | 580 | B:1 |
| 534 | A:1 | 581 | C:5 |
| 535 | K:1 | 582 | A:5 C:20 H:1 K:1 |
| 536 | F:1 | 583 | K:1 |
| 537 | A:1 | 584 | D:2 |
| 538 | A:1 | 585 | H:2 |
| 539 | K:1 | 586 | F:4 K:4 |
| 587 | K:1 | 634 | A:3 |
| 588 | A:2 | 635 | K:1 |
| 589 | A:1 D:1 | 636 | A:2 |
| 590 | H:1 | 637 | H:3 |
| 591 | F:3 K:2 | 638 | F:1 |
| 592 | K:1 | 639 | F:1 |
| 593 | A:3 | 640 | F:1 |
| 594 | K:1 | 641 | K:1 |
| 595 | B:1 | 642 | A:6 F:9 K:1 |
| 596 | H:1 | 643 | B:1 |
| 597 | F:2 K:3 | 644 | B:1 C:1 |
| 598 | B:1 | 645 | F:8 K:1 |
| 599 | K:2 | 646 | F:8 K:3 |
| 600 | K:1 | 647 | A:1 |
| 601 | K:1 | 648 | F:1 |
| 602 | C:1 | 649 | A:7 |
| 603 | K:1 | 650 | F:5 K:1 |
| 604 | K:1 | 651 | C:10 |
| 605 | H:1 | 652 | I:4 |
| 606 | A:1 F:1 | 653 | F:1 |
| 607 | K:1 | 654 | C:1 |
| 608 | A:1 | 655 | A:13 B:1 |
| 609 | A:1 | 656 | C:1 |
| 610 | A:1 | 657 | K:4 |
| 611 | I:4 | 658 | F:1 |
| 612 | K:1 | 659 | K:1 |
| 613 | C:1 F:1 H:14 | 660 | K:1 |
| 614 | A:1 | 661 | I:1 K:1 |

TABLE V-continued

(Spatial distribution)

| Seq Id No. | Tissue distribution | Seq Id No. | Tissue distribution |
|---|---|---|---|
| 615 | K:1 | 662 | B:4 H:2 K:1 |
| 616 | A:1 | 663 | H:2 |
| 617 | K:2 | 664 | K:1 |
| 618 | H:1 | 665 | F:1 |
| 619 | H:1 | 666 | K:2 |
| 620 | H:1 | 667 | A:3 |
| 621 | A:1 | 668 | F:1 |
| 622 | A:2 | 669 | A:6 |
| 623 | H:1 | 670 | F:1 |
| 624 | H:2 | 671 | C:3 K:1 |
| 625 | A:2 | 672 | H:3 |
| 626 | B:1 C:1 | 673 | A:1 |
| 627 | A:5 B:2 | 674 | F:7 K:1 |
| 628 | K:1 | 675 | F:1 |
| 629 | K:1 | 676 | K:1 |
| 630 | K:2 | 677 | A:3 |
| 631 | K:1 | 678 | H:1 |
| 632 | C:4 | 679 | A:1 |
| 633 | A:11 | 680 | H:1 |
| 681 | H:1 | 728 | A:1 C:1 |
| 682 | F:4 | 729 | K:1 |
| 683 | F:2 K:19 | 730 | A:2 I:1 |
| 684 | K:1 | 731 | A:2 B:2 C:9 D:2 F:1 H:2 K:2 |
| 685 | B:1 | 732 | H:3 |
| 686 | C:35 I:2 | 733 | H:1 |
| 687 | A:3 | 734 | K:1 |
| 688 | B:2 | 735 | K:1 |
| 689 | A:1 C:1 H:2 | 736 | C:1 |
| 690 | K:2 | 737 | K:1 |
| 691 | H:1 | 738 | B:1 |
| 692 | A:3 | 739 | A:2 B:1 C:2 D:4 |
| 693 | B:1 | 740 | B:1 J:1 |
| 694 | C:7 | 741 | J:1 |
| 695 | C:1 | 742 | B:7 C:2 H:2 |
| 696 | B:1 | 743 | C:1 |
| 697 | A:2 B:11 C:9 D:2 E:1 F:2 H:4 I:1 | 744 | A:1 |
| 698 | K:1 | 745 | K:1 |
| 699 | H:1 | 746 | F:1 |
| 700 | K:1 | 747 | F:1 |
| 701 | A:1 | 748 | K:1 |
| 702 | B:1 F:1 | 749 | F:1 |
| 703 | F:1 K:1 | 750 | F:1 |
| 704 | B:1 F:3 | 751 | F:1 |
| 705 | F:10 K:8 | 752 | B:1 |
| 706 | B:2 C:8 H:4 K:3 | 753 | B:2 |
| 707 | F:1 | 754 | F:1 H:1 I:2 |
| 708 | B:1 | 755 | B:1 |
| 709 | K:1 | 756 | H:1 |
| 710 | D:2 | 757 | A:1 C:1 |
| 711 | K:1 | 758 | H:3 |
| 712 | A:4 | 759 | K:1 |
| 713 | B:1 | 760 | F:1 K:1 |
| 714 | B:3 C:1 F:4 K:1 | 761 | K:1 |
| 715 | F:24 K:7 | 762 | H:1 |
| 716 | I:1 | 763 | H:1 |
| 717 | H:1 | 764 | C:3 |
| 718 | A:4 | 765 | H:1 |
| 719 | A:1 B:4 C:1 | 766 | B:1 |
| 720 | F:2 H:1 I:1 K:1 | 767 | C:1 |
| 721 | A:2 | 768 | A:2 B:3 C:4 E:1 I:1 K:3 |
| 722 | K:5 | 769 | A:29 |
| 723 | B:1 | 770 | H:1 |
| 724 | D:1 | 771 | C:2 H:1 |
| 725 | B:3 | 772 | H:1 |
| 726 | F:2 | 773 | I:3 |
| 727 | H:3 | 774 | A:8 |
| 775 | F:1 K4 | 821 | H:1 |
| 776 | B:1 | 822 | K:1 |
| 777 | B:6 C:1 H:2 | 823 | H:1 |
| 778 | B:2 C:1 D:1 F:9 H:2 K:15 | 824 | K:2 |
| 779 | A:1 | 825 | H:1 |
| 780 | B:4 C:11 D:1 H:2 | 826 | A:1 B:1 |
| 781 | F:1 K:7 | 827 | H:4 |
| 782 | B:1 | 828 | B:1 |
| 783 | A:1 D:1 | 829 | K:1 |
| 784 | K:1 | 830 | B:1 |
| 785 | K:1 | 831 | A:1 |
| 786 | B:2 D:1 K:1 | 832 | C:8 J:1 |
| 787 | I:2 | 833 | D:1 |
| 788 | F:10 K:8 | 834 | B:2 F:1 |
| 789 | K:1 | 835 | K:1 |
| 790 | A:13 B:17 C:30 D:10 F:9 H:75 I:1 J:1 K:13 | 836 | C:2 |
| 791 | F:1 | 837 | K:1 |
| 792 | F:1 K:1 | 838 | K:1 |
| 793 | C:3 | 839 | C:1 F:3 K:3 |
| 794 | H:1 | 840 | I:1 |
| 795 | C:1 H:11 | 841 | H:1 |
| 796 | A:2 | 842 | D:1 H:1 |
| 797 | A:1 B:8 C:9 D:1 H:4 J:2 | 843 | D:1 F:1 |
| 798 | K:5 | 844 | B:1 F:1 |
| 799 | H:1 | 845 | B:1 |
| 800 | A:1 F:5 H:1 K:2 | 846 | F:8 K:7 |
| 801 | K:1 | 847 | A:1 |
| 802 | K:2 | 848 | A:1 H:2 K:1 |
| 803 | F:3 K:2 | 849 | F:9 K:1 |
| 804 | F:3 K:1 | 850 | H:2 |
| 805 | K:3 | 851 | F:3 |
| 806 | C:1 H:1 | 852 | H:2 |
| 807 | K:1 | 853 | K:1 |
| 808 | H:1 | 854 | B:2 H:2 I:1 |
| 809 | C:1 D:2 | 855 | F:1 K:4 |
| 810 | B:1 | 856 | F:1 K:4 |
| 811 | K:3 | 857 | F:2 K:1 |
| 812 | K:1 | 858 | F:1 |
| 813 | H:2 | 859 | F:2 |
| 814 | K:1 | 860 | F:1 K:1 |
| 815 | A:5 B:3 | 861 | F:11 K:6 |
| 816 | H:1 | 862 | C:6 F:1 |
| 817 | B:9 | 863 | H:1 |
| 818 | A:3 B:6 C:21 D:1 F:1 H:2 J:1 K:1 | 864 | A:1 B:5 |
| 819 | A:4 B:6 C:26 D:2 F:2 H:4 J:1 K:1 | 865 | K:7 |
| 820 | H:4 | 866 | K:1 |
| 868 | A:13 | 867 | A:13 |
| 869 | K:1 | 915 | H:3 |
| 870 | K:1 | 916 | C:1 |
| 871 | B:3 | 917 | H:2 |
| 872 | K:1 | 918 | C:8 |
| 873 | A:8 B:34 C:14 D:2 H:5 | 919 | C:12 |
| 874 | C:1 | 920 | H:1 |
| 875 | K:1 | 921 | B:2 C:1 |
| 876 | K:1 | 922 | K:1 |
| 877 | H:1 | 923 | B:2 |
| 878 | H:4 | 924 | F:1 K:1 |
| 879 | F:1 | 925 | F:6 K:4 |
| 880 | A:5 | 926 | K:3 |
| 881 | A:26 B:5 C:4 D:1 F:1 H:13 I:1 | 927 | K:1 |
| 882 | A:2 | 928 | K:1 |
| 883 | A:3 H:3 | 929 | A:1 B:3 D:1 K:3 |
| 884 | H:1 | 930 | I:2 |
| 885 | A:5 | 931 | H:2 I:1 |
| 886 | K:4 | 932 | B:3 |
| 887 | F:1 K:1 | 933 | A:1 B:2 K:2 |
| 888 | A:1 H:3 | 934 | C:1 |
| 889 | D:1 | 935 | H:1 |
| 890 | F:3 | 936 | F:1 K:1 |
| 891 | H:1 | 937 | A:12 B:6 C:10 F:1 H:2 |
| 892 | F:5 K:2 | 938 | H:4 |
| 893 | I:2 | 939 | C:21 |
| 894 | D:2 F:3 H:2 K:3 | 940 | C:21 |
| 895 | K:1 | 941 | K:2 |
|  |  | 942 | K:2 |

TABLE V-continued

(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 896 | K:1 | 943 | F:2 K:1 | 1063 | K:1 | 1109 | K:2 |
| 897 | K:2 | 944 | H:1 I:1 | 1064 | K:1 | 1110 | K:1 |
| 898 | H:4 | 945 | F:7 K:2 | 1065 | F:1 K:2 | 1111 | H:1 |
| 899 | J:1 | 946 | B:3 | 1066 | K:1 | 1112 | H:1 |
| 900 | H:1 | 947 | C:1 | 1067 | K:1 | 1113 | A:6 |
| 901 | H:1 | 948 | B:1 | 1068 | K:1 | 1114 | K:1 |
| 902 | B:3 | 949 | F:11 K:6 | 1069 | F:1 | 1115 | H:1 |
| 903 | K:1 | 950 | H:3 | 1070 | K:1 | 1116 | K:1 |
| 904 | F:4 | 951 | F:2 K:1 | 1071 | F:2 K:15 | 1117 | K:1 |
| 905 | F:2 K:7 | 952 | F:3 | 1072 | K:1 | 1118 | A:1 |
| 906 | K:2 | 953 | B:1 F:1 K:3 | 1073 | K:1 | 1119 | H:2 |
| 907 | A:5 | 954 | I:2 | 1074 | A:3 H:7 | 1120 | D:1 F:4 |
| 908 | F:1 K:1 | 955 | D:1 F:1 | 1075 | B:3 | 1121 | H:1 |
| 909 | A:15 B:11 C:7 H:4 K:1 | 956 | F:1 H:1 K:1 | 1076 | B:2 | 1122 | D:1 H:1 |
| 910 | A:2 B:5 C:2 H:2 K:1 | 957 | A:1 B:2 F:3 H:1 | 1077 | K:1 | 1123 | F:1 K:2 |
| 911 | A:3 K:2 | 958 | A:2 | 1078 | K:2 | 1124 | A:4 B:1 C:6 F:7 H:2 K:9 |
| 912 | H:1 | 959 | F:5 K:5 | 1079 | A:14 B:1 | 1125 | F:5 K:1 |
| 913 | B:2 H:2 | 960 | K:3 | 1080 | K:1 | 1126 | K:1 |
| 914 | A:1 | 961 | F:8 K:3 | 1081 | F:2 K:1 | 1127 | A:1 |
| 962 | I:3 | 1009 | A:1 | 1082 | H:5 | 1128 | F:1 K:1 |
| 963 | B:1 H:1 | 1010 | A:1 | 1083 | A:2 B:3 H:1 | 1129 | H:1 |
| 964 | K:1 | 1011 | A:1 | 1084 | H:1 K:1 | 1130 | F:1 |
| 965 | C:1 | 1012 | A:1 | 1085 | A:3 B:1 H:1 K:1 | 1131 | D:1 |
| 966 | C:15 | 1013 | A:1 | 1086 | A:1 | 1132 | K:2 |
| 967 | B:1 | 1014 | B:1 | 1087 | B:1 | 1133 | F:1 |
| 968 | A:9 D:1 | 1015 | B:1 | 1088 | A:10 B:21 C:18 D:11 E:2 F:3 H:12 I:5 J:2 | 1134 | F:1 K:2 |
| 969 | F:4 | 1016 | B:1 | 1089 | A:2 B:28 C:5 F:1 I:2 K:3 | 1135 | A:3 I:5 |
| 970 | K:1 | 1017 | B:1 | 1090 | C:15 J:2 | 1136 | K:1 |
| 971 | D:1 H:1 | 1018 | B:1 | 1091 | F:1 K:24 | 1137 | B:2 C:1 H:1 |
| 972 | A:5 F:1 | 1019 | B:1 | 1092 | C:2 | 1138 | B:1 |
| 973 | A:4 K:3 | 1020 | A:1 | 1093 | K:4 | 1139 | H:1 |
| 974 | C:2 | 1021 | A:1 | 1094 | A:1 F:6 K:11 | 1140 | H:1 K:1 |
| 975 | H:2 | 1022 | A:1 | 1095 | H:1 | 1141 | A:5 |
| 976 | F:1 I:3 K:1 | 1023 | A:1 | 1096 | J:1 | 1142 | A:1 |
| 977 | F:2 K:4 | 1024 | B:1 | 1097 | K:6 | 1143 | D:1 |
| 978 | A:8 | 1025 | A:1 | 1098 | K:1 | 1144 | F:4 K:25 |
| 979 | B:1 F:1 K:4 | 1026 | A:1 | 1099 | K:1 | 1145 | B:2 |
| 980 | A:1 C:1 | 1027 | B:1 | 1100 | K:1 | 1146 | F:1 K:1 |
| 981 | H:5 | 1028 | A:1 | 1101 | K:1 | 1147 | D:2 |
| 982 | H:1 | 1029 | A:1 | 1149 | B:4 | 1148 | B:1 I:1 |
| 983 | H:1 | 1030 | B:2 H:7 I:1 | 1150 | K:1 | 1194 | B:1 |
| 984 | F:4 | 1031 | B:1 C:1 H:8 I:8 | 1151 | A:2 H:3 | 1195 | F:2 K:2 |
| 985 | K:2 | 1032 | K:3 | 1152 | H:1 | 1196 | F:6 H:2 K:1 |
| 986 | K:1 | 1033 | B:3 | 1153 | K:1 | 1197 | A:1 B:2 H:2 |
| 987 | H:2 | 1034 | A:1 | 1154 | A:1 | 1198 | H:2 |
| 988 | K:4 | 1035 | K:2 | 1155 | H:1 | 1199 | H:1 |
| 989 | B:6 K:1 | 1036 | K:3 | 1156 | A:4 | 1200 | F:1 K:2 |
| 990 | K:1 | 1037 | K:3 | 1157 | K:6 | 1201 | H:1 |
| 991 | K:1 | 1038 | F:2 | 1158 | C:4 H:1 | 1202 | K:2 |
| 992 | A:1 D:1 | 1039 | H:1 | 1159 | K:1 | 1203 | F:4 K:19 |
| 993 | F:7 K:5 | 1040 | C:9 | 1160 | B:1 C:1 D:1 K:1 | 1204 | F:4 K:16 |
| 994 | F:6 K:21 | 1041 | K:1 | 1161 | B:1 | 1205 | K:1 |
| 995 | H:1 | 1042 | I:2 | 1162 | D:1 | 1206 | C:1 |
| 996 | H:1 | 1043 | A:1 C:1 H:1 I:2 | 1163 | C:1 | 1207 | A:10 B:3 |
| 997 | H:1 | 1044 | B:2 | 1164 | A:1 | 1208 | B:6 C:1 |
| 998 | C:2 | 1045 | A:2 | 1165 | B:1 | 1209 | B:8 C:1 |
| 999 | H:1 | 1046 | A:1 | 1166 | B:1 | 1210 | B:1 C:2 F:33 H:1 K:19 |
| 1000 | H:1 | 1047 | K:1 | 1167 | J:1 | 1211 | K:1 |
| 1001 | B:1 | 1048 | C:1 H:1 I:1 | 1168 | H:1 | 1212 | F:1 |
| 1002 | C:6 D:1 H:1 J:6 | 1049 | F:1 | 1169 | H:1 | 1213 | H:1 |
| 1003 | F:13 K:1 | 1050 | H:1 | 1170 | C:17 | 1214 | K:2 |
| 1004 | F:1 K:1 | 1051 | F:13 K:4 | 1171 | A:1 | 1215 | C:12 I:3 |
| 1005 | A:1 B:1 | 1052 | H:1 | 1172 | J:53 | 1216 | K:2 |
| 1006 | B:4 | 1053 | D:1 | 1173 | F:2 K:2 | 1217 | B:2 C:1 |
| 1007 | A:1 | 1054 | F:7 K:1 | 1174 | F:8 K:1 | 1218 | F:1 |
| 1008 | A:1 | 1055 | H:7 | 1175 | H:2 | 1219 | F:1 |
| 1056 | F:3 K2 | 1102 | H:1 | 1176 | B:1 | 1220 | A:1 |
| 1057 | H:1 | 1103 | F:1 | 1177 | F:2 K:1 | 1221 | C:3 |
| 1058 | K:3 | 1104 | F:1 | 1178 | F:4 | 1222 | K:1 |
| 1059 | B:3 | 1105 | K:1 | 1179 | F:7 K:2 | 1223 | C:1 |
| 1060 | B:1 | 1106 | K:1 | 1180 | F:5 K:39 | 1224 | I:1 |
| 1061 | C:1 H:1 | 1107 | A:5 F:2 | 1181 | A:2 F:2 H:1 K:13 | 1225 | H:1 |
| 1062 | F:4 K:11 | 1108 | K:1 | | | 1226 | J:1 |

TABLE V-continued
(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 1182 | K:6 | 1227 | B:1 | 1345 | B:59 C:47 D:2 H:20 I:2 J:3 | 1392 | H:3 |
| 1183 | H:1 | 1228 | F:5 K:1 | 1346 | B:17 C:22 D:2 H:14 J:4 K:1 | 1393 | B:2 |
| 1184 | F:1 | 1229 | K:3 | 1347 | D:3 F:3 H:1 K:1 | 1394 | B:1 |
| 1185 | A:1 B:3 C:12 D:1 F:3 H:3 I:1 K:12 | 1230 | B:2 | 1348 | D:3 F:2 | 1395 | H:2 |
| 1186 | A:17 B:42 C:27 D:11 F:5 H:29 I:2 J:11 K:2 | 1231 | F:7 | 1349 | C:1 | 1396 | K:1 |
|  |  | 1232 | H:1 | 1350 | I:1 | 1397 | F:7 K:1 |
| 1187 | A:1 B:3 C:1 H:1 | 1233 | F:1 K:1 | 1351 | K:1 | 1398 | C:5 H:1 |
| 1188 | C:4 F:1 | 1234 | A:1 K:1 | 1352 | B:1 | 1399 | F:1 |
| 1189 | C:4 K:1 | 1235 | F:1 | 1353 | D:1 | 1400 | H:1 |
| 1190 | B:9 K:1 | 1236 | A:6 B:1 C:1 D:2 | 1354 | H:1 | 1401 | H:1 |
| 1191 | F:5 K:2 | 1237 | A:2 C:17 D:1 | 1355 | F:1 K:6 | 1402 | F:2 |
| 1192 | K:2 | 1238 | F:2 K:4 | 1356 | K:3 | 1403 | B:2 H:3 |
| 1193 | F:1 K:1 | 1239 | A:5 | 1357 | H:4 | 1404 | D:2 |
| 1241 | K:1 | 1240 | F:1 K:3 | 1358 | C:13 | 1405 | H:5 |
| 1242 | H:1 | 1287 | C:5 | 1359 | D:2 | 1406 | K:4 |
| 1243 | A:2 B:3 | 1288 | C:1 | 1360 | F:4 | 1407 | F:5 K:1 |
| 1244 | K:1 | 1289 | C:3 H:1 | 1361 | K:2 | 1408 | A:3 B:8 C:15 |
| 1245 | B:4 C:27 | 1290 | K:5 | 1362 | F:24 K:8 | 1409 | C:32 H:1 |
| 1246 | C:4 | 1291 | K:1 | 1363 | F:2 K:2 | 1410 | C:2 |
| 1247 | B:3 | 1292 | B:1 | 1364 | F:1 K:1 | 1411 | K:1 |
| 1248 | A:3 B:1 D:1 K:3 | 1293 | K:2 | 1365 | F:1 K:3 | 1412 | B:1 H:3 |
| 1249 | H:1 | 1294 | H:1 | 1366 | I:18 | 1413 | H:1 |
| 1250 | F:31 K:11 | 1295 | C:1 H:3 I:4 | 1367 | C:2 D:1 I:1 | 1414 | D:1 |
| 1251 | A:18 B:24 C:32 F:43 H:49 I:32 J:1 K:17 | 1296 | A:6 H:3 I:3 | 1368 | C:2 | 1415 | A:75 B:75 C:94 D:36 E:1 F:13 H:33 I:1 J:1 K:22 |
|  |  | 1297 | H:1 | 1369 | D:1 H:2 |  |  |
| 1252 | A:4 B:4 C:7 F:21 H:24 I:9 K:7 | 1298 | A:1 B:2 F:1 | 1370 | H:1 | 1416 | A:2 C:128 H:5 |
|  |  | 1299 | B:1 C:1 | 1371 | A:2 | 1417 | J:2 |
| 1253 | A:2 B:2 C:3 F:8 H:7 I:2 K:4 | 1300 | D:1 F:3 H:1 | 1372 | K:1 | 1418 | A:2 B:3 C:1 |
| 1254 | A:1 | 1301 | A:1 F:7 H:6 I:2 K:2 | 1373 | C:1 | 1419 | C:30 J:2 K:2 |
| 1255 | C:1 | 1302 | H:4 I:10 | 1374 | K:1 | 1420 | I:4 |
| 1256 | C:1 | 1303 | B:5 D:1 H:1 | 1375 | F:1 K:2 | 1421 | B:1 F:3 K:5 |
| 1257 | A:1 | 1304 | F:1 K:3 | 1376 | A:2 | 1422 | K:2 |
| 1258 | F:3 K:2 | 1305 | I:2 | 1377 | D:6 F:21 | 1423 | D:1 |
| 1259 | F:4 K:3 | 1306 | A:1 B:1 H:2 | 1378 | K:2 | 1424 | H:1 |
| 1260 | A:2 B:1 C:1 D:3 H:1 K:5 | 1307 | F:3 | 1379 | F:3 | 1425 | A:2 |
| 1261 | F:36 K:15 | 1308 | A:2 H:1 I:2 | 1380 | H:1 | 1426 | A:1 B:1 |
| 1262 | K:3 | 1309 | B:1 | 1427 | H:1 | 1474 | D:1 |
| 1263 | D:1 | 1310 | C:1 | 1428 | A:1 | 1475 | A:1 |
| 1264 | H:6 | 1311 | B:2 | 1429 | K:1 | 1476 | D:1 |
| 1265 | A:1 F:1 | 1312 | F:12 H:2 K:12 | 1430 | I:4 | 1477 | C:2 |
| 1266 | H:1 | 1313 | F:1 K:1 | 1431 | K:2 | 1478 | A:3 D:4 |
| 1267 | F:2 K:6 | 1314 | A:1 D:1 K:1 | 1432 | B:1 K:4 | 1479 | K:1 |
| 1268 | F:8 K:8 | 1315 | K:1 | 1433 | C:1 | 1480 | A:10 H:1 |
| 1269 | K:2 | 1316 | H:1 | 1434 | F:3 | 1481 | A:1 |
| 1270 | F:1 K:2 | 1317 | A:1 | 1435 | C:9 | 1482 | A:1 |
| 1271 | F:1 | 1318 | C:2 | 1436 | K:1 | 1483 | K:12 |
| 1272 | F:1 | 1319 | H:4 | 1437 | F:1 K:2 | 1484 | C:3 |
| 1273 | K:2 | 1320 | K:1 | 1438 | K:1 | 1485 | A:2 B:9 |
| 1274 | K:1 | 1321 | C:1 D:1 H:1 | 1439 | H:1 | 1486 | B:1 |
| 1275 | A:7 | 1322 | F:1 | 1440 | A:1 H:1 | 1487 | A:2 B:1 C:5 |
| 1276 | F:3 | 1323 | F:1 | 1441 | F:1 | 1488 | B:5 |
| 1277 | K:2 | 1324 | K:1 | 1442 | B:1 | 1489 | H:2 |
| 1278 | H:1 | 1325 | K:1 | 1443 | K:1 | 1490 | F:2 K:2 |
| 1279 | B:7 | 1326 | A:9 K:1 | 1444 | F:1 | 1491 | F:2 |
| 1280 | B:1 C:6 H:1 | 1327 | B:3 C:1 H:1 | 1445 | B:1 | 1492 | D:1 |
| 1281 | B:3 | 1328 | F:1 K:1 | 1446 | F:3 K:1 | 1493 | F:1 K:1 |
| 1282 | F:4 K:5 | 1329 | F:4 K:2 | 1447 | K:2 | 1494 | A:1 |
| 1283 | F:9 K:5 | 1330 | K:2 | 1448 | K:2 | 1495 | F:9 H:1 K:1 |
| 1284 | F:2 K:1 | 1331 | H:1 | 1449 | B:1 | 1496 | B:3 |
| 1285 | J:1 | 1332 | H:1 | 1450 | B:1 | 1497 | A:10 |
| 1286 | F:6 | 1333 | H:1 | 1451 | B:1 | 1498 | K:2 |
| 1334 | H:1 | 1381 | D:1 | 1452 | B:1 | 1499 | K:1 |
| 1335 | H:1 | 1382 | K:2 | 1453 | F:3 | 1500 | F:1 |
| 1336 | H:1 | 1383 | K:1 | 1454 | C:1 D:1 H:1 | 1501 | F:1 |
| 1337 | F:2 | 1384 | F:2 K:6 | 1455 | F:3 K:4 | 1502 | B:2 |
| 1338 | H:1 | 1385 | H:1 | 1456 | B:1 | 1503 | C:1 |
| 1339 | H:6 I:1 | 1386 | C:1 D:3 F:2 | 1457 | B:1 | 1504 | C:1 |
| 1340 | D:1 | 1387 | A:1 C:1 D:1 K:2 | 1458 | A:1 H:1 | 1505 | A:1 |
| 1341 | D:1 | 1388 | C:4 | 1459 | B:1 | 1506 | K:1 |
| 1342 | D:1 | 1389 | K:4 | 1460 | F:1 | 1507 | D:1 |
| 1343 | C:48 J:1 | 1390 | A:1 | 1461 | F:2 K:3 | 1508 | B:1 |
| 1344 | D:2 | 1391 | K:4 | 1462 | H:2 | 1509 | D:1 |
|  |  |  |  | 1463 | C:2 K:1 | 1510 | C:1 |

TABLE V-continued

(Spatial distribution)

| Seq Id No. | Tissue distribution | Seq Id No. | Tissue distribution |
|---|---|---|---|
| 1464 | B:1 | 1511 | K:1 |
| 1465 | A:1 B:5 C:1 F:3 H:2 | 1512 | K:1 |
| 1466 | A:2 | 1513 | I:4 |
| 1467 | D:1 | 1514 | H:1 |
| 1468 | K:2 | 1515 | H:3 |
| 1469 | K:1 | 1516 | C:36 |
| 1470 | A:3 | 1517 | H:3 I:1 K:1 |
| 1471 | F:4 K:1 | 1518 | B:1 |
| 1472 | A:5 D:4 | 1519 | A:1 C:18 D:1 |
| 1473 | H:2 | 1520 | A:1 |
| 1521 | H:5 | 1568 | A:1 |
| 1522 | F:1 H:15 | 1569 | K:7 |
| 1523 | A:1 | 1570 | F:1 K:2 |
| 1524 | A:3 | 1571 | A:2 |
| 1525 | D:3 | 1572 | C:1 |
| 1526 | A:12 F:1 H:12 | 1573 | A:1 |
| 1527 | B:3 | 1574 | C:2 |
| 1528 | D:1 | 1575 | C:2 |
| 1529 | J:1 | 1576 | H:1 |
| 1530 | F:1 J:25 K:1 | 1577 | D:1 |
| 1531 | B:1 | 1578 | H:3 |
| 1532 | D:1 H:1 | 1579 | D:1 |
| 1533 | I:2 | 1580 | K:8 |
| 1534 | A:2 | 1581 | K:1 |
| 1535 | A:1 B:1 | 1582 | F:1 K:1 |
| 1536 | B:1 H:1 | 1583 | H:1 |
| 1537 | F:1 | 1584 | F:1 |
| 1538 | K:2 | 1585 | B:2 |
| 1539 | C:3 | 1586 | B:2 |
| 1540 | A:4 | 1587 | C:3 H:1 |
| 1541 | K:1 | 1588 | F:2 H:1 |
| 1542 | B:1 | 1589 | H:1 |
| 1543 | F:3 K:4 | 1590 | C:1 |
| 1544 | K:1 | 1591 | A:1 B:1 C:12 H:1 |
| 1545 | H:1 | 1592 | A:1 C:23 H:1 |
| 1546 | C:1 D:2 H:4 K:6 | 1593 | F:2 |
| 1547 | H:1 | 1594 | F:1 K:3 |
| 1548 | A:2 | 1595 | K:1 |
| 1549 | I:1 | 1596 | A:12 B:29 C:22 F:38 H:20 I:9 K:12 |
| 1550 | H:1 | 1597 | K:1 |
| 1551 | B:3 | 1598 | F:1 |
| 1552 | A:26 B:8 D:7 F:3 H:3 K:1 | 1599 | D:1 F:1 |
| 1553 | H:14 | 1600 | H:3 I:3 |
| 1554 | H:1 | 1601 | B:2 |
| 1555 | K:3 | 1602 | B:7 |
| 1556 | H:1 | 1603 | B:9 C:1 |
| 1557 | A:3 | 1604 | D:1 K:2 |
| 1558 | C:2 | 1605 | A:1 |
| 1559 | C:1 | 1606 | B:3 C:52 D:2 H:1 |
| 1560 | H:1 | 1607 | A:3 |
| 1561 | F:1 | 1608 | A:1 |
| 1562 | F:18 K:3 | 1609 | H:1 |
| 1563 | A:15 B:5 C:56 D:3 F:1 H:6 K:2 | 1610 | F:1 K:2 |
| 1564 | A:15 B:5 C:50 D:3 F:1 H:6 K:2 | | |
| 1565 | A:1 | 1611 | H:2 |
| 1566 | C:1 | 1612 | H:1 |
| 1567 | D:4 | 1613 | B:2 |
| 1614 | D:1 | 1661 | K:1 |
| 1615 | C:15 | 1662 | H:1 |
| 1616 | C:4 | 1663 | K:2 |
| 1617 | K:3 | 1664 | F:2 K:12 |
| 1618 | H:1 | 1665 | A:2 |
| 1619 | K:1 | 1666 | F:1 K:6 |
| 1620 | A:2 | 1667 | K:4 |
| 1621 | A:1 C:1 | 1668 | A:1 |
| 1622 | A:2 C:6 | 1669 | F:10 K:36 |
| 1623 | K:1 | 1670 | K:2 |
| 1624 | A:4 | 1671 | K:6 |
| 1625 | F:7 K:1 | 1672 | K:4 |
| 1626 | B:2 | 1673 | H:1 |
| 1627 | B:4 | 1674 | A:1 |
| 1628 | B:1 | 1675 | F:1 |
| 1629 | B:2 | 1676 | K:1 |
| 1630 | K:2 | 1677 | F:18 K:22 |
| 1631 | A:2 | 1678 | C:8 |
| 1632 | A:22 H:2 I:3 | 1679 | K:1 |
| 1633 | K:1 | 1680 | F:4 K:4 |
| 1634 | A:2 | 1681 | K:1 |
| 1635 | A:19 H:3 I:3 | 1682 | B:1 K:1 |
| 1636 | H:1 | 1683 | C:21 J:1 |
| 1637 | B:1 | 1684 | K:1 |
| 1638 | A:1 D:1 | 1685 | K:2 |
| 1639 | K:1 | 1686 | K:1 |
| 1640 | F:2 | 1687 | F:2 |
| 1641 | F:1 | 1688 | H:1 |
| 1642 | C:2 | 1689 | D:1 |
| 1643 | F:4 K:20 | 1690 | D:1 |
| 1644 | H:1 | 1691 | H:1 |
| 1645 | H:1 | 1692 | K:1 |
| 1646 | C:9 J:1 | 1693 | K:1 |
| 1647 | H:9 | 1694 | H:1 |
| 1648 | I:1 | 1695 | K:1 |
| 1649 | C:2 D:1 F:11 H:5 K:31 | 1696 | F:2 |
| 1650 | H:3 | 1697 | K:1 |
| 1651 | D:1 | 1698 | K:1 |
| 1652 | C:7 | 1699 | H:1 |
| 1653 | B:4 | 1700 | K:1 |
| 1654 | F:4 K:1 | 1701 | A:1 |
| 1655 | F:3 K:1 | 1702 | B:1 |
| 1656 | A:1 | 1703 | K:1 |
| 1657 | F:1 | 1704 | K:2 |
| 1658 | A:3 B:2 F:1 I:3 | 1705 | F:14 K:3 |
| 1659 | A:1 B:4 C:3 D:1 K:1 | 1706 | K:2 |
| 1660 | K:3 | 1707 | A:1 C:1 D:2 H:1 |
| 1708 | K:1 | 1755 | A:2 |
| 1709 | H:2 | 1756 | A:1 |
| 1710 | B:1 | 1757 | K:2 |
| 1711 | A:3 C:4 D:2 F:1 H:1 | 1758 | K:2 |
| 1712 | A:1 | 1759 | B:2 I:1 |
| 1713 | A:1 | 1760 | A:2 B:1 K:2 |
| 1714 | J:3 | 1761 | B:2 |
| 1715 | B:1 | 1762 | I:1 |
| 1716 | F:1 | 1763 | F:1 |
| 1717 | F:3 K:1 | 1764 | I:1 |
| 1718 | B:1 F:1 | 1765 | H:3 |
| 1719 | B:2 C:8 | 1766 | I:1 |
| 1720 | H:2 | 1767 | I:1 |
| 1721 | F:4 | 1768 | A:1 |
| 1722 | K:1 | 1769 | D:1 |
| 1723 | K:9 | 1770 | H:3 |
| 1724 | K:1 | 1771 | K:2 |
| 1725 | K:1 | 1772 | H:5 |
| 1726 | A:2 | 1773 | A:1 J:2 |
| 1727 | F:2 | 1774 | H:1 |
| 1728 | H:1 | 1775 | D:1 H:6 J:133 |
| 1729 | F:1 | 1776 | J:1 |
| 1730 | A:1 | 1777 | B:2 |
| 1731 | C:1 | 1778 | K:1 |
| 1732 | I:1 | 1779 | J:1 |
| 1733 | C:8 J:7 | 1780 | A:1 |
| 1734 | K:3 | 1781 | K:1 |
| 1735 | F:1 | 1782 | I:2 |
| 1736 | F:3 K:3 | 1783 | A:1 F:1 K:6 |
| 1737 | K:5 | 1784 | A:1 |
| 1738 | F:2 K:1 | 1785 | K:1 |
| 1739 | D:1 | 1786 | K:2 |
| 1740 | F:3 K:10 | 1787 | F:18 K:8 |
| 1741 | K:3 | 1788 | C:3 |
| 1742 | A:1 | 1789 | B:1 |
| 1743 | A:4 | 1790 | B:1 |
| 1744 | K:2 | 1791 | C:15 J:1 |
| 1745 | K:2 | 1792 | F:18 K:1 |
| 1746 | A:1 | 1793 | K:1 |
| 1747 | C:1 | 1794 | F:3 |

TABLE V-continued (Spatial distribution)

| Seq Id No. | Tissue distribution | Seq Id No. | Tissue distribution |
|---|---|---|---|
| 1748 | H:1 | 1795 | K:5 |
| 1749 | F:1 | 1796 | D:1 H:8 |
| 1750 | A:68 | 1797 | K:3 |
| 1751 | H:1 | 1798 | D:1 |
| 1752 | A:1 | 1799 | B:3 |
| 1753 | H:1 | 1800 | K:1 |
| 1754 | A:3 | 1801 | I:3 |
| 1802 | C:3 | 1849 | K:1 |
| 1803 | A:30 B:5 F:1 I:6 | 1850 | F:1 K:1 |
| 1804 | H:1 | 1851 | A:1 |
| 1805 | K:1 | 1852 | C:3 |
| 1806 | A:8 B:7 C:1 D:1 F:3 H:8 I:1 K:12 | 1853 | K:1 |
| 1807 | B:1 | 1854 | B:1 C:1 D:2 H:4 J:12 |
| 1808 | A:4 B:3 C:3 F:1 H:31 | 1855 | F:1 |
| 1809 | K:J | 1856 | A:4 B:6 H:1 K:1 |
| 1810 | J:1 | 1857 | D:1 |
| 1811 | K:1 | 1858 | K:1 |
| 1812 | H:3 | 1859 | A:3 |
| 1813 | K:1 | 1860 | F:3 K:37 |
| 1814 | K:2 | 1861 | D:1 |
| 1815 | B:2 | 1862 | F:1 K:1 |
| 1816 | B:1 | 1863 | A:5 B:5 D:4 F:2 H:1 K:9 |
| 1817 | H:1 | 1864 | H:3 |
| 1818 | F:1 K:1 | 1865 | H:1 |
| 1819 | B:8 C:10 D:1 H:4 J:2 | 1866 | C:6 I:1 |
| 1820 | F:2 | 1867 | A:8 B:36 C:13 D:7 F:1 H:1 J:1 |
| 1821 | D:1 | 1868 | D:1 |
| 1822 | A:1 F:1 I:4 K:4 | 1869 | K:2 |
| 1823 | A:1 | 1870 | B:3 |
| 1824 | K:2 | 1871 | A:1 |
| 1825 | H:1 | 1872 | K:1 |
| 1826 | H:1 | 1873 | A:3 K:3 |
| 1827 | A:1 B:2 C:3 I:2 | 1874 | F:5 K:1 |
| 1828 | F:1 K:2 | 1875 | K:4 |
| 1829 | K:1 | 1876 | K:1 |
| 1830 | I:2 | 1877 | K:3 |
| 1831 | A:1 | 1878 | F:1 |
| 1832 | A:1 | 1879 | F:1 K:1 |
| 1833 | H:2 | 1880 | B:1 |
| 1834 | D:1 | 1881 | B:1 C:5 F:1 |
| 1835 | C:5 H:2 I:3 | 1882 | F:1 |
| 1836 | A:2 | 1883 | F:1 |
| 1837 | A:1 F:4 K:1 | 1884 | A:1 B:6 |
| 1838 | C:1 | 1885 | K:1 |
| 1839 | A:9 K:1 | 1886 | K:1 |
| 1840 | H:1 | 1887 | F:5 K:1 |
| 1841 | H:1 | 1888 | I:1 |
| 1842 | C:2 | 1889 | B:1 |
| 1843 | A:1 | 1890 | D:1 |
| 1844 | D:1 | 1891 | F:1 K:4 |
| 1845 | A:1 D:4 H:9 | 1892 | B:2 |
| 1846 | A:1 | 1893 | A:2 C:2 K:1 |
| 1847 | B:2 | 1894 | K:1 |
| 1848 | A:2 | 1895 | K:1 |
| 1896 | I:1 | 1943 | C:1 |
| 1897 | A:1 | 1944 | C:1 |
| 1898 | K:1 | 1945 | B:1 C:1 D:1 H:4 J:12 |
| 1899 | A:1 | 1946 | B:1 |
| 1900 | B:2 | 1947 | C:11 |
| 1901 | K:2 | 1948 | B:1 |
| 1902 | D:1 | 1949 | B:1 |
| 1903 | D:1 | 1950 | F:3 K:2 |
| 1904 | I:2 | 1951 | H:3 |
| 1905 | F:5 | 1952 | C:1 |
| 1906 | A:1 H:1 | 1953 | K:1 |
| 1907 | A:4 | 1954 | K:1 |
| 1908 | K:1 | 1955 | C:5 |
| 1909 | K:2 | 1956 | B:1 |
| 1910 | B:1 | 1957 | B:2 |
| 1911 | K:1 | 1958 | C:1 |
| 1912 | B:1 | 1959 | F:1 |
| 1913 | A:13 | 1960 | E:1 K:2 |
| 1914 | B:2 | 1961 | A:4 H:1 |
| 1915 | C:1 | 1962 | F:3 K:1 |
| 1916 | I:1 | 1963 | B:2 D:1 K:3 |
| 1917 | H:1 | 1964 | H:3 |
| 1918 | H:3 | 1965 | F:4 K:1 |
| 1919 | B:2 | 1966 | D:1 |
| 1920 | F:1 K:2 | 1967 | H:4 |
| 1921 | A:1 | 1968 | B:3 |
| 1922 | K:1 | 1969 | B:3 |
| 1923 | K:7 | 1970 | D:2 |
| 1924 | A:1 | 1971 | A:1 F:3 K:1 |
| 1925 | B:2 | 1972 | F:18 K:6 |
| 1926 | A:1 | 1973 | A:2 B:6 C:72 D:1 F:2 H:5 J:5 K:3 |
| 1927 | A:1 | 1974 | A:15 B:3 F:2 |
| 1928 | A:1 | 1975 | I:2 |
| 1929 | B:1 | 1976 | B:3 |
| 1930 | A:10 H:1 I:1 | 1977 | B:2 |
| 1931 | E:1 | 1978 | A:4 |
| 1932 | K:1 | 1979 | A:4 |
| 1933 | A:1 | 1980 | A:2 B:1 D:1 |
| 1934 | B:2 | 1981 | H:1 |
| 1935 | A:1 | 1982 | A:2 |
| 1936 | F:1 K:7 | 1983 | C:9 |
| 1937 | C:1 | 1984 | A:1 C:15 H:1 |
| 1938 | K:1 | 1985 | F:2 |
| 1939 | C:1 | 1986 | A:1 |
| 1940 | C:1 | 1987 | C:1 |
| 1941 | K:1 | 1988 | K:1 |
| 1942 | C:1 | 1989 | H:1 |
| 1990 | C:1 | 2036 | K:3 |
| 1991 | K:1 | 2037 | F:3 |
| 1992 | C:1 | 2038 | C:2 |
| 1993 | A:3 | 2039 | I:1 |
| 1994 | F:2 K:1 | 2040 | K:3 |
| 1995 | K:4 | 2041 | K:1 |
| 1996 | K:1 | 2042 | C:1 F:1 |
| 1997 | F:1 K:5 | 2043 | I:2 |
| 1998 | C:3 | 2044 | B:1 C:3 F:6 H:3 I:2 K:4 |
| 1999 | A:1 | 2045 | A:1 |
| 2000 | A:2 | 2046 | H:3 |
| 2001 | C:1 | 2047 | K:1 |
| 2002 | F:1 | 2048 | B:3 |
| 2003 | A:5 B:1 D:1 F:1 | 2049 | K:1 |
| 2004 | A:6 D:1 F:1 | 2050 | H:3 |
| 2005 | A:1 B:3 C:29 D:4 H:2 J:1 | 2051 | A:2 B:2 C:8 D:2 H:1 |
| 2006 | A:26 | 2052 | K:1 |
| 2007 | H:2 | 2053 | A:2 C:2 I:1 |
| 2008 | K:2 | 2054 | K:1 |
| 2009 | A:7 B:20 C:41 D:5 F:6 H:36 I:4 K:12 | 2055 | F:1 K:2 |
| 2010 | A:9 | 2056 | H:1 |
| 2011 | C:9 | 2057 | H:1 |
| 2012 | K:1 | 2058 | K:1 |
| 2013 | K:1 | 2059 | F:1 |
| 2014 | K:1 | 2060 | B:1 |
| 2015 | K:1 | 2061 | C:1 |
| 2016 | F:1 | 2062 | C:1 |
| 2017 | A:2 B:13 C:1 F:10 H:1 K:38 | 2063 | C:1 |
| 2018 | C:1 D:1 F:2 K:1 | 2064 | C:1 |
| 2019 | K:3 | 2065 | C:1 |
| 2020 | B:2 | 2066 | C:1 |
| 2021 | C:18 J:1 | 2067 | I:2 |
| 2022 | B:1 | 2068 | A:1 H:1 |
| 2023 | D:1 | 2069 | K:3 |
| 2024 | K:4 | 2070 | C:1 |
| 2025 | C:1 | 2071 | C:1 |
| 2026 | K:1 | 2072 | I:1 |
| 2027 | K:1 | 2073 | I:1 |
| 2028 | B:2 | 2074 | C:1 |
| 2029 | F:2 K:2 | 2075 | K:2 |
| 2030 | H:2 | 2076 | C:1 |
|  |  | 2077 | C:1 |

TABLE V-continued (Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 2031 | K:1 | 2078 | C:1 | 2198 | H:2 | 2245 | A:1 |
| 2032 | A:1 | 2079 | C:1 | 2199 | A:1 | 2246 | A:1 |
| 2033 | K:1 | 2080 | C:1 | 2200 | C:8 | 2247 | K:1 |
| 2034 | K:4 | 2081 | I:1 | 2201 | A:1 | 2248 | A:1 |
| 2035 | F:1 K:1 | 2082 | C:55 H:5 K:2 | 2202 | A:1 | 2249 | A:1 |
| 2083 | C:1 | 2130 | D:1 | 2203 | A:1 | 2250 | K:1 |
| 2084 | I:1 | 2131 | I:1 | 2204 | A:1 | 2251 | A:1 |
| 2085 | C:1 | 2132 | B:3 H:1 | 2205 | A:1 | 2252 | A:1 |
| 2086 | C:1 | 2133 | I:1 | 2206 | A:1 | 2253 | D:1 |
| 2087 | C:1 | 2134 | D:1 | 2207 | A:1 | 2254 | A:1 |
| 2088 | I:1 | 2135 | I:1 | 2208 | D:1 | 2255 | A:1 |
| 2089 | C:1 | 2136 | C:1 | 2209 | K:3 | 2256 | B:1 F:9 I:1 K:3 |
| 2090 | F:5 K:2 | 2137 | D:1 | 2210 | K:2 | 2257 | A:1 |
| 2091 | I:1 | 2138 | D:1 | 2211 | C:1 | 2258 | B:1 D:1 F:1 I:1 K:1 |
| 2092 | C:1 | 2139 | D:1 | 2212 | F:1 | 2259 | K:1 |
| 2093 | C:1 | 2140 | B:1 | 2213 | A:1 | 2260 | C:8 |
| 2094 | K:1 | 2141 | B:1 | 2214 | A:1 | 2261 | B:3 |
| 2095 | C:1 | 2142 | D:1 | 2215 | A:1 | 2262 | K:3 |
| 2096 | I:1 | 2143 | D:1 | 2216 | C:1 | 2263 | A:1 |
| 2097 | C:1 | 2144 | H:2 | 2217 | D:1 | 2264 | A:1 |
| 2098 | I:1 | 2145 | D:1 | 2218 | A:2 | 2265 | A:1 |
| 2099 | K:1 | 2146 | B:1 | 2219 | D:1 | 2266 | A:1 |
| 2100 | F:7 K:44 | 2147 | B:1 | 2220 | B:2 | 2267 | A:1 |
| 2101 | C:1 | 2148 | B:1 | 2221 | F:1 | 2268 | A:1 |
| 2102 | D:1 | 2149 | D:1 | 2222 | A:1 | 2269 | A:1 |
| 2103 | C:1 | 2150 | D:1 | 2223 | A:1 | 2270 | A:1 |
| 2104 | E:1 | 2151 | D:1 | 2271 | B:1 | 2318 | F:1 |
| 2105 | I:1 | 2152 | B:1 | 2272 | K:1 | 2319 | A:1 |
| 2106 | D:1 | 2153 | F:1 | 2273 | K:1 | 2320 | A:1 |
| 2107 | C:1 | 2154 | D:1 | 2274 | A:1 | 2321 | A:1 |
| 2108 | I:1 | 2155 | C:1 | 2275 | D:1 | 2322 | F:1 |
| 2109 | J:1 | 2156 | F:2 K:2 | 2276 | A:1 | 2323 | K:1 |
| 2110 | C:1 | 2157 | D:1 | 2277 | K:1 | 2324 | A:1 |
| 2111 | I:1 | 2158 | D:1 | 2278 | A:1 | 2325 | A:1 |
| 2112 | I:1 | 2159 | D:1 | 2279 | A:1 | 2326 | B:1 |
| 2113 | J:1 | 2160 | D:1 | 2280 | F:1 | 2327 | K:1 |
| 2114 | D:1 | 2161 | B:1 | 2281 | A:1 | 2328 | K:1 |
| 2115 | I:1 | 2162 | B:1 | 2282 | A:11 | 2329 | A:1 |
| 2116 | D:1 | 2163 | B:1 | 2283 | A:1 | 2330 | K:1 |
| 2117 | C:1 | 2164 | D:1 | 2284 | A:1 | 2331 | F:1 |
| 2118 | C:1 | 2165 | D:1 | 2285 | A:1 | 2332 | A:1 |
| 2119 | D:1 | 2166 | D:1 | 2286 | K:1 | 2333 | A:1 |
| 2120 | C:1 | 2167 | A:6 | 2287 | K:1 | 2334 | F:2 K:1 |
| 2121 | B:1 D:1 H:7 | 2168 | D:1 | 2288 | A:1 | 2335 | A:1 |
| 2122 | D:1 | 2169 | D:1 | 2289 | A:1 | 2336 | K:1 |
| 2123 | K:2 | 2170 | B:5 | 2290 | K:1 | 2337 | K:1 |
| 2124 | C:1 | 2171 | D:1 | 2291 | A:1 | 2338 | A:1 |
| 2125 | C:1 | 2172 | E:1 | 2292 | A:1 | 2339 | A:1 |
| 2126 | C:1 | 2173 | F:1 | 2293 | A:1 | 2340 | A:1 |
| 2127 | I:1 | 2174 | F:5 K:2 | 2294 | A:1 | 2341 | A:1 |
| 2128 | C:1 | 2175 | J:1 | 2295 | K:1 | 2342 | K:1 |
| 2129 | C:1 | 2176 | F:1 | 2296 | K:1 | 2343 | A:1 |
| 2177 | D:1 | 2224 | A:1 | 2297 | A:1 | 2344 | A:1 |
| 2178 | F:1 | 2225 | A:1 | 2298 | A:1 | 2345 | A:1 |
| 2179 | F:1 | 2226 | C:1 | 2299 | A:1 | 2346 | A:1 |
| 2180 | B:1 | 2227 | A:1 | 2300 | A:1 | 2347 | A:1 |
| 2181 | F:1 | 2228 | A:1 | 2301 | A:1 | 2348 | B:1 |
| 2182 | D:1 | 2229 | F:1 | 2302 | A:1 | 2349 | A:1 |
| 2183 | F:1 | 2230 | C:1 | 2303 | A:1 | 2350 | A:1 |
| 2184 | D:1 | 2231 | A:1 | 2304 | K:1 | 2351 | H:2 |
| 2185 | J:1 | 2232 | A:1 | 2305 | K:1 | 2352 | A:1 |
| 2186 | B:1 | 2233 | K:1 | 2306 | A:1 | 2353 | K:1 |
| 2187 | A:1 D:1 | 2234 | K:1 | 2307 | A:1 | 2354 | K:1 |
| 2188 | F:1 | 2235 | K:1 | 2308 | A:1 | 2355 | K:3 |
| 2189 | A:2 | 2236 | A:1 | 2309 | F:1 | 2356 | F:2 K:6 |
| 2190 | A:1 | 2237 | A:1 | 2310 | K:1 | 2357 | K:1 |
| 2191 | A:1 | 2238 | H:1 | 2311 | A:1 | 2358 | K:1 |
| 2192 | D:1 | 2239 | A:5 | 2312 | F:1 K:1 | 2359 | K:1 |
| 2193 | A:1 | 2240 | A:1 | 2313 | A:1 | 2360 | F:1 H:1 K:1 |
| 2194 | C:2 H:4 | 2241 | A:1 | 2314 | A:1 | 2361 | K:1 |
| 2195 | C:2 H:4 | 2242 | C:1 | 2315 | C:1 | 2362 | K:1 |
| 2196 | D:1 | 2243 | B:1 | 2316 | C:1 | 2363 | K:1 |
| 2197 | C:1 | 2244 | K:1 | 2317 | C:1 | 2364 | K:1 |

TABLE V-continued

(Spatial distribution)

| Seq Id No. | Tissue distribution | Seq Id No. | Tissue distribution |
|---|---|---|---|
| 2365 | K:1 | | K:2 |
| 2366 | B:4 | 2412 | K:1 |
| 2367 | F:34 K:160 | 2413 | K:1 |
| 2368 | K:4 | 2414 | A:2 J:2 |
| 2369 | B:3 | 2415 | K:1 |
| 2370 | F:1 K:4 | 2416 | A:1 B:5 C:1 D:1 K:2 |
| 2371 | H:6 | 2417 | A:2 C:14 H:1 |
| 2372 | A:3 B:2 C:2 D:1 I:1 K:1 | 2418 | F:2 |
| 2373 | F:8 K:2 | 2419 | A:1 I:1 |
| 2374 | K:1 | 2420 | K:1 |
| 2375 | F:1 | 2421 | K:2 |
| 2376 | K:3 | 2422 | A:1 |
| 2377 | K:1 | 2423 | F:1 K:2 |
| 2378 | D:1 | 2424 | A:2 |
| 2379 | A:113 | 2425 | K:2 |
| 2380 | A:1 | 2426 | A:4 |
| 2381 | B:1 | 2427 | A:2 B:3 C:8 D:2 F:2 H:2 K:3 |
| 2382 | A:1 | 2428 | C:1 |
| 2383 | K:1 | 2429 | H:1 |
| 2384 | A:2 B:2 F:68 H:1 K:16 | 2430 | B:1 |
| 2385 | A:1 | 2431 | F:7 K:3 |
| 2386 | K:1 | 2432 | F:1 K:2 |
| 2387 | C:6 | 2433 | F:4 |
| 2388 | K:1 | 2434 | K:1 |
| 2389 | K:1 | 2435 | F:2 K:3 |
| 2390 | C:7 | 2436 | A:2 D:1 H:1 |
| 2391 | K:1 | 2437 | K:1 |
| 2392 | F:1 K:1 | 2438 | I:2 |
| 2393 | C:1 | 2439 | K:3 |
| 2394 | K:1 | 2440 | F:1 K:4 |
| 2395 | B:1 | 2441 | A:1 |
| 2396 | A:1 D:1 H:1 | 2442 | H:2 |
| 2397 | F:1 K:15 | 2443 | D:1 |
| 2398 | K:1 | 2444 | B:1 |
| 2399 | K:1 | 2445 | C:2 |
| 2400 | F:2 | 2446 | F:2 |
| 2401 | A:1 B:6 H:1 | 2447 | H:1 K:1 |
| 2402 | A:1 | 2448 | K:1 |
| 2403 | H:1 | 2449 | K:1 |
| 2404 | A:1 | 2450 | K:1 |
| 2405 | K:1 | 2451 | K:1 |
| 2406 | K:1 | 2452 | F:7 K:4 |
| 2407 | K:2 | 2453 | D:3 F:15 I:1 K:61 |
| 2408 | H:2 | 2454 | D:1 H:2 K:7 |
| 2409 | A:1 | 2455 | C:1 |
| 2410 | F:1 K:3 | 2456 | A:1 |
| 2411 | A:18 B:11 C:11 F:1 H:6 I:3 J:3 | 2457 | K:1 |
| 2458 | K:1 | 2504 | K:1 |
| 2459 | F:1 | 2505 | A:6 B:2 C:2 D:1 F:1 |
| 2460 | K:1 | 2506 | F:1 K:1 |
| 2461 | K:1 | 2507 | A:1 |
| 2462 | B:3 | 2508 | F:2 K:48 |
| 2463 | K:1 | 2509 | K:1 |
| 2464 | F:1 K:1 | 2510 | K:2 |
| 2465 | I:4 | 2511 | A:1 C:5 |
| 2466 | H:5 | 2512 | B:1 |
| 2467 | K:6 | 2513 | A:1 |
| 2468 | A:2 D:3 H:1 K:1 | 2514 | A:1 |
| 2469 | F:1 K:1 | 2515 | K:1 |
| 2470 | F:3 K:8 | 2516 | H:2 |
| 2471 | F:3 | 2517 | B:1 |
| 2472 | K:1 | 2518 | K:1 |
| 2473 | K:1 | 2519 | K:1 |
| 2474 | K:1 | 2520 | A:9 B:1 I:1 |
| 2475 | B:2 | 2521 | A:1 |
| 2476 | C:1 | 2522 | K:3 |
| 2477 | A:1 | 2523 | F:11 H:2 |
| 2478 | F:10 | 2524 | F:11 H:3 |
| 2479 | C:3 | 2525 | K:1 |
| 2480 | A:1 | 2526 | K:1 |
| 2481 | K:2 | 2527 | K:1 |
| 2482 | D:1 H:1 | 2528 | A:6 |
| 2483 | C:1 | 2529 | C:18 |
| 2484 | B:3 | 2530 | C:6 |
| 2485 | A:17 B:7 C:2 D:7 H:4 | 2531 | K:1 |
| 2486 | B:2 | 2532 | K:1 |
| 2487 | A:24 B:81 C:60 D:28 F:6 H:69 I:2 J:9 K:30 | 2533 | K:1 |
| 2488 | K:1 | 2534 | K:1 |
| 2489 | B:3 | 2535 | K:2 |
| 2490 | F:1 K:2 | 2536 | K:1 |
| 2491 | K:1 | 2537 | K:1 |
| 2492 | F:1 K:1 | 2538 | K:1 |
| 2493 | A:1 K:3 | 2539 | C:2 |
| 2494 | F:2 K:10 | 2540 | A:6 B:5 C:1 H:7 |
| 2495 | K:1 | 2541 | K:2 |
| 2496 | B:2 | 2542 | K:2 |
| 2497 | A:2 | 2543 | K:3 |
| 2498 | K:1 | 2544 | B:3 |
| 2499 | A:2 | 2545 | D:49 |
| 2500 | F:5 K:3 | 2546 | C:11 |
| 2501 | K:1 | 2547 | K:1 |
| 2502 | A:3 | 2548 | F:1 K:1 |
| 2503 | A:5 D:1 | 2549 | D:1 |
| 2551 | K:1 | 2550 | A:5 |
| 2552 | D:1 | 2598 | A:2 |
| 2553 | F:1 K:1 | 2599 | F:1 K:3 |
| 2554 | H:1 | 2600 | K:1 |
| 2555 | K:1 | 2601 | K:1 |
| 2556 | K:1 | 2602 | A:1 |
| 2557 | K:1 | 2603 | A:1 |
| 2558 | B:1 | 2604 | B:1 |
| 2559 | C:1 | 2605 | K:3 |
| 2560 | A:8 | 2606 | C:1 |
| 2561 | B:1 | 2607 | A:1 |
| | | 2608 | A:3 B:21 C:43 D:2 H:18 I:1 K:4 |
| 2562 | C:9 H:1 | 2609 | K:1 |
| 2563 | B:1 | 2610 | K:1 |
| 2564 | K:3 | 2611 | K:1 |
| 2565 | K:1 | 2612 | A:20 B:2 |
| 2566 | F:5 | 2613 | A:1 B:2 C:4 |
| 2567 | B:1 | 2614 | A:20 B:2 |
| 2568 | B:1 K:3 | 2615 | K:1 |
| 2569 | K:1 | 2616 | A:1 |
| 2570 | K:1 | 2617 | K:3 |
| 2571 | K:2 | 2618 | F:2 K:4 |
| 2572 | F:2 | 2619 | C:1 F:2 H:8 I:3 |
| 2573 | B:1 | 2620 | B:2 |
| 2574 | B:2 F:1 K:3 | 2621 | K:1 |
| 2575 | K:2 | 2622 | A:1 B:1 |
| 2576 | C:1 K:1 | 2623 | F:13 K:32 |
| 2577 | B:3 C:2 D:2 H:1 | 2624 | K:1 |
| 2578 | B:4 C:2 D:1 H:1 | 2625 | K:1 |
| 2579 | B:2 C:1 D:1 F:2 | 2626 | K:1 |
| 2580 | C:1 F:15 | 2627 | K:1 |
| 2581 | K:1 | 2628 | F:1 |
| 2582 | K:2 | 2629 | K:1 |
| 2583 | K:1 | 2630 | K:1 |
| 2584 | A:3 B:3 C:2 D:1 F:5 H:1 | 2631 | K:1 |
| 2585 | D:1 | 2632 | K:1 |
| 2586 | B:1 | 2633 | K:1 |
| 2587 | F:25 K:7 | 2634 | K:1 |
| 2588 | K:1 | 2635 | F:1 K:2 |
| 2589 | K:4 | 2636 | K:1 |
| 2590 | K:1 | 2637 | K:1 |
| 2591 | F:1 K:8 | 2638 | A:1 B:1 C:15 D:1 J:2 |
| 2592 | K:7 | 2639 | K:1 |
| 2593 | B:2 | 2640 | B:1 |
| 2594 | F:10 K:1 | 2641 | B:1 |
| 2595 | K:1 | 2642 | F:1 K:1 |
| 2596 | C:5 J:2 | 2643 | K:1 |
| 2597 | K:1 | 2644 | A:3 |
| 2645 | K:1 | 2692 | K:1 |
| 2646 | K:1 | 2693 | K:2 |

TABLE V-continued
(Spatial distribution)

| Seq Id No. | Tissue distribution | Seq Id No. | Tissue distribution |
|---|---|---|---|
| 2647 | A:9 | 2694 | A:1 B:2 H:1 |
| 2648 | K:1 | 2695 | K:1 |
| 2649 | K:1 | 2696 | K:1 |
| 2650 | K:1 | 2697 | A:2 |
| 2651 | K:5 | 2698 | F:1 K:1 |
| 2652 | A:13 B:1 C:11 D:1 F:4 H:1 K:17 | 2699 | K:3 |
| 2653 | C:1 | 2700 | K:1 |
| 2654 | K:2 | 2701 | F:1 |
| 2655 | K:2 | 2702 | A:2 |
| 2656 | A:7 | 2703 | F:2 K:2 |
| 2657 | A:2 | 2704 | F:1 K:1 |
| 2658 | D:1 H:1 | 2705 | K:1 |
| 2659 | K:1 | 2706 | B:1 |
| 2660 | A:3 B:1 C:1 F:1 H:13 I:3 J:2 K:1 | 2707 | A:5 |
| 2661 | H:1 | 2708 | K:1 |
| 2662 | H:1 | 2709 | B:2 |
| 2663 | K:4 | 2710 | A:2 |
| 2664 | K:3 | 2711 | F:9 K:3 |
| 2665 | B:3 | 2712 | C:1 |
| 2666 | K:1 | 2713 | A:12 C:1 |
| 2667 | H:4 | 2714 | C:1 |
| 2668 | A:4 B:1 H:1 | 2715 | C:1 |
| 2669 | K:2 | 2716 | B:1 |
| 2670 | K:1 | 2717 | K:3 |
| 2671 | A:4 B:8 C:74 D:1 F:3 H:16 I:2 | 2718 | B:1 C:1 |
| 2672 | B:1 C:6 H:17 | 2719 | C:1 |
| 2673 | B:1 C:16 H:7 | 2720 | F:1 K:1 |
| 2674 | B:1 | 2721 | F:2 K:1 |
| 2675 | F:13 K:101 | 2722 | A:4 |
| 2676 | B:1 | 2723 | A:1 F:2 H:1 |
| 2677 | C:4 | 2724 | H:1 |
| 2678 | K:1 | 2725 | K:1 |
| 2679 | A:3 | 2726 | K:1 |
| 2680 | A:16 | 2727 | C:2 |
| 2681 | A:12 | 2728 | A:15 B:56 C:25 D:20 F:2 H:16 I:1 J:5 K:1 |
| 2682 | A:1 F:2 | 2729 | C:3 D:1 H:1 |
| 2683 | F:1 K:9 | 2730 | C:1 |
| 2684 | K:1 | 2731 | H:2 |
| 2685 | K:1 | 2732 | H:3 |
| 2686 | D:1 | 2733 | K:1 |
| 2687 | K:1 | 2734 | D:2 K:1 |
| 2688 | B:1 | 2735 | A:2 |
| 2689 | D:1 | 2736 | K:1 |
| 2690 | H:1 I:2 | 2737 | K:1 |
| 2691 | A:1 B:2 | 2785 | A:2 D:2 F:1 H:10 |
| 2738 | K:1 | 2786 | H:2 |
| 2739 | F:3 | 2787 | F:4 K:3 |
| 2740 | A:6 B:1 C:1 D:3 H:6 | 2788 | B:1 |
| 2741 | K:1 | 2789 | K:1 |
| 2742 | C:1 | 2790 | A:9 |
| 2743 | C:25 | 2791 | A:16 C:2 D:1 I:1 |
| 2744 | K:3 | 2792 | K:2 |
| 2745 | A:1 D:3 | 2793 | K:1 |
| 2746 | D:1 | 2794 | C:7 |
| 2747 | K:1 | 2795 | J:1 |
| 2748 | F:1 K:1 | 2796 | J:1 |
| 2749 | B:1 | 2797 | J:1 |
| 2750 | B:1 C:1 D:1 F:1 H:2 K:2 | 2798 | J:1 |
| 2751 | K:1 | 2799 | J:1 |
| 2752 | K:1 | 2800 | J:1 |
| 2753 | B:1 | 2801 | J:1 |
| 2754 | A:4 C:1 J:2 | 2802 | J:1 |
| 2755 | B:1 | 2803 | J:1 |
| 2756 | B:2 | 2804 | J:1 |
| 2757 | K:1 | 2805 | J:1 |
| 2758 | B:1 | 2806 | K:1 |
| 2759 | C:4 H:1 J:1 | 2807 | F:4 K:4 |
| 2760 | C:2 D:1 K:1 | 2808 | K:1 |
| 2761 | C:26 D:1 | 2809 | K:1 |
| 2762 | B:2 | | |
| 2763 | B:3 | 2810 | K:1 |
| 2764 | K:1 | 2811 | K:1 |
| 2765 | F:3 | 2812 | H:1 |
| 2766 | B:5 C:25 D:1 H:1 J:3 K:2 | 2813 | B:3 C:8 |
| 2767 | B:4 | 2814 | K:1 |
| 2768 | B:3 C:26 D:1 H:1 J:3 K:2 | 2815 | A:11 B:24 C:19 D:11 E:2 F:3 H:12 I:5 J:2 |
| 2769 | A:9 B:5 C:36 D:2 H:1 J:3 K:3 | 2816 | H:19 K:2 |
| 2770 | C:1 | 2817 | B:1 |
| 2771 | C:1 | 2818 | K:1 |
| 2772 | B:7 C:12 D:1 H:1 K:1 | 2819 | K:1 |
| 2773 | A:2 B:6 K:2 | 2820 | A:3 |
| 2774 | K:1 | 2821 | K:1 |
| 2775 | K:1 | 2822 | D:2 |
| 2776 | K:1 | 2823 | C:3 |
| 2777 | K:3 | 2824 | K:1 |
| 2778 | B:1 | 2825 | A:1 D:1 |
| 2779 | F:1 K:1 | 2826 | B:1 |
| 2780 | A:7 | 2827 | B:1 C:1 D:1 |
| 2781 | K:1 | 2828 | A:1 C:34 J:1 |
| 2782 | B:2 C:1 F:1 H:2 | 2829 | K:1 |
| 2783 | B:2 | 2830 | K:1 |
| 2784 | K:1 | 2878 | A:1 H:1 |
| 2831 | K:1 | 2879 | C:4 |
| 2832 | B:1 F:4 I:1 K:3 | 2880 | K:2 |
| 2833 | K:1 | 2881 | F:2 K:23 |
| 2834 | B:3 C:11 I:1 | 2882 | K:1 |
| 2835 | A:1 | 2883 | B:1 |
| 2836 | D:2 H:1 | 2884 | B:5 C:1 |
| 2837 | K:1 | 2885 | K:1 |
| 2838 | F:3 | 2886 | D:1 |
| 2839 | A:1 B:2 H:2 | 2887 | F:4 |
| 2840 | K:1 | 2888 | A:2 C:1 F:1 H:1 K:3 |
| 2841 | K:1 | 2889 | F:1 |
| 2842 | K:1 | 2890 | F:1 |
| 2843 | K:1 | 2891 | A:1 B:1 C:1 F:1 H:1 |
| 2844 | A:1 B:1 C:2 | 2892 | A:7 |
| 2845 | A:4 B:26 C:39 D:6 H:3 J:1 K:2 | 2893 | F:1 K:7 |
| 2846 | D:1 | 2894 | F:4 K:10 |
| 2847 | B:1 | 2895 | B:1 |
| 2848 | C:1 | 2896 | H:3 |
| 2849 | A:2 | 2897 | F:1 |
| 2850 | K:1 | 2898 | H:1 |
| 2851 | C:1 | 2899 | K:5 |
| 2852 | F:5 K:6 | 2900 | B:1 I:1 |
| 2853 | A:1 F:1 H:8 | 2901 | F:1 |
| 2854 | B:1 C:5 | 2902 | B:6 C:1 |
| 2855 | D:1 K:10 | 2903 | F:1 |
| 2856 | A:1 H:1 K:1 | 2904 | C:7 |
| 2857 | B:1 | 2905 | A:3 |
| 2858 | K:1 | 2906 | B:1 |
| 2859 | B:1 | 2907 | F:1 H:2 |
| 2860 | A:2 B:3 C:1 | 2908 | C:15 |
| 2861 | B:1 | 2909 | C:1 |
| 2862 | F:1 | 2910 | F:1 |
| 2863 | A:7 F:15 K:21 | 2911 | A:2 B:2 C:8 D:1 |
| 2864 | D:1 H:1 | 2912 | K:2 |
| 2865 | A:2 | 2913 | K:2 |
| 2866 | K:2 | 2914 | A:3 F:1 H:1 |
| 2867 | F:1 K:3 | 2915 | F:1 |
| 2868 | K:3 | 2916 | C:15 |
| 2869 | B:4 | 2917 | B:1 |
| 2870 | A:12 B:2 D:3 H:1 I:11 | 2918 | F:1 |
| 2871 | I:1 | 2919 | B:1 D:1 K:2 |
| 2872 | F:1 | 2920 | B:2 |
| 2873 | K:3 | 2921 | F:2 K:9 |
| 2874 | F:3 K:35 | 2922 | B:3 |
| 2875 | K:1 | 2923 | F:1 |
| 2876 | H:3 | 2924 | A:1 B:4 |
| 2877 | B:2 C:1 | 2971 | B:2 |
| 2925 | B:1 C:2 H:20 I:1 K2 | 2972 | F:1 |
| 2926 | F:3 | 2973 | K:1 |
| 2927 | H:2 | | |

TABLE V-continued

(Spatial distribution)

| Seq Id No. | Tissue distribution | Seq Id No. | Tissue distribution |
|---|---|---|---|
| 2928 | H:2 | 2974 | C:4 I:1 |
| 2929 | F:1 | 2975 | K:1 |
| 2930 | F:1 | 2976 | K:2 |
| 2931 | A:1 B:3 C:18 D:1 F:1 H:46 | 2977 | B:1 |
| 2932 | K:3 | 2978 | B:6 |
| 2933 | A:8 B:3 C:30 F:1 I:2 | 2979 | A:2 |
| 2934 | F:1 K:1 | 2980 | B:4 |
| 2935 | D:1 | 2981 | A:5 B:9 C:42 D:3 F:2 H:7 J:1 K:3 |
| 2936 | B:3 | 2982 | E:1 |
| 2937 | H:6 | 2983 | B:1 |
| 2938 | A:18 B:38 C:77 D:28 E:2 F:13 H:129 I:1 J:4 K:19 | 2984 | I:5 |
| | | 2985 | A:7 |
| 2939 | F:1 | 2986 | I:3 |
| 2940 | A:1 B:5 C:2 D:1 F:1 H:46 | 2987 | C:1 |
| 2941 | I:3 | 2988 | F:1 |
| 2942 | F:1 | 2989 | B:2 |
| 2943 | B:3 | 2990 | H:2 |
| 2944 | C:5 | 2991 | D:3 H:2 |
| 2945 | A:27 H:8 I:1 | 2992 | H:1 |
| 2946 | A:1 | 2993 | F:1 |
| 2947 | K:2 | 2994 | B:1 |
| 2948 | H:1 | 2995 | F:1 K:13 |
| 2949 | B:4 C:6 | 2996 | A:1 B:1 |
| 2950 | F:1 | 2997 | C:15 |
| 2951 | D:3 | 2998 | K:2 |
| 2952 | A:2 H:2 | 2999 | B:1 |
| 2953 | F:1 | 3000 | K:1 |
| 2954 | B:1 | 3001 | A:10 B:9 |
| 2955 | C:1 | 3002 | C:1 D:1 |
| 2956 | F:1 | 3003 | B:1 C:1 D:1 H:2 |
| 2957 | F:1 | 3004 | F:1 |
| 2958 | F:1 | 3005 | C:7 D:1 F:4 K:31 |
| 2959 | C:2 | 3006 | A:1 F:2 H:1 K:3 |
| 2960 | F:1 | 3007 | A:3 B:2 C:11 D:1 H:1 K:1 |
| 2961 | F:1 | 3008 | C:2 H:1 K:1 |
| 2962 | K:2 | 3009 | B:1 |
| 2963 | K:2 | 3010 | C:5 |
| 2964 | B:6 | 3011 | C:1 K:2 |
| 2965 | F:1 | 3012 | A:2 |
| 2966 | F:1 K:1 | 3013 | F:5 K:9 |
| 2967 | H:1 | 3014 | K:2 |
| 2968 | A:8 B:7 D:1 H:4 I:6 K:1 | 3015 | C:1 |
| 2969 | H:2 | 3016 | A:1 D:2 |
| 2970 | A:3 B:7 C:8 D:2 H:2 K:2 | 3017 | A:2 |
| 3018 | F:1 K:2 | 3065 | B:1 |
| 3019 | H:2 | 3066 | K:3 |
| 3020 | H:1 | 3067 | K:10 |
| 3021 | K:2 | 3068 | A:8 |
| 3022 | I:2 | 3069 | F:8 K:2 |
| 3023 | A:4 | 3070 | K:2 |
| 3024 | I:4 | 3071 | F:1 K:1 |
| 3025 | C:11 H:1 | 3072 | A:9 C:1 |
| 3026 | K:1 | 3073 | K:1 |
| 3027 | K:2 | 3074 | K:1 |
| 3028 | K:1 | 3075 | K:1 |
| 3029 | J:15 | 3076 | C:3 |
| 3030 | A:13 | 3077 | K:1 |
| 3031 | B:2 | 3078 | H:1 |
| 3032 | F:1 K:1 | 3079 | K:1 |
| 3033 | K:1 | 3080 | K:1 |
| 3034 | A:8 F:14 I:2 K:5 | 3081 | K:1 |
| 3035 | D:1 | 3082 | K:1 |
| 3036 | F:2 K:1 | 3083 | K:1 |
| 3037 | H:2 | 3084 | F:21 K:2 |
| 3038 | H:3 | 3085 | H:2 |
| 3039 | B:1 I:3 | 3086 | B:2 |
| 3040 | H:1 | 3087 | C:15 |
| 3041 | A:3 B:1 F:7 | 3088 | C:1 |
| 3042 | K:1 | 3089 | C:1 |
| 3043 | K:1 | 3090 | C:1 |
| 3044 | B:3 | 3091 | C:1 |
| 3045 | K:1 | 3092 | C:1 |
| 3046 | F:1 K:3 | 3093 | K:4 |
| 3047 | C:20 J:1 K:1 | 3094 | K:3 |
| 3048 | K:1 | 3095 | K:1 |
| 3049 | A:2 B:12 C:3 D:1 H:1 | 3096 | F:4 K:16 |
| 3050 | K:1 | 3097 | C:1 |
| 3051 | K:1 | 3098 | D:1 |
| 3052 | K:1 | 3099 | A:5 B:6 C:14 H:2 |
| 3053 | F:2 K:1 | 3100 | B:1 |
| 3054 | K:1 | 3101 | B:1 |
| 3055 | K:1 | 3102 | H:1 |
| 3056 | A:1 B:1 K:1 | 3103 | K:2 |
| 3057 | F:3 K:1 | 3104 | K:3 |
| 3058 | K:3 | 3105 | K:1 |
| 3059 | F:2 | 3106 | K:1 |
| 3060 | F:3 K:5 | 3107 | C:7 |
| 3061 | F:2 K:7 | 3108 | H:1 |
| 3062 | K:1 | 3109 | F:8 K:1 |
| 3063 | K:1 | 3110 | H:1 |
| 3064 | B:2 | 3111 | A:1 C:4 D:1 |
| 3112 | B:3 | 3158 | A:4 |
| 3113 | K:1 | 3159 | A:5 B:1 C:2 D:3 F:1 H:3 K:2 |
| 3114 | F:1 K:3 | 3160 | A:4 C:2 D:3 F:1 H:2 K:1 |
| 3115 | C:2 | 3161 | A:1 |
| 3116 | F:1 K:3 | 3162 | F:11 K:4 |
| 3117 | A:6 | 3163 | K:3 |
| 3118 | K:2 | 3164 | C:4 J:1 |
| 3119 | F:1 | 3165 | A:6 |
| 3120 | F:1 | 3166 | K:2 |
| 3121 | A:7 D:7 F:21 H:9 K:21 | 3167 | F:1 |
| 3122 | A:7 B:1 D:7 F:21 H:9 K:20 | 3168 | A:2 D:1 |
| 3123 | F:1 | 3169 | F:1 K:1 |
| 3124 | A:2 | 3170 | K:8 |
| 3125 | A:2 | 3171 | F:2 |
| 3126 | I:1 K:1 | 3172 | A:15 C:13 H:1 |
| 3127 | C:5 H:1 | 3173 | K:2 |
| 3128 | B:1 F:4 K:1 | 3174 | K:1 |
| 3129 | F:1 | 3175 | K:3 |
| 3130 | A:4 | 3176 | D:1 F:1 |
| 3131 | B:1 | 3177 | F:2 |
| 3132 | F:1 | 3178 | A:1 B:5 C:13 D:2 H:4 I:1 |
| 3133 | A:2 B:8 C:55 D:5 H:9 J:4 K:3 | 3179 | A:1 H:3 |
| 3134 | E:1 | 3180 | F:1 |
| 3135 | D:1 | 3181 | A:2 B:1 D:2 |
| 3136 | H:1 | 3182 | A:1 B:4 C:16 J:1 |
| 3137 | K:1 | 3183 | C:20 H:1 |
| 3138 | F:1 K:1 | 3184 | B:1 |
| 3139 | D:1 H:1 | 3185 | F:1 |
| 3140 | F:1 | 3186 | K:7 |
| 3141 | F:1 | 3187 | A:4 |
| 3142 | F:1 K:1 | 3188 | A:2 C:5 H:1 |
| 3143 | B:2 | 3189 | F:1 |
| 3144 | A:10 B:25 C:47 D:4 F:1 H:8 I:1 J:2 K:2 | 3190 | F:1 |
| | | 3191 | F:1 |
| 3145 | A:4 B:4 C:14 D:2 F:3 H:2 K:24 | 3192 | A:1 B:3 H:2 K:1 |
| 3146 | F:2 K:3 | 3193 | F:2 K:1 |
| 3147 | A:5 B:1 | 3194 | A:8 |
| 3148 | A:3 | 3195 | C:3 |
| 3149 | A:1 F:5 H:4 K:12 | 3196 | A:3 |
| 3150 | K:3 | 3197 | B:2 |
| 3151 | D:1 F:1 H:3 K:3 | 3198 | B:1 |
| 3152 | F:1 K:4 | 3199 | K:2 |
| 3153 | H:4 | 3200 | F:1 |
| 3154 | K:1 | 3201 | F:1 |
| 3155 | F:5 | 3202 | B:1 |
| 3156 | A:3 B:1 C:14 F:1 J:67 | 3203 | B:1 |
| 3157 | A:2 B:2 C:2 F:1 | 3204 | A:6 B:1 C:4 H:24 I:3 K:1 |
| 3205 | C:7 | 3252 | A:2 B:2 C:2 H:25 K:9 |
| 3206 | F:1 | 3253 | A:2 B:2 C:2 H:26 K:9 |
| 3207 | F:1 | 3254 | A:48 B:29 C:8 D:18 E:2 F:25 H:235 K:85 |
| 3208 | F:1 K:2 | | |

TABLE V-continued
(Spatial distribution)

| Seq Id No. | Tissue distribution | Seq Id No. | Tissue distribution |
|---|---|---|---|
| 3209 | F:1 K:1 | 3255 | F:1 |
| 3210 | F:1 | 3256 | A:1 |
| 3211 | B:1 C:4 H:2 | 3257 | H:1 |
| 3212 | B:1 | 3258 | D:2 |
| 3213 | K:1 | 3259 | A:2 |
| 3214 | K:1 | 3260 | H:1 |
| 3215 | C:2 | 3261 | H:1 |
| 3216 | K:1 | 3262 | C:1 |
| 3217 | A:10 | 3263 | B:1 |
| 3218 | I:1 | 3264 | A:3 |
| 3219 | F:5 K:1 | 3265 | A:2 |
| 3220 | K:1 | 3266 | C:17 |
| 3221 | K:2 | 3267 | H:1 |
| 3222 | A:1 | 3268 | H:1 |
| 3223 | F:5 K:1 | 3269 | B:4 |
| 3224 | A:1 | 3270 | H:1 |
| 3225 | B:1 F:3 K:1 | 3271 | B:4 C:1 D:3 E:1 K:3 |
| 3226 | A:1 B:1 C:1 I:3 K:2 | 3272 | H:1 |
| 3227 | C:5 | 3273 | I:2 |
| 3228 | K:3 | 3274 | K:1 |
| 3229 | H:1 | 3275 | F:2 K:7 |
| 3230 | A:4 B:2 C:2 F:2 K:1 | 3276 | F:2 K:15 |
| 3231 | A:1 B:4 K:1 | 3277 | A:1 H:1 |
| 3232 | K:2 | 3278 | H:1 |
| 3233 | H:1 | 3279 | K:1 |
| 3234 | H:1 | 3280 | F:4 K:1 |
| 3235 | H:1 | 3281 | K:2 |
| 3236 | B:2 D:3 H:2 I:2 | 3282 | F:1 K:5 |
| 3237 | B:1 C:1 | 3283 | H:4 |
| 3238 | B:4 | 3284 | D:1 |
| 3239 | A:1 B:1 C:8 D:1 H:4 J:3 K:1 | 3285 | A:1 B:1 |
| 3240 | C:3 | 3286 | H:1 |
| 3241 | A:2 C:6 D:1 H:2 J:3 | 3287 | A:1 D:1 |
| 3242 | B:8 C:1 H:1 | 3288 | B:1 C:1 |
| 3243 | D:2 | 3289 | B:1 |
| 3244 | B:1 | 3290 | C:23 |
| 3245 | K:2 | 3291 | C:1 |
| 3246 | H:1 | 3292 | C:1 |
| 3247 | H:1 | 3293 | K:2 |
| 3248 | F:2 K:1 | 3294 | H:1 |
| 3249 | B:2 | 3295 | C:19 D:1 |
| 3250 | A:2 B:2 C:7 H:20 K:9 | 3296 | H:1 |
| 3251 | A:2 B:2 C:2 H:20 K:12 | 3297 | A:3 B:3 C:1 D:3 H:1 K:2 |
| 3298 | H:1 | 3344 | A:2 B:1 C:26 D:4 H:2 J:3 |
| 3299 | H:1 | 3345 | H:6 |
| 3300 | H:1 | 3346 | B:1 C:11 |
| 3301 | F:5 K:1 | 3347 | B:1 C:4 |
| 3302 | I:1 | 3348 | D:1 |
| 3303 | H:1 | 3349 | B:2 |
| 3304 | C:1 | 3350 | B:1 |
| 3305 | A:2 B:4 C:9 D:1 H:4 K:1 | 3351 | B:1 |
| 3306 | F:1 K:1 | 3352 | B:1 |
| 3307 | I:1 | 3353 | K:2 |
| 3308 | K:4 | 3354 | C:15 |
| 3309 | B:3 | 3355 | C:1 |
| 3310 | H:1 | 3356 | H:1 |
| 3311 | A:3 B:1 | 3357 | F:5 K:1 |
| 3312 | K:2 | 3358 | D:2 |
| 3313 | H:1 | 3359 | H:1 |
| 3314 | A:1 | 3360 | K:2 |
| 3315 | H:1 | 3361 | F:1 K:1 |
| 3316 | H:1 | 3362 | A:2 B:5 C:58 D:2 F:22 H:3 I:3 J:9 K:122 |
| 3317 | H:1 | | |
| 3318 | H:1 | 3363 | A:1 B:4 C:39 D:2 F:22 H:3 I:3 J:9 K:106 |
| 3319 | K:4 | | |
| 3320 | F:1 | 3364 | A:1 B:5 C:54 D:2 F:22 H:3 I:3 J:9 K:130 |
| 3321 | K:2 | 3365 | C:1 |
| 3322 | F:11 K:2 | 3366 | F:1 |
| 3323 | H:8 | 3367 | H:1 |
| 3324 | K:1 | 3368 | A:5 D:1 |
| 3325 | K:17 | 3369 | A:26 B:12 C:2 K:1 |
| 3326 | H:1 | 3370 | D:1 |
| 3327 | D:1 F:1 | 3371 | B:1 |
| 3328 | A:4 | 3372 | A:1 |
| 3329 | B:2 | 3373 | A:1 |
| 3330 | B:1 C:1 | 3374 | A:1 |
| 3331 | A:5 B:5 C:1 H:1 K:4 | 3375 | A:1 |
| 3332 | A:1 | 3376 | A:1 |
| 3333 | H:1 | 3377 | A:1 |
| 3334 | H:1 | 3378 | A:1 |
| 3335 | A:2 | 3379 | A:2 |
| 3336 | H:1 | 3380 | K:2 |
| 3337 | B:2 C:1 K:1 | 3381 | B:1 |
| 3338 | C:2 D:1 F:2 K:4 | 3382 | F:3 H:1 K:11 |
| 3339 | H:1 | 3383 | H:2 |
| 3340 | K:2 | 3384 | A:1 C:17 D:2 H:3 |
| 3341 | K:2 | 3385 | H:4 |
| 3342 | A:3 | 3386 | H:1 |
| 3343 | A:19 B:70 C:89 D:29 F:1 H:36 I:1 J:1 K:14 | 3387 | I:3 |
| | | 3388 | K:3 |
| 3389 | K:2 | 3436 | K:4 |
| 3390 | H:1 | 3437 | B:1 |
| 3391 | F:9 K:1 | 3438 | F:1 K:5 |
| 3392 | F:2 | 3439 | B:1 |
| 3393 | H:1 | 3440 | A:1 B:1 C:3 |
| 3394 | I:2 | 3441 | H:9 |
| 3395 | H:2 | 3442 | B:5 |
| 3396 | F:1 K:1 | 3443 | D:3 |
| 3397 | H:3 | 3444 | F:1 K:1 |
| 3398 | H:1 | 3445 | F:1 |
| 3399 | H:1 | 3446 | H:4 |
| 3400 | H:1 | 3447 | K:2 |
| 3401 | H:1 | 3448 | C:9 H:2 |
| 3402 | K:2 | 3449 | H:1 |
| 3403 | H:1 | 3450 | H:6 |
| 3404 | H:1 | 3451 | B:3 |
| 3405 | H:1 | 3452 | K:1 |
| 3406 | A:11 | 3453 | K:1 |
| 3407 | H:1 | 3454 | B:1 F:6 |
| 3408 | H:1 | 3455 | F:1 K:3 |
| 3409 | K:1 | 3456 | F:1 K:6 |
| 3410 | C:2 | 3457 | F:1 K:21 |
| 3411 | F:5 K:2 | 3458 | F:5 |
| 3412 | A:1 B:1 | 3459 | C:6 H:1 J:1 |
| 3413 | K:1 | 3460 | B:1 H:4 K:4 |
| 3414 | H:1 | 3461 | D:1 |
| 3415 | A:1 C:1 | 3462 | K:2 |
| 3416 | H:1 | 3463 | H:1 |
| 3417 | F:1 K:2 | 3464 | H:1 |
| 3418 | A:2 K:1 | 3465 | A:1 D:1 |
| 3419 | H:12 | 3466 | A:51 B:69 C:43 D:16 E:2 F:6 H:2 I:23 J:9 K:20 |
| 3420 | F:2 | | |
| 3421 | A:1 F:1 K:5 | 3467 | B:3 |
| 3422 | F:26 K:172 | 3468 | K:1 |
| 3423 | F:5 K:14 | 3469 | K:1 |
| 3424 | B:1 | 3470 | K:1 |
| 3425 | H:1 | 3471 | H:1 |
| 3426 | K:1 | 3472 | K:2 |
| 3427 | F:1 | 3473 | I:2 |
| 3428 | I:1 | 3474 | H:2 |
| 3429 | B:1 | 3475 | H:1 |
| 3430 | F:4 K:35 | 3476 | A:1 B:1 C:1 |
| 3431 | A:1 B:4 C:9 D:1 | 3477 | K:1 |
| 3432 | B:1 | 3478 | B:2 |
| 3433 | F:5 K:2 | 3479 | F:1 |
| 3434 | D:2 | 3480 | H:1 |
| 3435 | F:1 K:8 | 3481 | H:1 |
| 3482 | F:4 K:19 | 3529 | B:1 |
| 3483 | F:5 K:7 | 3530 | K:1 |
| 3484 | F:2 K:15 | 3531 | H:1 |
| 3485 | F:1 | 3532 | H:1 |
| 3486 | K:1 | 3533 | H:1 |
| 3487 | K:1 | 3534 | H:1 K:3 |
| 3488 | F:1 | 3535 | I:2 |

TABLE V-continued

(Spatial distribution)

| Seq Id No. | Tissue distribution |
|---|---|
| 3489 | B:2 |
| 3490 | A:1 B:10 H:1 |
| 3491 | A:7 B:1 D:3 H:1 K:1 |
| 3492 | A:5 B:1 D:1 H:1 K:1 |
| 3493 | K:2 |
| 3494 | K:2 |
| 3495 | H:1 |
| 3496 | K:1 |
| 3497 | A:1 K:1 |
| 3498 | C:1 D:3 H:1 |
| 3499 | B:2 |
| 3500 | B:1 E:1 H:1 |
| 3501 | F:1 K:6 |
| 3502 | K:1 |
| 3503 | F:1 |
| 3504 | H:1 |
| 3505 | F:2 |
| 3506 | A:1 |
| 3507 | K:2 |
| 3508 | F:1 K:1 |
| 3509 | A:1 B:14 C:42 D:16 F:6 H:10 K:9 |
| 3510 | B:3 C:4 D:2 F:4 H:4 K:3 |
| 3511 | D:1 |
| 3512 | F:3 |
| 3513 | H:1 |
| 3514 | A:1 C:15 D:1 H:1 |
| 3515 | B:1 |
| 3516 | H:1 |
| 3517 | H:1 |
| 3518 | A:3 D:1 H:2 |
| 3519 | A:1 H:2 |
| 3520 | A:2 |
| 3521 | B:2 |
| 3522 | B:1 F:7 |
| 3523 | K:3 |
| 3524 | A:3 B:1 D:1 K:2 |
| 3525 | A:3 B:4 D:1 F:1 |
| 3526 | H:1 |
| 3527 | K:1 |
| 3528 | A:16 |
| 3576 | H:1 |
| 3577 | H:1 |
| 3578 | C:6 |
| 3579 | H:1 |
| 3580 | H:1 |
| 3581 | H:2 I:4 |
| 3582 | A:7 B:6 C:1 D:19 K:1 |
| 3583 | F:5 K:2 |
| 3584 | A:27 B:8 D:7 F:3 H:3 K:1 |
| 3585 | H:1 |
| 3586 | D:1 |
| 3587 | D:1 |
| 3588 | F:10 K:5 |
| 3589 | K:2 |
| 3590 | K:15 |
| 3591 | K:2 |
| 3592 | H:1 |
| 3593 | F:6 K:36 |
| 3594 | H:6 |
| 3595 | F:1 K:5 |
| 3596 | K:1 |
| 3597 | K:6 |
| 3598 | A:1 D:1 |
| 3599 | F:2 H:1 K:4 |
| 3600 | A:2 C:3 |
| 3601 | C:27 |
| 3602 | F:1 |
| 3603 | F:1 |
| 3604 | B:2 |
| 3605 | D:1 |
| 3536 | H:1 |
| 3537 | H:1 |
| 3538 | A:8 |
| 3539 | K:1 |
| 3540 | B:3 |
| 3541 | H:1 |
| 3542 | H:1 |
| 3543 | H:1 |
| 3544 | H:1 |
| 3545 | H:1 |
| 3546 | B:4 |
| 3547 | B:1 C:1 |
| 3548 | H:2 |
| 3549 | H:1 |
| 3550 | H:1 |
| 3551 | I:3 |
| 3552 | A:2 |
| 3553 | A:13 |
| 3554 | H:1 |
| 3555 | C:28 D:3 K:3 |
| 3556 | C:31 D:3 K:2 |
| 3557 | F:3 K:1 |
| 3558 | H:1 |
| 3559 | F:1 K:2 |
| 3560 | D:1 |
| 3561 | A:10 B:1 C:3 H:5 |
| 3562 | K:1 |
| 3563 | H:1 |
| 3564 | A:37 |
| 3565 | A:5 |
| 3566 | A:1 |
| 3567 | K:2 |
| 3568 | A:3 B:35 C:23 D:6 F:2 H:3 K:3 |
| 3569 | A:9 B:42 C:42 D:2 H:9 K:6 |
| 3570 | F:1 |
| 3571 | C:1 |
| 3572 | C:1 |
| 3573 | F:11 K:1 |
| 3574 | A:1 B:2 |
| 3575 | H:1 |
| 3623 | C:4 |
| 3624 | B:3 |
| 3625 | H:1 |
| 3626 | H:1 |
| 3627 | C:2 D:2 H:4 K:1 |
| 3628 | F:6 K:2 |
| 3629 | F:1 K:3 |
| 3630 | K:1 |
| 3631 | A:4 |
| 3632 | C:1 |
| 3633 | H:1 |
| 3634 | H:1 |
| 3635 | B:1 |
| 3636 | H:1 |
| 3637 | H:6 |
| 3638 | F:1 K:1 |
| 3639 | C:3 |
| 3640 | C:1 |
| 3641 | C:1 |
| 3642 | B:1 |
| 3643 | H:1 |
| 3644 | F:1 K:3 |
| 3645 | B:1 |
| 3646 | H:1 |
| 3647 | K:1 |
| 3648 | H:1 |
| 3649 | H:1 |
| 3650 | A:2 |
| 3651 | F:1 |
| 3652 | A:1 B:4 C:2 D:1 F:1 |
| 3606 | K:1 |
| 3607 | A:1 D:1 |
| 3608 | F:14 K:3 |
| 3609 | A:1 B:3 |
| 3610 | A:3 |
| 3611 | H:1 |
| 3612 | A:11 B:7 C:10 H:5 K:1 |
| 3613 | A:1 |
| 3614 | C:3 F:1 H:1 |
| 3615 | C:2 |
| 3616 | C:14 D:1 F:1 J:1 |
| 3617 | K:2 |
| 3618 | A:6 B:5 C:3 F:1 H:31 |
| 3619 | H:1 |
| 3620 | A:1 |
| 3621 | K:1 |
| 3622 | K:2 |
| 3669 | B:1 |
| 3670 | K:7 |
| 3671 | C:3 |
| 3672 | C:14 H:3 |
| 3673 | C:1 |
| 3674 | K:1 |
| 3675 | C:1 |
| 3676 | K:2 |
| 3677 | K:1 |
| 3678 | K:2 |
| 3679 | F:8 K:1 |
| 3680 | K:4 |
| 3681 | F:6 K:4 |
| 3682 | H:1 |
| 3683 | D:1 |
| 3684 | A:10 |
| 3685 | A:2 |
| 3686 | H:1 |
| 3687 | K:1 |
| 3688 | H:2 |
| 3689 | K:3 |
| 3690 | F:6 |
| 3691 | K:12 |
| 3692 | H:1 |
| 3693 | D:1 H:1 |
| 3694 | H:2 |
| 3695 | H:1 |
| 3696 | F:1 |
| 3697 | K:2 |
| 3698 | H:5 |
| 3699 | K:2 |
| 3700 | H:1 |
| 3701 | F:3 K:25 |
| 3702 | F:2 K:5 |
| 3703 | C:14 |
| 3704 | C:1 |
| 3705 | A:1 |
| 3706 | F:2 K:3 |
| 3707 | H:1 |
| 3708 | A:2 C:7 H:3 K:2 |
| 3709 | A:1 B:2 C:1 H:2 K:1 |
| 3710 | K:2 |
| 3711 | F:3 |
| 3712 | F:1 K:8 |
| 3713 | F:2 H:1 K:14 |
| 3714 | K:1 |
| 3715 | B:2 |
| 3763 | C:4 |
| 3764 | B:2 |
| 3765 | K:1 |
| 3766 | A:2 B:2 |
| | H:3 K:1 |
| 3653 | A:5 |
| 3654 | H:1 |
| 3655 | I:1 |
| 3656 | C:1 |
| 3657 | H:1 |
| 3658 | F:1 |
| 3659 | C:1 |
| 3660 | H:1 |
| 3661 | C:1 |
| 3662 | B:2 |
| 3663 | K:2 |
| 3664 | A:9 B:6 C:73 D:5 F:122 H:112 K:44 |
| 3665 | B:1 |
| 3666 | A:7 B:2 C:24 D:3 F:67 H:58 K:25 |
| 3667 | B:1 |
| 3668 | K:1 |
| 3716 | A:2 F:1 K:3 |
| 3717 | A:1 C:7 K:7 |
| 3718 | H:1 |
| 3719 | F:2 K:11 |
| 3720 | F:2 K:15 |
| 3721 | K:2 |
| 3722 | C:9 |
| 3723 | F:6 |
| 3724 | F:2 |
| 3725 | H:1 |
| 3726 | C:4 |
| 3727 | F:1 K:3 |
| 3728 | K:1 |
| 3729 | H:1 |
| 3730 | A:1 |
| 3731 | F:2 |
| 3732 | F:1 K:3 |
| 3733 | F:3 K:1 |
| 3734 | H:1 |
| 3735 | H:1 |
| 3736 | F:1 |
| 3737 | H:1 |
| 3738 | C:1 C:55 D:6 J:18 |
| 3739 | C:4 |
| 3740 | B:3 |
| 3741 | K:1 |
| 3742 | A:8 B:8 C:16 D:3 F:9 H:6 I:3 K:5 |
| 3743 | A:2 |
| 3744 | A:9 B:12 C:18 D:1 H:4 K:1 |
| 3745 | D:1 |
| 3746 | H:3 |
| 3747 | B:1 |
| 3748 | C:1 D:2 H:2 |
| 3749 | A:1 B:3 C:11 D:1 H:2 |
| 3750 | A:1 B:4 C:1 |
| 3751 | A:1 B:1 H:1 |
| 3752 | F:1 |
| 3753 | A:3 B:5 C:9 D:4 H:7 I:1 K:1 |
| 3754 | A:5 F:1 |
| 3755 | K:1 |
| 3756 | A:3 C:21 D:1 |
| 3757 | C:1 H:2 |
| 3758 | B:1 |
| 3759 | A:3 B:5 D:2 H:3 I:1 |
| 3760 | F:3 |
| 3761 | B:3 |
| 3762 | K:1 |
| 3808 | F:1 K:1 |
| 3809 | A:4 B:1 C:1 H:1 I:2 |
| 3810 | F:2 |
| 3811 | F:1 K:6 |

TABLE V-continued

(Spatial distribution)

| Seq Id No. | Tissue distribution | Seq Id No. | Tissue distribution |
|---|---|---|---|
| 3767 | H:1 K:1 | 3812 | K:2 |
| 3768 | K:1 | 3813 | C:5 |
| 3769 | F:2 | 3814 | A:2 B:1 |
| 3770 | E:1 | 3815 | A:2 |
| 3771 | C:4 F:6 H:2 I:1 K:4 | 3816 | A:2 |
| 3772 | B:3 | 3817 | A:1 H:1 |
| 3773 | F:2 | 3818 | B:1 K:1 |
| 3774 | A:1 B:6 C:1 D:1 H:1 | 3819 | B:2 |
| 3775 | C:27 J:2 | 3820 | B:2 |
| 3776 | A:4 B:5 C:9 D:2 I:1 | 3821 | B:2 |
| 3777 | K:2 | 3822 | C:21 |
| 3778 | A:4 F:11 H:6 K:1 | 3823 | K:1 |
| 3779 | A:11 B:26 C:69 D:8 F:2 H:4 I:1 J:4 K:3 | 3824 | F:1 |
|  |  | 3825 | A:2 |
| 3780 | A:11 B:27 C:77 D:9 F:2 H:4 I:1 J:5 K:3 | 3826 | A:15 B:30 C:26 F:1 H:3 K:1 |
|  |  | 3827 | F:13 K:76 |
| 3781 | H:1 K:1 | 3828 | K:1 |
| 3782 | F:1 K:1 | 3829 | A:3 D:1 F:5 K:9 |
| 3783 | H:1 | 3830 | F:1 K:10 |
| 3784 | K:3 | 3831 | H:2 |
| 3785 | F:4 | 3832 | A:1 |
| 3786 | F:10 K:8 | 3833 | H:1 |
| 3787 | F:2 | 3834 | K:2 |
| 3788 | K:2 | 3835 | K:2 |
| 3789 | A:2 | 3836 | H:1 |
| 3790 | A:4 | 3837 | K:2 |
| 3791 | B:6 | 3838 | H:1 |
| 3792 | A:9 | 3839 | A:1 F:7 K:16 |
| 3793 | A:130 B:1 C:1 H:2 I:1 | 3840 | A:1 F:5 K:16 |
| 3794 | A:155 B:3 C:1 H:2 I:3 | 3841 | H:1 |
| 3795 | A:1 | 3842 | K:1 |
| 3796 | H:1 | 3843 | K:1 |
| 3797 | A:1 | 3844 | F:1 |
| 3798 | A:1 | 3845 | H:2 |
| 3799 | A:1 | 3846 | A:2 |
| 3800 | F:1 | 3847 | A:1 |
| 3801 | A:7 | 3848 | A:55 |
| 3802 | A:7 | 3849 | A:1 |
| 3803 | A:11 C:1 F:1 H:1 K:3 | 3850 | A:1 |
| 3804 | K:1 | 3851 | A:1 |
| 3805 | H:1 | 3852 | A:1 |
| 3806 | H:1 | 3853 | A:1 |
| 3807 | A:1 C:5 | 3854 | A:1 |
| 3855 | A:1 | 7762 | H:1 |
| 3856 | A:1 | 7763 | H:1 |
| 3857 | A:1 | 7764 | H:1 |
| 3858 | A:1 | 7765 | H:1 |
| 3859 | A:1 | 7766 | H:1 |
| 3860 | A:2 | 7767 | H:1 |
| 3861 | B:3 | 7768 | H:1 |
| 3862 | C:1 | 7769 | H:1 |
| 3863 | H:1 | 7770 | H:1 |
| 3864 | B:2 | 7771 | H:1 |
| 3865 | A:1 H:9 | 7772 | H:1 |
| 3866 | B:4 | 7773 | H:1 |
| 3867 | F:1 | 7774 | H:1 |
| 3868 | F:4 K:13 | 7775 | H:1 |
| 3869 | I:1 | 7776 | H:1 |
| 3870 | F:1 K:1 | 7777 | H:1 |
| 3871 | F:1 | 7778 | H:1 |
| 3872 | I:1 | 7779 | H:1 |
| 3873 | H:1 | 7780 | H:1 |
| 3874 | A:8 | 7781 | H:1 |
| 3875 | H:1 | 7782 | H:1 |
| 3876 | H:1 | 7783 | H:1 |
| 3877 | H:1 | 7784 | H:1 |
| 3878 | H:1 | 7785 | H:1 |
| 3879 | K:1 | 7786 | H:1 |
| 3880 | A:8 | 7787 | H:1 |
| 3881 | H:1 | 7788 | H:1 |
| 3882 | A:3 B:4 C:2 | 7789 | H:1 |
| 3883 | H:1 | 7790 | H:1 |
| 7744 | H:1 | 7791 | H:1 |
| 7745 | H:1 | 7792 | H:1 |
| 7746 | H:1 | 7793 | H:1 |
| 7747 | H:1 | 7794 | H:1 |
| 7748 | H:1 | 7795 | H:1 |
| 7749 | H:1 | 7796 | H:1 |
| 7750 | H:1 | 7797 | H:1 |
| 7751 | H:1 | 7798 | H:1 |
| 7752 | H:1 | 7799 | H:1 |
| 7753 | H:1 | 7800 | H:1 |
| 7754 | H:1 | 7801 | H:1 |
| 7755 | H:1 | 7802 | H:1 |
| 7756 | H:1 | 7803 | H:1 |
| 7757 | H:1 | 7804 | H:1 |
| 7758 | H:1 | 7805 | H:1 |
| 7759 | H:1 | 7806 | H:1 |
| 7760 | H:1 | 7807 | H:1 |
| 7761 | H:1 | 7808 | H:1 |
| 7809 | H:1 | 7856 | H:1 |
| 7810 | H:1 | 7857 | H:1 |
| 7811 | H:1 | 7858 | H:1 |
| 7812 | H:1 | 7859 | H:1 |
| 7813 | H:1 | 7860 | H:1 |
| 7814 | H:1 | 7861 | H:1 |
| 7815 | H:1 | 7862 | H:1 |
| 7816 | H:1 | 7863 | H:1 |
| 7817 | H:1 | 7864 | H:1 |
| 7818 | H:1 | 7865 | H:1 |
| 7819 | H:11 | 7866 | H:1 |
| 7820 | H:1 | 7867 | H:1 |
| 7821 | H:1 | 7868 | H:1 |
| 7822 | H:1 | 7869 | H:1 |
| 7823 | H:1 | 7870 | H:1 |
| 7824 | H:1 | 7871 | H:1 |
| 7825 | H:1 | 7872 | F:25 K:136 |
| 7826 | H:1 | 7873 | H:1 |
| 7827 | H:1 | 7874 | H:1 |
| 7828 | F:1 K:3 | 7875 | H:1 |
| 7829 | H:1 | 7876 | H:1 |
| 7830 | H:1 | 7877 | H:1 |
| 7831 | H:1 | 7878 | H:1 |
| 7832 | H:1 | 7879 | H:1 |
| 7833 | H:1 | 7880 | H:1 |
| 7834 | H:1 | 7881 | H:1 |
| 7835 | H:1 | 7882 | H:1 |
| 7836 | H:1 | 7883 | H:1 |
| 7837 | F:1 K:3 | 7884 | H:1 |
| 7838 | H:1 | 7885 | H:1 |
| 7839 | H:1 | 7886 | H:1 |
| 7840 | H:1 | 7887 | H:1 |
| 7841 | H:1 | 7888 | H:1 |
| 7842 | H:1 | 7889 | H:1 |
| 7843 | H:1 | 7890 | H:1 |
| 7844 | H:1 | 7891 | H:1 |
| 7845 | F:1 K:3 | 7892 | H:1 |
| 7846 | H:1 | 7893 | H:1 |
| 7847 | H:1 | 7894 | H:1 |
| 7848 | H:1 | 7895 | H:1 |
| 7849 | H:1 | 7896 | H:1 |
| 7850 | H:1 | 7897 | H:1 |
| 7851 | F:1 K:1 | 7898 | H:1 |
| 7852 | H:1 | 7899 | H:1 |
| 7853 | H:1 | 7900 | H:1 |
| 7854 | H:1 | 7901 | H:1 |
| 7855 | H:1 | 7902 | H:1 |
| 7903 | H:1 | 7950 | H:1 |
| 7904 | H:1 | 7951 | H:1 |
| 7905 | H:1 | 7952 | H:1 |
| 7906 | H:1 | 7953 | H:1 |
| 7907 | H:1 | 7954 | H:1 |
| 7908 | H:1 | 7955 | H:1 |
| 7909 | H:1 | 7956 | H:1 |
| 7910 | H:1 | 7957 | H:1 |

TABLE V-continued

(Spatial distribution)

| Seq Id No. | Tissue distribution | Seq Id No. | Tissue distribution |
|---|---|---|---|
| 7911 | H:1 | 7958 | H:1 |
| 7912 | H:1 | 7959 | H:1 |
| 7913 | H:1 | 7960 | H:1 |
| 7914 | H:1 | 7961 | H:1 |
| 7915 | H:1 | 7962 | H:1 |
| 7916 | H:1 | 7963 | B:7 |
| 7917 | H:1 | 7964 | H:1 |
| 7918 | H:1 | 7965 | H:1 |
| 7919 | H:1 | 7966 | H:1 |
| 7920 | A:1 B:1 D:1 E:1 F:1 | 7967 | H:1 |
| 7921 | H:1 | 7968 | H:1 |
| 7922 | H:1 | 7969 | H:1 |
| 7923 | H:1 | 7970 | H:1 |
| 7924 | H:1 | 7971 | H:1 |
| 7925 | H:1 | 7972 | H:1 |
| 7926 | H:1 | 7973 | H:1 |
| 7927 | H:1 | 7974 | H:1 |
| 7928 | H:1 | 7975 | H:1 |
| 7929 | H:1 | 7976 | H:1 |
| 7930 | H:1 | 7977 | H:1 |
| 7931 | H:1 | 7978 | H:1 |
| 7932 | H:1 | 7979 | H:1 |
| 7933 | H:1 | 7980 | H:1 |
| 7934 | H:1 | 7981 | H:1 |
| 7935 | H:1 | 7982 | H:1 |
| 7936 | H:1 | 7983 | H:1 |
| 7937 | H:1 | 7984 | H:1 |
| 7938 | H:1 | 7935 | H:1 |
| 7939 | H:1 | 7986 | H:1 |
| 7940 | H:1 | 7987 | H:1 |
| 7941 | H:1 | 7988 | H:1 |
| 7942 | H:1 | 7989 | H:1 |
| 7943 | H:1 | 7990 | H:1 |
| 7944 | H:1 | 7991 | F:1 K:3 |
| 7945 | H:2 | 7992 | H:1 |
| 7946 | H:1 | 7993 | H:1 |
| 7947 | H:1 | 7994 | H:1 |
| 7948 | H:1 | 7995 | H:1 |
| 7949 | H:1 | 7996 | H:1 |
| 7997 | H:1 | 8044 | H:1 |
| 7998 | H:1 | 8045 | H:1 |
| 7999 | H:1 | 8046 | H:1 |
| 8000 | H:1 | 8047 | H:1 |
| 8001 | H:1 | 8048 | H:1 |
| 8002 | H:1 | 8049 | H:1 |
| 8003 | H:1 | 8050 | H:1 |
| 8004 | H:1 | 8051 | H:1 |
| 8005 | B:1 | 8052 | H:1 |
| 8006 | H:1 | 8053 | H:1 |
| 8007 | H:1 | 8054 | H:1 |
| 8008 | H:1 | 8055 | H:1 |
| 8009 | H:1 | 8056 | H:1 |
| 8010 | H:1 | 8057 | H:1 |
| 8011 | H:1 | 8058 | H:1 |
| 8012 | H:1 | 8059 | H:1 |
| 8013 | H:1 | 8060 | H:1 |
| 8014 | H:1 | 8061 | H:1 |
| 8015 | B:1 | 8062 | H:1 |
| 8016 | H:1 | 8063 | H:1 |
| 8017 | H:1 | 8064 | H:1 |
| 8018 | H:1 | 8065 | H:1 |
| 8019 | H:1 | 8066 | H:1 |
| 8020 | H:1 | 8067 | H:1 |
| 8021 | H:1 | 8068 | H:1 |
| 8022 | H:1 | 8069 | H:1 |
| 8023 | H:1 | 8070 | H:1 |
| 8024 | H:1 | 8071 | H:1 |
| 8025 | H:1 | 8072 | H:1 |
| 8026 | H:1 | 8073 | H:1 |
| 8027 | H:1 | 8074 | H:1 |
| 8028 | H:1 | 8075 | H:1 |
| 8029 | H:1 | 8076 | H:1 |
| 8030 | H:1 | 8077 | H:1 |
| 8031 | H:1 | 8078 | H:1 |
| 8032 | H:1 | 8079 | H:1 |
| 8033 | H:1 | 8080 | H:1 |
| 8034 | H:1 | 8081 | H:1 |
| 8035 | H:1 | 8082 | H:1 |
| 8036 | H:1 | 8083 | A:1 |
| 8037 | H:1 | 8084 | H:1 |
| 8038 | H:1 | 8085 | H:1 |
| 8039 | H:1 | 8086 | H:1 |
| 8040 | H:1 | 8087 | H:1 |
| 8041 | H:1 | 8088 | H:1 |
| 8042 | H:1 | 8089 | H:1 |
| 8043 | H:1 | 8090 | H:1 |
| 8091 | H:1 | 8138 | H:1 |
| 8092 | H:1 | 8139 | H:1 |
| 8093 | H:1 | 8140 | H:1 |
| 8094 | H:1 | 8141 | H:1 |
| 8095 | H:1 | 8142 | H:1 |
| 8096 | H:1 | 8143 | K:1 |
| 8097 | H:1 | 8144 | H:1 |
| 8098 | H:1 | 8145 | H:1 |
| 8099 | H:1 | 8146 | H:1 |
| 8100 | H:1 | 8147 | H:1 |
| 8101 | H:1 | 8148 | H:1 |
| 8102 | H:1 | 8149 | H:1 |
| 8103 | H:1 | 8150 | H:1 |
| 8104 | C:1 | 8151 | H:1 |
| 8105 | H:1 | 8152 | H:1 |
| 8106 | H:1 | 8153 | H:1 |
| 8107 | H:1 | 8154 | H:1 |
| 8108 | H:1 | 8155 | H:1 |
| 8109 | H:1 | 8156 | H:1 |
| 8110 | H:1 | 8157 | H:1 |
| 8111 | H:1 | 8158 | H:1 |
| 8112 | H:1 | 8159 | H:1 |
| 8113 | H:1 | 8160 | H:1 |
| 8114 | H:1 | 8161 | H:1 |
| 8115 | H:1 | 8162 | H:1 |
| 8116 | H:1 | 8163 | H:1 |
| 8117 | H:1 | 8164 | H:1 |
| 8118 | H:1 | 8165 | H:1 |
| 8119 | H:1 | 8166 | H:1 |
| 8120 | H:1 | 8167 | H:1 |
| 8121 | H:1 | 8168 | H:1 |
| 8122 | H:1 | 8169 | H:1 |
| 8123 | H:1 | 8170 | H:1 |
| 8124 | H:1 | 8171 | H:1 |
| 8125 | F:1 | 8172 | H:1 |
| 8126 | H:1 | 8173 | H:1 |
| 8127 | H:1 | 8174 | H:1 |
| 8128 | H:1 | 8175 | H:1 |
| 8129 | H:1 | 8176 | H:1 |
| 8130 | H:1 | 8177 | H:1 |
| 8131 | H:1 | 8178 | H:1 |
| 8132 | H:1 | 8179 | H:1 |
| 8133 | H:1 | 8180 | H:1 |
| 8134 | H:1 | 8181 | H:1 |
| 8135 | H:1 | 8182 | H:1 |
| 8136 | H:1 | 8183 | H:1 |
| 8137 | H:1 | 8184 | H:1 |
| 8185 | H:1 | 8232 | H:1 |
| 8186 | H:1 | 8233 | K:1 |
| 8187 | H:1 | 8234 | H:1 |
| 8188 | H:1 | 8235 | H:1 |
| 8189 | H:1 | 8236 | H:1 |
| 8190 | H:1 | 8237 | H:1 |
| 8191 | H:1 | 8238 | H:1 |
| 8192 | C:1 | 8239 | H:1 |
| 8193 | H:1 | 8240 | H:1 |
| 8194 | H:1 | 8241 | H:1 |
| 8195 | H:1 | 8242 | K:2 |
| 8196 | H:1 | 8243 | H:1 |
| 8197 | H:1 | 8244 | H:1 |

TABLE V-continued
(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 8198 | H:1 | 8245 | H:1 | 8318 | H:1 | 8365 | H:1 |
| 8199 | H:1 | 8246 | H:1 | 8319 | H:1 | 8366 | H:1 |
| 8200 | H:1 | 8247 | H:1 | 8320 | H:1 | 8367 | H:1 |
| 8201 | H:1 | 8248 | H:1 | 8321 | H:1 | 8368 | H:1 |
| 8202 | H:1 | 8249 | H:1 | 8322 | H:1 | 8369 | H:1 |
| 8203 | H:1 | 8250 | H:1 | 8323 | H:1 | 8370 | H:1 |
| 8204 | H:1 | 8251 | H:1 | 8324 | K:2 | 8371 | H:1 |
| 8205 | H:1 | 8252 | H:1 | 8325 | H:1 | 8372 | H:1 |
| 8206 | H:1 | 8253 | H:1 | 8373 | H:1 | 8420 | H:1 |
| 8207 | H:1 | 8254 | H:1 | 8374 | H:1 | 8421 | A:5 |
| 8208 | H:1 | 8255 | H:1 | 8375 | H:1 | 8422 | H:1 |
| 8209 | H:1 | 8256 | H:1 | 8376 | H:1 | 8423 | H:1 |
| 8210 | H:1 | 8257 | H:1 | 8377 | F:1 K:2 | 8424 | H:1 |
| 8211 | H:1 | 8258 | H:1 | 8378 | H:1 | 8425 | H:1 |
| 8212 | H:1 | 8259 | H:1 | 8379 | H:1 | 8426 | H:1 |
| 8213 | H:1 | 8260 | H:1 | 8380 | H:1 | 8427 | H:1 |
| 8214 | H:1 | 8261 | H:1 | 8381 | H:1 | 8428 | H:1 |
| 8215 | H:1 | 8262 | H:1 | 8382 | H:1 | 8429 | H:1 |
| 8216 | H:1 | 8263 | H:1 | 8383 | H:1 | 8430 | H:1 |
| 8217 | H:1 | 8264 | H:1 | 8384 | H:1 | 8431 | H:1 |
| 8218 | H:1 | 8265 | H:1 | 8385 | B:2 | 8432 | H:1 |
| 8219 | H:1 | 8266 | H:1 | 8386 | H:1 | 8433 | H:1 |
| 8220 | H:1 | 8267 | H:1 | 8387 | H:1 | 8434 | H:1 |
| 8221 | H:1 | 8268 | H:1 | 8388 | H:1 | 8435 | H:1 |
| 8222 | H:1 | 8269 | H:1 | 8389 | H:1 | 8436 | K:3 |
| 8223 | H:1 | 8270 | H:1 | 8390 | H:1 | 8437 | H:1 |
| 8224 | H:1 | 8271 | H:1 | 8391 | H:1 | 8438 | H:1 |
| 8225 | H:1 | 8272 | H:1 | 8392 | H:1 | 8439 | H:1 |
| 8226 | H:1 | 8273 | H:1 | 8393 | H:2 | 8440 | H:1 |
| 8227 | H:1 | 8274 | H:1 | 8394 | H:1 | 8441 | H:1 |
| 8228 | H:1 | 8275 | H:1 | 8395 | H:1 | 8442 | H:1 |
| 8229 | H:1 | 8276 | H:1 | 8396 | H:1 | 8443 | H:1 |
| 8230 | H:1 | 8277 | H:1 | 8397 | H:1 | 8444 | H:1 |
| 8231 | H:1 | 8278 | H:1 | 8398 | H:1 | 8445 | H:1 |
| 8279 | H:1 | 8326 | H:1 | 8399 | H:1 | 8446 | H:1 |
| 8280 | H:1 | 8327 | H:1 | 8400 | H:1 | 8447 | H:1 |
| 8281 | H:1 | 8328 | H:1 | 8401 | F:5 K:2 | 8448 | H:1 |
| 8282 | H:1 | 8329 | H:1 | 8402 | H:1 | 8449 | H:1 |
| 8283 | H:1 | 8330 | H:1 | 8403 | H:1 | 8450 | H:1 |
| 8284 | H:1 | 8331 | H:1 | 8404 | H:1 | 8451 | H:1 |
| 8285 | H:1 | 8332 | H:1 | 8405 | H:1 | 8452 | F:1 K:1 |
| 8286 | H:1 | 8333 | H:1 | 8406 | H:1 | 8453 | H:1 |
| 8287 | H:1 | 8334 | H:1 | 8407 | H:1 | 8454 | H:1 |
| 8288 | H:1 | 8335 | H:1 | 8408 | H:1 | 8455 | H:1 |
| 8289 | H:1 | 8336 | H:1 | 8409 | H:1 | 8456 | H:1 |
| 8290 | H:1 | 8337 | H:1 | 8410 | H:1 | 8457 | H:1 |
| 8291 | H:1 | 8338 | H:1 | 8411 | H:1 | 8458 | H:1 |
| 8292 | C:6 | 8339 | H:1 | 8412 | H:1 | 8459 | H:1 |
| 8293 | H:1 | 8340 | H:1 | 8413 | K:2 | 8460 | H:1 |
| 8294 | H:1 | 8341 | H:1 | 8414 | H:1 | 8461 | H:1 |
| 8295 | H:1 | 8342 | H:1 | 8415 | H:1 | 8462 | H:1 |
| 8296 | H:1 | 8343 | H:1 | 8416 | H:1 | 8463 | H:1 |
| 8297 | H:1 | 8344 | H:1 | 8417 | H:1 | 8464 | H:1 |
| 8298 | H:1 | 8345 | H:1 | 8418 | H:1 | 8465 | H:1 |
| 8299 | H:1 | 8346 | H:1 | 8419 | H:1 | 8466 | H:1 |
| 8300 | H:1 | 8347 | H:1 | 8467 | H:1 | 8514 | H:1 |
| 8301 | H:1 | 8348 | H:1 | 8468 | H:1 | 8515 | H:1 |
| 8302 | H:1 | 8349 | H:1 | 8469 | H:1 | 8516 | H:1 |
| 8303 | H:1 | 8350 | H:1 | 8470 | H:1 | 8517 | H:1 |
| 8304 | H:1 | 8351 | C:2 J:2 | 8471 | H:1 | 8518 | H:1 |
| 8305 | H:1 | 8352 | H:1 | 8472 | H:1 | 8519 | H:1 |
| 8306 | H:1 | 8353 | H:1 | 8473 | H:1 | 8520 | H:1 |
| 8307 | I:1 | 8354 | H:1 | 8474 | H:1 | 8521 | H:1 |
| 8308 | H:1 | 8355 | H:1 | 8475 | H:1 | 8522 | H:1 |
| 8309 | H:1 | 8356 | H:1 | 8476 | H:1 | 8523 | H:1 |
| 8310 | H:1 | 8357 | H:1 | 8477 | D:1 F:1 | 8524 | H:1 |
| 8311 | H:1 | 8358 | H:1 | 8478 | H:1 | 8525 | H:1 |
| 8312 | H:1 | 8359 | H:1 | 8479 | H:1 | 8526 | H:1 |
| 8313 | H:1 | 8360 | H:1 | 8480 | H:1 | 8527 | H:1 |
| 8314 | H:1 | 8361 | H:1 | 8481 | H:1 | 8528 | H:1 |
| 8315 | H:1 | 8362 | H:1 | 8482 | H:1 | 8529 | F:1 K:2 |
| 8316 | H:1 | 8363 | H:1 | 8483 | H:1 | 8530 | H:1 |
| 8317 | H:1 | 8364 | H:1 | 8484 | H:1 | 8531 | H:1 |

TABLE V-continued
(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 8485 | H:1 | 8532 | H:1 | 8605 | H:1 | 8652 | H:1 |
| 8486 | H:1 | 8533 | H:1 | 8606 | H:1 | 8653 | H:1 |
| 8487 | H:1 | 8534 | H:1 | 8607 | H:1 | 8654 | H:1 |
| 8488 | H:1 | 8535 | H:1 | 8655 | H:1 | 8702 | H:1 |
| 8489 | H:1 | 8536 | H:1 | 8656 | H:1 | 8703 | H:1 |
| 8490 | H:1 | 8537 | H:1 | 8657 | H:1 | 8704 | H:1 |
| 8491 | H:1 | 8538 | F:1 K:3 | 8658 | H:1 | 8705 | H:1 |
| 8492 | H:1 | 8539 | H:1 | 8659 | H:1 | 8706 | H:1 |
| 8493 | H:1 | 8540 | H:1 | 8660 | H:1 | 8707 | H:1 |
| 8494 | H:1 | 8541 | H:1 | 8661 | H:1 | 8708 | H:1 |
| 8495 | H:1 | 8542 | H:1 | 8662 | H:1 | 8709 | H:1 |
| 8496 | H:1 | 8543 | H:1 | 8663 | H:1 | 8710 | A:1 |
| 8497 | H:1 | 8544 | H:1 | 8664 | H:1 | 8711 | H:1 |
| 8498 | H:1 | 8545 | H:1 | 8665 | H:1 | 8712 | H:1 |
| 8499 | H:1 | 8546 | H:1 | 8666 | H:1 | 8713 | H:1 |
| 8500 | H:1 | 8547 | H:1 | 8667 | A:1 | 8714 | H:1 |
| 8501 | H:1 | 8548 | H:1 | 8668 | H:1 | 8715 | H:1 |
| 8502 | H:1 | 8549 | H:1 | 8669 | H:1 | 8716 | H:1 |
| 8503 | H:1 | 8550 | H:1 | 8670 | H:1 | 8717 | H:1 |
| 8504 | H:1 | 8551 | H:1 | 8671 | H:1 | 8718 | H:1 |
| 8505 | H:1 | 8552 | H:1 | 8672 | H:1 | 8719 | H:1 |
| 8506 | H:1 | 8553 | H:1 | 8673 | H:1 | 8720 | H:1 |
| 8507 | H:1 | 8554 | H:1 | 8674 | H:1 | 8721 | A:1 |
| 8508 | A:7 | 8555 | H:1 | 8675 | H:1 | 8722 | H:1 |
| 8509 | H:1 | 8556 | H:1 | 8676 | H:1 | 8723 | H:1 |
| 8510 | H:1 | 8557 | H:1 | 8677 | H:1 | 8724 | H:1 |
| 8511 | H:1 | 8558 | H:1 | 8678 | A:1 | 8725 | H:1 |
| 8512 | H:1 | 8559 | H:1 | 8679 | H:1 | 8726 | H:1 |
| 8513 | H:1 | 8560 | H:4 | 8680 | H:1 | 8727 | H:1 |
| 8561 | H:1 | 8608 | H:1 | 8681 | H:1 | 8728 | H:1 |
| 8562 | H:1 | 8609 | H:1 | 8682 | H:1 | 8729 | H:1 |
| 8563 | H:1 | 8610 | H:1 | 8683 | H:1 | 8730 | H:1 |
| 8564 | H:1 | 8611 | H:1 | 8684 | H:1 | 8731 | H:1 |
| 8565 | H:1 | 8612 | H:1 | 8685 | H:1 | 8732 | A:1 |
| 8566 | H:1 | 8613 | H:1 | 8686 | H:1 | 8733 | H:1 |
| 8567 | H:1 | 8614 | H:1 | 8687 | H:1 | 8734 | H:1 |
| 8568 | H:1 | 8615 | H:1 | 8688 | H:1 | 8735 | H:1 |
| 8569 | H:1 | 8616 | H:1 | 8689 | B:2 | 8736 | H:1 |
| 8570 | H:1 | 8617 | H:1 | 8690 | A:1 | 8737 | H:1 |
| 8571 | H:1 | 8618 | H:1 | 8691 | H:1 | 8738 | H:1 |
| 8572 | H:1 | 8619 | H:1 | 8692 | H:1 | 8739 | H:1 |
| 8573 | H:1 | 8620 | H:1 | 8693 | H:1 | 8740 | H:1 |
| 8574 | H:1 | 8621 | H:1 | 8694 | H:1 | 8741 | H:1 |
| 8575 | H:1 | 8622 | H:1 | 8695 | H:1 | 8742 | B:1 |
| 8576 | H:1 | 8623 | H:1 | 8696 | H:1 | 8743 | H:1 |
| 8577 | H:1 | 8624 | H:1 | 8697 | H:1 | 8744 | H:1 |
| 8578 | H:1 | 8625 | H:1 | 8698 | H:1 | 8745 | H:1 |
| 8579 | H:1 | 8626 | H:1 | 8699 | A:1 | 8746 | H:1 |
| 8580 | H:1 | 8627 | A:2 | 8700 | H:1 | 8747 | H:1 |
| 8581 | H:1 | 8628 | H:1 | 8701 | H:1 | 8748 | H:1 |
| 8582 | H:1 | 8629 | H:1 | 8749 | H:1 | 8796 | H:1 |
| 8583 | H:1 | 8630 | H:1 | 8750 | H:1 | 8797 | H:1 |
| 8584 | H:1 | 8631 | H:1 | 8751 | A:1 | 8798 | H:1 |
| 8585 | H:1 | 8632 | H:1 | 8752 | H:1 | 8799 | H:1 |
| 8586 | I:2 | 8633 | H:1 | 8753 | H:1 | 8800 | H:1 |
| 8587 | H:1 | 8634 | H:1 | 8754 | H:1 | 8801 | H:1 |
| 8588 | H:1 | 8635 | H:1 | 8755 | H:1 | 8802 | H:1 |
| 8589 | H:1 | 8636 | H:1 | 8756 | H:1 | 8803 | H:1 |
| 8590 | H:1 | 8637 | H:1 | 8757 | H:1 | 8804 | H:1 |
| 8591 | H:1 | 8638 | H:1 | 8758 | A:1 | 8805 | K:1 |
| 8592 | H:1 | 8639 | H:1 | 8759 | H:1 | 8806 | H:1 |
| 8593 | H:1 | 8640 | H:1 | 8760 | H:1 | 8807 | H:1 |
| 8594 | H:1 | 8641 | H:1 | 8761 | H:1 | 8808 | H:1 |
| 8595 | H:1 | 8642 | H:1 | 8762 | H:1 | 8809 | H:1 |
| 8596 | H:1 | 8643 | H:1 | 8763 | H:1 | 8810 | H:1 |
| 8597 | H:1 | 8644 | H:1 | 8764 | H:1 | 8811 | H:1 |
| 8598 | H:1 | 8645 | H:1 | 8765 | H:1 | 8812 | H:1 |
| 8599 | H:1 | 8646 | H:1 | 8766 | H:1 | 8813 | K:1 |
| 8600 | H:1 | 8647 | H:1 | 8767 | H:1 | 8814 | H:1 |
| 8601 | H:1 | 8648 | H:1 | 8768 | B:1 | 8815 | H:1 |
| 8602 | H:1 | 8649 | H:1 | 8769 | H:1 | 8816 | H:1 |
| 8603 | H:1 | 8650 | H:1 | 8770 | H:1 | 8817 | H:1 |
| 8604 | H:1 | 8651 | H:1 | 8771 | H:1 | 8818 | H:1 |

TABLE V-continued

(Spatial distribution)

| Seq Id No. | Tissue distribution | Seq Id No. | Tissue distribution |
|---|---|---|---|
| 8772 | H:1 | 8819 | H:1 |
| 8773 | H:1 | 8820 | H:1 |
| 8774 | H:1 | 8821 | H:2 |
| 8775 | H:1 | 8822 | H:1 |
| 8776 | H:1 | 8823 | H:1 |
| 8777 | A:1 | 8824 | H:1 |
| 8778 | H:1 | 8825 | H:1 |
| 8779 | H:1 | 8826 | H:1 |
| 8780 | H:1 | 8827 | H:1 |
| 8781 | H:1 | 8828 | H:1 |
| 8782 | H:1 | 8829 | H:1 |
| 8783 | H:1 | 8830 | C:20 |
| 8784 | H:1 | 8831 | H:1 |
| 8785 | H:1 | 8832 | H:1 |
| 8786 | B:1 | 8833 | H:1 |
| 8787 | H:1 | 8834 | H:1 |
| 8788 | H:1 | 8835 | H:1 |
| 8789 | H:1 | 8836 | H:1 |
| 8790 | H:1 | 8837 | H:1 |
| 8791 | H:1 | 8838 | H:1 |
| 8792 | H:1 | 8839 | H:1 |
| 8793 | H:1 | 8840 | H:1 |
| 8794 | H:1 | 8841 | C:2 |
| 8795 | H:1 | 8842 | H:1 |
| 8843 | H:1 | 8890 | H:1 |
| 8844 | H:1 | 8891 | H:1 |
| 8845 | H:1 | 8892 | H:1 |
| 8846 | H:1 | 8893 | H:1 |
| 8847 | H:1 | 8894 | H:1 |
| 8848 | H:1 | 8895 | H:1 |
| 8849 | H:1 | 8896 | H:1 |
| 8850 | H:1 | 8897 | H:1 |
| 8851 | H:1 | 8898 | H:1 |
| 8852 | H:1 | 8899 | H:1 |
| 8853 | H:1 | 8900 | H:1 |
| 8854 | H:1 | 8901 | H:1 |
| 8855 | H:1 | 8902 | H:1 |
| 8856 | H:1 | 8903 | H:1 |
| 8857 | H:1 | 8904 | H:1 |
| 8858 | H:1 | 8905 | B:4 |
| 8859 | H:1 | 8906 | H:1 |
| 8860 | H:1 | 8907 | H:1 |
| 8861 | H:1 | 8908 | H:1 |
| 8862 | C:7 | 8909 | H:1 |
| 8863 | H:1 | 8910 | H:1 |
| 8864 | H:1 | 8911 | H:1 |
| 8865 | H:1 | 8912 | H:1 |
| 8866 | H:1 | 8913 | H:1 |
| 8867 | H:1 | 8914 | H:1 |
| 8868 | H:1 | 8915 | H:1 |
| 8869 | H:1 | 8916 | H:1 |
| 8870 | H:1 | 8917 | H:1 |
| 8871 | H:1 | 8918 | H:1 |
| 8872 | H:1 | 8919 | H:1 |
| 8873 | D:1 | 8920 | H:1 |
| 8874 | H:1 | 8921 | H:1 |
| 8875 | H:1 | 8922 | H:1 |
| 8876 | H:1 | 8923 | H:1 |
| 8877 | H:1 | 8924 | H:1 |
| 8878 | H:1 | 8925 | H:1 |
| 8879 | H:1 | 8926 | H:1 |
| 8880 | H:1 | 8927 | H:1 |
| 8881 | H:1 | 8928 | H:1 |
| 8882 | H:1 | 8929 | H:1 |
| 8883 | H:1 | 8930 | H:1 |
| 8884 | C:58 | 8931 | H:1 |
| 8885 | F:1 K:1 | 8932 | H:1 |
| 8886 | H:1 | 8933 | H:1 |
| 8887 | H:1 | 8934 | H:1 |
| 8888 | H:1 | 8935 | H:1 |
| 8889 | H:1 | 8936 | H:1 |
| 8937 | H:1 | 8984 | H:1 |
| 8938 | H:1 | 8985 | H:1 |
| 8939 | H:1 | 8986 | K:1 |
| 8940 | H:1 | 8987 | H:1 |
| 8941 | H:1 | 8988 | H:1 |
| 8942 | H:1 | 8989 | H:1 |
| 8943 | H:1 | 8990 | H:1 |
| 8944 | H:1 | 8991 | H:1 |
| 8945 | H:1 | 8992 | F:2 K:1 |
| 8946 | H:1 | 8993 | H:1 |
| 8947 | H:1 | 8994 | H:1 |
| 8948 | H:1 | 8995 | H:1 |
| 8949 | H:1 | 8996 | H:1 |
| 8950 | H:1 | 8997 | H:1 |
| 8951 | H:1 | 8998 | H:1 |
| 8952 | H:1 | 8999 | H:1 |
| 8953 | H:1 | 9000 | H:1 |
| 8954 | H:1 | 9001 | H:1 |
| 8955 | F:2 K:1 | 9002 | H:1 |
| 8956 | H:1 | 9003 | H:1 |
| 8957 | H:1 | 9004 | H:1 |
| 8958 | H:1 | 9005 | H:1 |
| 8959 | H:1 | 9006 | H:1 |
| 8960 | H:1 | 9007 | H:1 |
| 8961 | H:1 | 9008 | H:1 |
| 8962 | H:1 | 9009 | H:1 |
| 8963 | H:1 | 9010 | H:1 |
| 8964 | H:1 | 9011 | H:1 |
| 8965 | H:1 | 9012 | H:1 |
| 8966 | H:1 | 9013 | H:1 |
| 8967 | H:1 | 9014 | H:1 |
| 8968 | H:1 | 9015 | H:1 |
| 8969 | H:1 | 9016 | I:2 |
| 8970 | H:1 | 9017 | H:1 |
| 8971 | H:1 | 9018 | H:1 |
| 8972 | H:1 | 9019 | H:1 |
| 8973 | H:1 | 9020 | H:1 |
| 8974 | H:1 | 9021 | H:1 |
| 8975 | H:1 | 9022 | H:1 |
| 8976 | K:2 | 9023 | H:1 |
| 8977 | H:1 | 9024 | B:2 |
| 8978 | H:1 | 9025 | H:1 |
| 8979 | H:1 | 9026 | H:1 |
| 8980 | H:1 | 9027 | H:1 |
| 8981 | H:1 | 9028 | H:1 |
| 8982 | H:1 | 9029 | H:1 |
| 8983 | H:1 | 9030 | H:1 |
| 9031 | H:1 | 9078 | H:1 |
| 9032 | H:1 | 9079 | H:1 |
| 9033 | H:1 | 9080 | H:1 |
| 9034 | H:1 | 9081 | H:1 |
| 9035 | H:1 | 9082 | H:1 |
| 9036 | H:1 | 9083 | H:1 |
| 9037 | H:1 | 9084 | H:1 |
| 9038 | H:1 | 9085 | H:1 |
| 9039 | H:1 | 9086 | H:1 |
| 9040 | H:1 | 9087 | H:1 |
| 9041 | H:1 | 9088 | H:1 |
| 9042 | H:1 | 9089 | H:1 |
| 9043 | H:1 | 9090 | H:1 |
| 9044 | H:1 | 9091 | H:1 |
| 9045 | H:1 | 9092 | H:1 |
| 9046 | H:1 | 9093 | F:19 K:3 |
| 9047 | H:1 | 9094 | H:1 |
| 9048 | H:1 | 9095 | H:1 |
| 9049 | H:1 | 9096 | H:1 |
| 9050 | H:1 | 9097 | F:5 K:2 |
| 9051 | H:1 | 9098 | H:1 |
| 9052 | H:1 | 9099 | H:1 |
| 9053 | H:1 | 9100 | H:1 |
| 9054 | H:1 | 9101 | H:1 |
| 9055 | H:1 | 9102 | H:1 |
| 9056 | H:1 | 9103 | H:1 |
| 9057 | H:1 | 9104 | H:1 |
| 9058 | H:1 | 9105 | H:1 |

TABLE V-continued

(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 9059 | H:1 | 9106 | H:1 | 9226 | H:1 | 9273 | H:1 |
| 9060 | H:1 | 9107 | H:1 | 9227 | H:1 | 9274 | H:1 |
| 9061 | H:1 | 9108 | H:1 | 9228 | H:1 | 9275 | H:1 |
| 9062 | H:1 | 9109 | H:1 | 9229 | H:1 | 9276 | H:1 |
| 9063 | H:1 | 9110 | H:1 | 9230 | H:1 | 9277 | H:1 |
| 9064 | F:1 K:2 | 9111 | H:1 | 9231 | H:1 | 9278 | H:1 |
| 9065 | H:1 | 9112 | H:1 | 9232 | H:1 | 9279 | F:5 K:3 |
| 9066 | H:1 | 9113 | H:1 | 9233 | H:1 | 9280 | H:1 |
| 9067 | H:1 | 9114 | H:1 | 9234 | H:1 | 9281 | H:1 |
| 9068 | H:1 | 9115 | H:1 | 9235 | H:1 | 9282 | H:1 |
| 9069 | H:1 | 9116 | H:1 | 9236 | H:1 | 9283 | H:1 |
| 9070 | H:1 | 9117 | H:1 | 9237 | H:1 | 9284 | H:1 |
| 9071 | H:1 | 9118 | H:1 | 9238 | H:1 | 9285 | H:1 |
| 9072 | H:1 | 9119 | H:1 | 9239 | H:1 | 9286 | H:1 |
| 9073 | H:1 | 9120 | H:1 | 9240 | K:1 | 9287 | H:1 |
| 9074 | H:1 | 9121 | B:3 | 9241 | H:1 | 9288 | H:1 |
| 9075 | H:1 | 9122 | H:1 | 9242 | H:1 | 9289 | H:1 |
| 9076 | H:1 | 9223 | H:1 | 9243 | H:1 | 9290 | H:1 |
| 9077 | H:1 | 9124 | H:1 | 9244 | H:1 | 9291 | H:1 |
| 9125 | H:1 | 9172 | H:1 | 9245 | H:1 | 9292 | H:1 |
| 9126 | H:1 | 9173 | H:1 | 9246 | H:1 | 9293 | H:1 |
| 9127 | H:1 | 9174 | H:1 | 9247 | H:1 | 9294 | H:1 |
| 9128 | H:1 | 9175 | H:1 | 9248 | H:1 | 9295 | H:1 |
| 9129 | H:1 | 9176 | H:1 | 9249 | H:1 | 9296 | H:1 |
| 9130 | H:1 | 9177 | A:182 K:2 | 9250 | H:1 | 9297 | H:1 |
| 9131 | H:1 | 9178 | H:1 | 9251 | H:1 | 9298 | C:1 |
| 9132 | H:1 | 9179 | H:1 | 9252 | H:1 | 9299 | K:2 |
| 9133 | H:1 | 9180 | H:1 | 9253 | H:1 | 9300 | H:1 |
| 9134 | H:1 | 9181 | H:1 | 9254 | H:1 | 9301 | H:1 |
| 9135 | H:1 | 9182 | H:1 | 9255 | H:1 | 9302 | H:1 |
| 9136 | H:1 | 9183 | H:1 | 9256 | F:14 K:7 | 9303 | H:1 |
| 9137 | H:1 | 9184 | H:1 | 9257 | H:1 | 9304 | H:1 |
| 9138 | H:1 | 9185 | A:186 K:2 | 9258 | H:1 | 9305 | H:1 |
| 9139 | H:1 | 9186 | H:1 | 9259 | H:1 | 9306 | H:1 |
| 9140 | H:1 | 9187 | H:1 | 9260 | H:1 | 9307 | C:6 |
| 9141 | H:1 | 9188 | H:1 | 9261 | H:1 | 9308 | H:1 |
| 9142 | H:1 | 9189 | H:1 | 9262 | H:1 | 9309 | H:1 |
| 9143 | H:1 | 9190 | H:1 | 9263 | H:1 | 9310 | H;1 |
| 9144 | H:1 | 9191 | H:1 | 9264 | H:1 | 9311 | H:1 |
| 9145 | H:1 | 9192 | C:5 | 9265 | H:1 | 9312 | H:1 |
| 9146 | H:1 | 9193 | H:1 | 9313 | H:1 | 9360 | H:1 |
| 9147 | H:1 | 9194 | H:1 | 9314 | H:1 | 9361 | H:1 |
| 9148 | H:1 | 9195 | H:1 | 9315 | H:1 | 9362 | A:4 |
| 9149 | H:1 | 9196 | H:1 | 9316 | H:1 | 9363 | H:1 |
| 9150 | H:1 | 9197 | H:1 | 9317 | H:1 | 9364 | H:1 |
| 9151 | H:1 | 9198 | H:1 | 9318 | H:1 | 9365 | H:1 |
| 9152 | H:1 | 9199 | H:1 | 9319 | H:1 | 9366 | H:1 |
| 9153 | H:1 | 9200 | H:1 | 9320 | H:1 | 9367 | H:1 |
| 9154 | H:1 | 9201 | H:1 | 9321 | H:1 | 9368 | H:1 |
| 9155 | H:1 | 9202 | H:1 | 9322 | H:1 | 9369 | H:1 |
| 9156 | H:1 | 9203 | H:1 | 9323 | H:1 | 9370 | H:1 |
| 9157 | H:1 | 9204 | H:1 | 9324 | H:1 | 9371 | H:1 |
| 9158 | H:1 | 9205 | H:1 | 9325 | H:1 | 9372 | C:1 |
| 9159 | H:1 | 9206 | H:1 | 9326 | H:1 | 9373 | H:1 |
| 9160 | H:1 | 9207 | H:1 | 9327 | H:1 | 9374 | H:1 |
| 9161 | H:1 | 9208 | A:2 | 9328 | H:1 | 9375 | H:1 |
| 9162 | H:1 | 9209 | H:1 | 9329 | H:1 | 9376 | H:1 |
| 9163 | H:1 | 9210 | H:1 | 9330 | H:1 | 9377 | H:1 |
| 9164 | H:1 | 9211 | H:1 | 9331 | H:1 | 9378 | H:1 |
| 9165 | H:1 | 9212 | H:1 | 9332 | H:1 | 9379 | H:1 |
| 9166 | H:1 | 9213 | H:1 | 9333 | H:1 | 9380 | C:1 |
| 9167 | H:1 | 9214 | H:1 | 9334 | H:1 | 9381 | H:1 |
| 9168 | H:1 | 9215 | H:1 | 9335 | H:1 | 9382 | H:1 |
| 9169 | H:1 | 9216 | H:1 | 9336 | H:1 | 9383 | H:1 |
| 9170 | H:1 | 9217 | C:32 | 9337 | H:1 | 9384 | H:1 |
| 9171 | H:1 | 9218 | A:3 | 9338 | H:1 | 9385 | H:1 |
| 9219 | H:1 | 9266 | H:1 | 9339 | A:2 | 9386 | H:1 |
| 9220 | H:1 | 9267 | H:1 | 9340 | H:1 | 9387 | H:1 |
| 9221 | H:1 | 9268 | H:1 | 9341 | H:1 | 9388 | H:1 |
| 9222 | H:1 | 9269 | H:1 | 9342 | H:1 | 9389 | H:1 |
| 9223 | H:1 | 9270 | H:1 | 9343 | H:1 | 9390 | H:1 |
| 9224 | H:1 | 9271 | H:1 | 9344 | H:1 | 9391 | H:1 |
| 9225 | H:1 | 9272 | H:1 | 9345 | H:1 | 9392 | H:1 |

TABLE V-continued
(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 9346 | H:1 | 9393 | H:1 | 9513 | F:1 | 9560 | F:1 |
| 9347 | H:1 | 9394 | H:1 | 9514 | F:1 | 9561 | F:1 |
| 9348 | H:1 | 9395 | H:1 | 9515 | F:1 | 9562 | F:1 |
| 9349 | H:1 | 9396 | F:14 K:89 | 9516 | F:1 | 9563 | F:1 |
| 9350 | H:1 | 9397 | H:1 | 9517 | F:1 | 9564 | F:1 |
| 9351 | H:1 | 9398 | H:1 | 9518 | K:1 | 9565 | F:1 |
| 9352 | H:1 | 9399 | H:1 | 9519 | F:1 | 9566 | F:1 |
| 9353 | H:1 | 9400 | H:1 | 9520 | F:1 | 9567 | F:1 |
| 9354 | H:1 | 9401 | H:1 | 9521 | F:1 | 9568 | F:1 |
| 9355 | H:1 | 9402 | H:1 | 9522 | F:1 | 9569 | F:1 |
| 9356 | H:1 | 9403 | F:1 K:3 | 9523 | F:1 | 9570 | F:1 |
| 9357 | F:1 K:1 | 9404 | H:1 | 9524 | F:1 | 9571 | F:1 |
| 9358 | H:1 | 9405 | H:1 | 9525 | K:1 | 9572 | F:1 |
| 9359 | H:1 | 9406 | H:1 | 9526 | F:1 | 9573 | F:1 |
| 9407 | H:1 | 9454 | H:1 | 9527 | F:1 | 9574 | F:1 |
| 9408 | H:1 | 9455 | H:1 | 9528 | F:1 | 9575 | F:1 |
| 9409 | H:1 | 9456 | H:1 | 9529 | F:1 | 9576 | F:1 |
| 9410 | H:1 | 9457 | H:1 | 9530 | F:1 | 9577 | F:1 |
| 9411 | F:55 K:295 | 9458 | H:1 | 9531 | F:1 | 9578 | F:1 |
| 9412 | H:1 | 9459 | H:1 | 9532 | K:1 | 9579 | F:1 |
| 9413 | H:1 | 9460 | H:1 | 9533 | F:1 | 9580 | F:1 |
| 9414 | H:1 | 9461 | H:1 | 9534 | F:1 | 9581 | F:1 |
| 9415 | H:1 | 9462 | A:1 D:1 | 9535 | F:1 | 9582 | F:1 |
| 9416 | H:1 | 9463 | K:1 | 9536 | F:1 | 9583 | F:1 |
| 9417 | H:1 | 9464 | H:1 | 9537 | F:1 | 9584 | F:1 |
| 9418 | H:1 | 9465 | H:1 | 9538 | F:1 | 9585 | F:1 |
| 9419 | H:1 | 9466 | H:1 | 9539 | K:1 | 9586 | F:1 |
| 9420 | F:11 K:4 | 9467 | H:1 | 9540 | F:1 | 9587 | F:1 |
| 9421 | H:1 | 9468 | H:1 | 9541 | F:1 | 9588 | F:1 |
| 9422 | H:1 | 9469 | H:1 | 9542 | F:1 | 9589 | F:1 |
| 9423 | H:1 | 9470 | H:1 | 9543 | F:1 | 9590 | F:1 |
| 9424 | H:1 | 9471 | H:1 | 9544 | F:1 | 9591 | F:1 |
| 9425 | H:1 | 9472 | H:1 | 9545 | F:1 | 9592 | F:1 |
| 9426 | H:1 | 9473 | H:1 | 9546 | A:2 F:1 K:3 | 9593 | F:1 |
| 9427 | H:1 | 9474 | F:1 | 9547 | F:1 | 9594 | F:1 |
| 9428 | K:1 | 9475 | H:1 | 9595 | F:1 | 9642 | F:1 |
| 9429 | H:1 | 9476 | H:1 | 9596 | F:1 | 9643 | C:4 |
| 9430 | H:1 | 9477 | H:1 | 9597 | K:2 | 9644 | F:1 |
| 9431 | H:1 | 9478 | H:1 | 9598 | K:1 | 9645 | F:1 |
| 9432 | H:1 | 9479 | H:1 | 9599 | F:1 | 9646 | F:1 |
| 9433 | H:1 | 9480 | H:1 | 9600 | F:1 | 9647 | F:1 |
| 9434 | H:1 | 9481 | H:1 | 9601 | F:1 | 9648 | F:1 |
| 9435 | K:1 | 9482 | H:1 | 9602 | F:1 | 9649 | F:1 |
| 9436 | H:1 | 9483 | H:1 | 9603 | F:1 | 9650 | F:1 |
| 9437 | H:1 | 9484 | K:1 | 9604 | F:1 | 9651 | F:1 |
| 9438 | H:1 | 9485 | H:1 | 9605 | F:1 | 9652 | B:1 D:1 |
| 9439 | H:1 | 9486 | H:1 | 9606 | F:1 | 9653 | F:1 |
| 9440 | H:1 | 9487 | H:1 | 9607 | F:1 | 9654 | F:1 |
| 9441 | H:1 | 9488 | H:1 | 9608 | F:1 | 9655 | F:1 |
| 9442 | H:1 | 9489 | H:1 | 9609 | F:1 | 9656 | F:1 |
| 9443 | H:1 | 9490 | H:1 | 9610 | F:1 | 9657 | F:1 |
| 9444 | K:1 | 9491 | H:1 | 9611 | F:1 | 9658 | F:1 |
| 9445 | H:1 | 9492 | H:1 | 9612 | F:1 | 9659 | F:1 |
| 9446 | H:1 | 9493 | H:1 | 9613 | F:1 | 9660 | F:1 |
| 9447 | H:1 | 9494 | H:1 | 9614 | K:2 | 9661 | F:1 |
| 9448 | H:1 | 9495 | H:1 | 9615 | F:1 | 9662 | F:1 |
| 9449 | H:1 | 9496 | H:1 | 9616 | F:1 | 9663 | F:1 |
| 9450 | H:1 | 9497 | H:1 | 9617 | F:1 | 9664 | F:1 |
| 9451 | H:1 | 9498 | H:1 | 9618 | F:1 | 9665 | F:1 |
| 9452 | H:1 | 9499 | H:1 | 9619 | F:1 | 9666 | F:1 |
| 9453 | F:1 | 9500 | H:1 | 9620 | F:1 | 9667 | F:1 |
| 9501 | H:1 | 9548 | F:1 | 9621 | F:1 | 9668 | F:1 |
| 9502 | H:1 | 9549 | F:1 | 9622 | F:4 K:3 | 9669 | H:2 |
| 9503 | H:1 | 9550 | F:1 | 9623 | F:1 | 9670 | F:1 |
| 9504 | H:1 | 9551 | F:1 | 9624 | F:1 | 9671 | F:1 |
| 9505 | H:1 | 9552 | F:1 | 9625 | F:1 | 9672 | F:1 |
| 9506 | H:1 | 9553 | H:2 | 9626 | F:1 | 9673 | F:1 |
| 9507 | H:1 | 9554 | F:1 | 9627 | F:1 | 9674 | F:1 |
| 9508 | H:1 | 9555 | F:1 | 9628 | F:1 | 9675 | F:1 |
| 9509 | H:1 | 9556 | F:1 | 9629 | F:1 | 9676 | H:1 |
| 9510 | F:1 | 9557 | F:1 | 9630 | F:1 | 9677 | A:2 |
| 9511 | F:1 | 9558 | F:1 | 9631 | F:1 | 9678 | H:1 |
| 9512 | F:1 | 9559 | F:1 | 9632 | F:1 | 9679 | H:1 |

TABLE V-continued

(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 9633 | F:4 | 9680 | H:1 | 9800 | C:41 | 9847 | K:1 |
| 9634 | F:1 | 9681 | H:1 | 9801 | K:1 | 9848 | K:1 |
| 9635 | F:1 | 9682 | H:1 | 9802 | K:1 | 9849 | K:1 |
| 9636 | F:1 | 9683 | H:1 | 9803 | K:1 | 9850 | K:1 |
| 9637 | F:1 | 9684 | H:1 | 9804 | K:1 | 9851 | K:1 |
| 9638 | F:1 | 9685 | H:1 | 9805 | K:1 | 9852 | K:1 |
| 9639 | F:1 | 9686 | H:1 | 9806 | K:1 | 9853 | H:1 |
| 9640 | F:1 | 9687 | H:1 | 9807 | K:1 | 9854 | K:1 |
| 9641 | F:1 | 9688 | H:1 | 9808 | K:1 | 9855 | K:1 |
| 9689 | H:1 | 9736 | K:1 | 9809 | K:1 | 9856 | K:1 |
| 9690 | H:1 | 9737 | K:1 | 9810 | K:1 | 9857 | K:1 |
| 9691 | H:1 | 9738 | K:1 | 9811 | K:1 | 9858 | K:1 |
| 9692 | H:1 | 9739 | K:1 | 9812 | K:1 | 9859 | K:1 |
| 9693 | H:1 | 9740 | K:1 | 9813 | K:1 | 9860 | K:1 |
| 9694 | H:1 | 9741 | K:1 | 9814 | K:1 | 9861 | B:3 C:2 D:2 F:1 K:2 |
| 9695 | H:1 | 9742 | K:1 | 9815 | K:1 | 9862 | K:1 |
| 9696 | H:1 | 9743 | K:1 | 9816 | K:1 | 9863 | K:1 |
| 9697 | H:1 | 9744 | K:1 | 9817 | K:1 | 9864 | K:1 |
| 9698 | H:1 | 9745 | K:1 | 9818 | K:1 | 9865 | K:1 |
| 9699 | H:1 | 9746 | K:1 | 9819 | K:1 | 9866 | K:1 |
| 9700 | H:1 | 9747 | K:1 | 9820 | K:1 | 9867 | K:1 |
| 9701 | H:1 | 9748 | F:1 K:1 | 9821 | K:1 | 9868 | K:1 |
| 9702 | H:1 | 9749 | K:1 | 9822 | K:1 | 9869 | K:1 |
| 9703 | H:1 | 9750 | K:1 | 9823 | K:1 | 9870 | K:1 |
| 9704 | H:1 | 9751 | K:1 | 9824 | K:1 | 9871 | A:1 |
| 9705 | H:1 | 9752 | K:1 | 9825 | K:1 | 9872 | K:1 |
| 9706 | H:1 | 9753 | K:1 | 9826 | K:1 | 9873 | K:1 |
| 9707 | H:1 | 9754 | K:1 | 9827 | K:1 | 9874 | K:1 |
| 9708 | H:1 | 9755 | K:1 | 9828 | K:1 | 9875 | K:1 |
| 9709 | H:1 | 9756 | K:1 | 9829 | K:1 | 9876 | K:1 |
| 9710 | H:1 | 9757 | K:1 | 9877 | K:1 | 9924 | A:1 |
| 9711 | H:1 | 9758 | K:1 | 9878 | K:1 | 9925 | A:1 |
| 9712 | H:1 | 9759 | K:2 | 9879 | K:5 | 9926 | A:1 |
| 9713 | H:1 | 9760 | K:1 | 9880 | F:6 K:33 | 9927 | A:1 |
| 9714 | H:1 | 9761 | K:1 | 9881 | K:1 | 9928 | A:1 |
| 9715 | H:1 | 9762 | K:1 | 9882 | K:1 | 9929 | A:1 |
| 9716 | H:1 | 9763 | K:1 | 9883 | K:1 | 9930 | A:1 |
| 9717 | H:1 | 9764 | K:1 | 9884 | K:1 | 9931 | A:1 |
| 9718 | H:1 | 9765 | K:1 | 9885 | B:2 H:6 | 9932 | A:1 |
| 9719 | H:1 | 9766 | K:1 | 9886 | K:1 | 9933 | A:1 |
| 9720 | H:1 | 9767 | K:1 | 9887 | K:1 | 9934 | A:1 |
| 9721 | B:4 C:3 | 9768 | K:1 | 9888 | K:1 | 9935 | A:1 |
| 9722 | H:1 | 9769 | B:2 | 9889 | K:1 | 9936 | A:1 |
| 9723 | H:1 | 9770 | K:1 | 9890 | K:1 | 9937 | A:1 |
| 9724 | H:1 | 9771 | K:1 | 9891 | K:1 | 9938 | A:1 |
| 9725 | H:1 | 9772 | K:1 | 9892 | K:1 | 9939 | A:1 |
| 9726 | H:1 | 9773 | K:1 | 9893 | I:2 | 9940 | A:1 |
| 9727 | H:1 | 9774 | K:1 | 9894 | K:1 | 9941 | A:1 |
| 9728 | K:1 | 9775 | K:1 | 9895 | K:1 | 9942 | A:1 |
| 9729 | K:1 | 9776 | K:1 | 9896 | K:1 | 9943 | A:1 |
| 9730 | K:1 | 9777 | K:1 | 9897 | K:1 | 9944 | A:1 |
| 9731 | A:28 | 9778 | K:1 | 9898 | K:1 | 9945 | A:1 |
| 9732 | K:1 | 9779 | K:1 | 9899 | K:1 | 9946 | A:1 |
| 9733 | K:1 | 9780 | B:1 C:8 F:1 H:1 | 9900 | K:1 | 9947 | A:1 |
| 9734 | K:1 | 9781 | K:1 | 9901 | K:1 | 9948 | A:1 |
| 9735 | K:1 | 9782 | K:1 | 9902 | K:1 | 9949 | A:1 |
| 9783 | K:1 | 9830 | K:1 | 9903 | K:1 | 9950 | A:1 |
| 9784 | K:1 | 9831 | K:1 | 9904 | K:1 | 9951 | A:1 |
| 9785 | K:1 | 9832 | K:1 | 9905 | K:1 | 9952 | A:1 |
| 9786 | K:1 | 9833 | K:1 | 9906 | K:1 | 9953 | A:1 |
| 9787 | K:1 | 9834 | K:1 | 9907 | K:1 | 9954 | A:1 |
| 9788 | K:1 | 9835 | K:1 | 9908 | K:1 | 9955 | A:1 |
| 9789 | K:1 | 9836 | H:1 I:4 | 9909 | K:1 | 9956 | A:1 |
| 9790 | K:1 | 9837 | K:1 | 9910 | K:1 | 9957 | A:1 |
| 9791 | K:1 | 9838 | K:1 | 9911 | K:1 | 9958 | A:1 |
| 9792 | K:1 | 9839 | K:1 | 9912 | A:1 | 9959 | A:1 |
| 9793 | K:1 | 9840 | K:1 | 9913 | A:1 | 9960 | A:1 |
| 9794 | K:1 | 984 | K:1 | 9914 | A:1 | 9961 | A:1 |
| 9795 | K:1 | 9842 | K:1 | 9915 | A:1 | 9962 | A:1 |
| 9796 | K:1 | 9843 | K:1 | 9916 | A:1 | 9963 | A:1 |
| 9797 | K:1 | 9844 | K:1 | 9917 | A:1 | 9964 | F:1 K:1 |
| 9798 | K:1 | 9845 | K:1 | 9918 | A:1 B:1 C:20 | 9965 | A:1 |
| 9799 | K:1 | 9846 | K:1 | 9919 | A:1 | 9966 | A:1 |

TABLE V-continued

(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 9920 | A:1 | 9967 | A:1 | 10087 | F:1 | 10134 | F:1 |
| 9921 | A:1 | 9968 | A:1 | 10088 | K:2 | 10135 | F:1 |
| 9922 | A:1 | 9969 | A:1 | 10089 | F:1 | 10136 | F:1 |
| 9923 | A:1 | 9970 | A:1 | 10090 | F:1 | 10137 | F:1 |
| 9971 | F:1 | 10018 | F:1 | 10091 | F:1 | 10138 | F:1 |
| 9972 | F:1 | 10019 | F:1 | 10092 | F:1 | 10139 | F:1 |
| 9973 | F:1 | 10020 | F:1 | 10093 | F:1 | 10140 | F:1 |
| 9974 | F:1 | 10021 | F:1 | 10094 | F:1 | 10141 | F:1 |
| 9975 | F:1 | 10022 | F:1 | 10095 | F:1 | 10142 | F:1 |
| 9976 | F:1 | 10023 | F:1 | 10096 | F:1 | 10143 | F:1 |
| 9977 | F:1 | 10024 | F:1 | 10097 | F:1 | 10144 | F:1 |
| 9978 | F:1 | 10025 | F:1 | 10098 | F:1 | 10145 | F:1 |
| 9979 | F:1 | 10026 | F:1 | 10099 | F:1 | 10146 | F:1 |
| 9980 | F:1 | 10027 | F:1 | 10100 | F:1 | 10147 | F:1 |
| 9981 | F:1 | 10028 | F:1 | 10101 | F:1 | 10148 | F:1 |
| 9982 | F:1 | 10029 | F:1 | 10102 | F:1 | 10149 | F:1 |
| 9983 | F:1 | 10030 | F:1 | 10103 | F:1 | 10150 | F:1 |
| 9984 | F:1 | 10031 | F:1 | 10104 | F:1 | 10151 | F:1 |
| 9985 | F:1 | 10032 | A:1 C:4 H:1 | 10105 | F:1 | 10152 | F:1 |
| 9986 | F:1 | 10033 | F:1 | 10106 | F:1 K:1 | 10153 | F:9 K:1 |
| 9987 | F:1 | 0034 | F:1 | 10107 | F:1 | 10154 | F:1 |
| 9988 | A:7 | 10035 | F:1 | 10108 | F:1 | 10155 | F:1 |
| 9989 | F:1 | 10036 | F:1 | 10109 | F:1 | 10156 | F:1 |
| 9990 | F:1 | 10037 | F:1 | 10110 | F:1 | 10157 | F:1 |
| 9991 | F:1 | 10038 | F:1 | 10111 | F:1 | 10158 | F:1 |
| 9992 | F:1 | 10039 | F:1 | 10159 | F:1 | 10206 | F:1 |
| 9993 | F:1 | 10040 | F:1 | 10160 | F:1 | 10207 | F:1 |
| 9994 | F:1 | 10041 | F:1 | 10161 | F:1 | 10208 | F:1 |
| 9995 | F:1 | 10042 | A:2 | 10162 | F:1 | 10209 | F:1 |
| 9996 | F:1 | 10043 | F:1 | 10163 | F:1 | 10210 | F:1 |
| 9997 | F:1 | 10044 | F:1 | 10164 | F:1 | 10211 | F:1 |
| 9998 | F:1 | 10045 | F:1 | 10165 | F:1 | 10212 | F:1 |
| 9999 | F:1 | 10046 | F:1 | 10166 | F:1 | 10213 | F:1 |
| 10000 | F:1 | 10047 | F:1 | 10167 | F:1 | 10214 | F:1 |
| 10001 | F:1 | 10048 | F:1 | 10168 | F:2 | 10215 | F:1 |
| 10002 | F:1 | 10049 | F:1 | 10169 | F:1 | 10216 | F:1 |
| 10003 | F:1 | 10050 | F:1 | 10170 | F:1 | 10217 | F:1 |
| 10004 | F:1 | 10051 | F:1 | 10171 | F:1 | 10218 | F:1 |
| 10005 | F:1 | 10052 | F:1 | 10172 | F:1 | 10219 | F:1 |
| 10006 | F:1 | 10053 | F:1 | 10173 | F:1 | 10220 | F:1 |
| 10007 | F:1 | 10054 | F:1 | 10174 | F:1 | 10221 | F:1 |
| 10008 | F:1 | 10055 | F:1 | 10175 | F:1 | 10222 | F:1 |
| 10009 | F:1 | 10056 | F:1 | 10176 | F:1 | 10223 | F:1 |
| 10010 | F:1 | 10057 | F:1 | 10177 | F:1 | 10224 | F:1 |
| 10011 | F:1 | 10058 | F:1 | 10178 | F:10 K:4 | 10225 | F:1 |
| 10012 | F:1 | 10059 | F:1 | 10179 | F:1 | 10226 | K:1 |
| 10013 | F:1 | 10060 | F:1 | 10180 | F:1 | 10227 | K:1 |
| 10014 | F:1 | 10061 | F:1 | 10181 | F:1 | 10228 | K:1 |
| 10015 | F:1 | 10062 | F:1 | 10182 | F:1 | 10229 | F:1 |
| 10016 | F:1 | 10063 | F:1 | 10183 | F:1 | 10230 | K:1 |
| 10017 | F:1 | 10064 | F:1 | 10184 | F:1 | 10231 | K;1 |
| 10065 | F:1 | 10112 | F:1 | 10185 | K:1 | 10232 | K:1 |
| 10066 | F:1 | 10113 | F:1 | 10186 | F:1 | 10233 | K:1 |
| 10067 | F:1 | 10114 | F:1 | 10187 | F:1 | 10234 | K:1 |
| 10068 | F:1 | 10115 | F:1 | 10188 | F:1 | 10235 | K:1 |
| 10069 | F:1 | 10116 | F:1 | 10189 | F:2 | 10236 | K:1 |
| 10070 | F:1 | 10117 | F:1 | 10190 | F:1 | 10237 | F:1 |
| 10071 | F:1 | 10118 | F:1 | 10191 | F:1 | 10238 | K:1 |
| 10072 | F:1 | 10119 | F:1 | 10192 | F:1 | 10239 | K:1 |
| 10073 | F:1 K:1 | 10120 | F:1 | 10193 | K:1 | 10240 | K:1 |
| 10074 | F:1 | 10121 | F:1 | 10194 | F:1 | 10241 | K:1 |
| 10075 | F:1 | 10122 | F:1 | 10195 | F:1 | 10242 | K:1 |
| 10076 | F:1 | 10123 | F:1 | 10196 | F:1 | 10243 | K:1 |
| 10077 | F:1 | 10124 | F:1 | 10197 | F:1 | 10244 | K:1 |
| 10078 | F:1 | 10125 | F:1 | 10198 | F:1 | 10245 | K:1 |
| 10079 | C:4 | 10126 | F:1 | 10199 | F:1 | 10246 | K:1 |
| 10080 | F:1 | 10127 | F:1 | 10200 | F:1 | 10247 | K:1 |
| 10081 | F:1 | 10128 | F:1 | 10201 | F:1 | 10248 | F:1 |
| 10082 | F:1 | 10129 | F:1 | 10202 | F:1 | 10249 | K:1 |
| 10083 | F:1 | 10130 | F:1 | 10203 | F:1 | 10250 | K:1 |
| 10084 | F:1 | 10131 | F:1 | 10204 | F:1 | 10251 | K:1 |
| 10085 | F:1 | 10132 | F:1 | 10205 | F:1 | 10252 | K:1 |
| 10086 | F:1 | 10133 | F:1 | 10253 | K:1 | 10299 | K:1 |

TABLE V-continued (Spatial distribution)

| Seq Id No. | Tissue distribution | Seq Id No. | Tissue distribution |
|---|---|---|---|
| 10254 | K:1 | 10300 | K:1 |
| 10255 | K:1 | 10301 | K:1 |
| 10256 | K:1 | 10302 | K:1 |
| 10257 | K:1 | 10303 | K:1 |
| 10258 | F:1 | 10304 | K:1 |
| 10259 | K:1 | 10305 | K:1 |
| 10260 | K:1 | 10306 | F:1 |
| 10261 | K:1 | 10307 | K:1 |
| 10262 | K:1 | 10308 | K:1 |
| 10263 | K:1 | 10309 | K:1 |
| 10264 | K:1 | 10310 | K:1 |
| 10265 | K:1 | 10311 | K:1 |
| 10266 | K:1 | 10312 | K:1 |
| 10267 | K:1 | 10313 | K:1 |
| 10268 | K:1 | 10314 | K:1 |
| 10269 | F:1 | 10315 | K:1 |
| 10270 | K:1 | 10316 | K:1 |
| 10271 | K:1 | 10317 | K:1 |
| 10272 | K:1 | 10318 | K:1 |
| 10273 | K:1 | 10319 | K:1 |
| 10274 | K:1 | 10320 | K:1 |
| 10275 | K:1 | 10321 | K:1 |
| 10276 | K:1 | 10322 | K:1 |
| 10277 | K:1 | 10323 | K:1 |
| 10278 | F:1 | 10324 | K:1 |
| 10279 | K:1 | 10325 | K:1 |
| 10280 | K:1 | 10326 | K:1 |
| 10281 | K:1 | 10327 | K:1 |
| 10282 | K:1 | 10328 | K:1 |
| 10283 | K:1 | 10329 | K:1 |
| 10284 | K:1 | 10330 | K:1 |
| 10285 | K:1 | 10331 | F:1 K:1 |
| 10286 | F:1 | 10332 | K:1 |
| 10287 | K:1 | 10333 | K:1 |
| 10288 | K:1 | 10334 | K:1 |
| 10289 | K:1 | 10335 | K:1 |
| 10290 | K:1 | 10336 | K:1 |
| 10291 | K:1 | 10337 | K:1 |
| 10292 | K:1 | 10338 | K:1 |
| 10293 | K:1 | 10339 | F:9 K:3 |
| 10294 | K:1 | 10340 | K:1 |
| 10295 | A:13 B:18 C:60 D:6 F:3 H:53 I:1 K:7 | 10341 | K:1 |
| 10296 | A:6 | 10342 | K:1 |
| 10297 | F:1 | 10343 | K:1 |
| 10298 | K:1 | 10344 | K:1 |
| 10346 | K:1 | 10393 | K:1 |
| 10347 | K:1 | 10394 | K:1 |
| 10348 | F:9 K:4 | 10395 | K:1 |
| 10349 | K:1 | 10396 | K:1 |
| 10350 | K:1 | 10397 | K:1 |
| 10351 | K:1 | 10398 | K:1 |
| 10352 | K:1 | 10399 | K:1 |
| 10353 | K:1 | 10400 | K:1 |
| 10354 | K:1 | 10401 | A:1 |
| 10355 | K:1 | 10402 | K:1 |
| 10356 | K:1 | 10403 | K:1 |
| 10357 | K:1 | 10404 | K:1 |
| 10358 | K:1 | 10405 | K:1 |
| 10359 | K:1 | 10406 | K:1 |
| 10360 | K:1 | 10407 | K:1 |
| 10361 | K:1 | 10408 | K:3 |
| 10362 | K:1 | 10409 | K:1 |
| 10363 | K:2 | 10410 | K:1 |
| 10364 | K:1 | 10411 | K:1 |
| 10365 | K:1 | 10412 | K:1 |
| 10366 | K:1 | 10413 | A:3 |
| 10367 | K:1 | 10414 | K:1 |
| 10368 | K:1 | 10415 | K:1 |
| 10369 | K:1 | 10416 | K:1 |
| 10370 | K:1 | 10417 | K:1 |
| 10371 | K:1 | 10418 | K:1 |
| 10372 | K:1 | 10419 | K:1 |
| 10373 | K:1 | 10420 | K:1 |
| 10374 | K:1 | 10421 | I:2 |
| 10375 | K:1 | 10422 | K:1 |
| 10376 | K:1 | 10423 | K:1 |
| 10377 | A:4 | 10424 | K:1 |
| 10378 | H:2 | 10425 | K:1 |
| 10379 | K:1 | 10426 | K:1 |
| 10380 | K:1 | 10427 | B:2 |
| 10381 | K:1 | 10428 | K:1 |
| 10382 | K:1 | 10429 | K:1 |
| 10383 | K:1 | 10430 | K:1 |
| 10384 | K:1 | 10431 | K:1 |
| 10385 | K:1 | 10432 | K:1 |
| 10386 | K:1 | 10433 | K:1 |
| 10387 | K:1 | 10434 | K:1 |
| 10388 | K:1 | 10435 | K:1 |
| 10389 | K:1 | 10436 | K:1 |
| 10390 | K:1 | 10437 | K:1 |
| 10391 | K:1 | 10438 | F:4 K:2 |
| 10392 | F:1 | 10439 | K:1 |
| 10440 | K:1 | 10487 | K:1 |
| 10441 | K:1 | 10488 | K:1 |
| 10442 | K:1 | 10489 | K:1 |
| 10443 | K:1 | 10490 | K:1 |
| 10444 | F:1 K:1 | 10491 | K:1 |
| 10445 | A:5 | 10492 | K:1 |
| 10446 | K:1 | 10493 | K:1 |
| 10447 | K:1 | 10494 | K:1 |
| 10448 | K:1 | 10495 | K:1 |
| 10449 | K:1 | 10496 | K:1 |
| 10450 | K:1 | 10497 | K:1 |
| 10451 | K:1 | 10498 | K:1 |
| 10452 | K:1 | 10499 | K:1 |
| 10453 | A:5 | 10500 | K:1 |
| 10454 | K:1 | 10501 | K:1 |
| 10455 | K:1 | 10502 | K:1 |
| 10456 | K:1 | 10503 | K:1 |
| 10457 | K:1 | 10504 | A:1 |
| 10458 | K:1 | 10505 | K:1 |
| 10459 | K:1 | 10506 | K:1 |
| 10460 | K:1 | 10507 | K:1 |
| 10461 | K:1 | 10508 | K:1 |
| 10462 | K:1 | 10509 | K:1 |
| 10463 | K:1 | 10510 | K:1 |
| 10464 | K:1 | 10511 | K:1 |
| 10465 | K:1 | 10512 | K:1 |
| 10466 | K:1 | 10513 | K:1 |
| 10467 | K:1 | 10514 | K:1 |
| 10468 | K:1 | 10515 | K:1 |
| 10469 | K:1 | 10516 | K:1 |
| 10470 | K:1 | 10517 | K:1 |
| 10471 | K:1 | 10518 | K:1 |
| 10472 | K:1 | 10519 | K:1 |
| 10473 | K:1 | 10520 | K:1 |
| 10474 | K:1 | 10521 | K:1 |
| 10475 | K:1 | 10522 | K:1 |
| 10476 | K:1 | 10523 | B:1 C:2 |
| 10477 | K:1 | 10524 | K:1 |
| 10478 | A:1 | 10525 | K:1 |
| 10479 | K:1 | 10526 | K:1 |
| 10480 | K:1 | 10527 | K:1 |
| 10481 | K:1 | 10528 | K:1 |
| 10482 | K:1 | 10529 | K:1 |
| 10483 | K:1 | 10530 | K:1 |
| 10484 | K:1 | 10531 | C:1 H:1 |
| 10485 | K:1 | 10532 | K:1 |
| 10486 | K:1 | 10533 | K:1 |
| 10534 | K:1 | 10581 | K:1 |
| 10535 | K:1 | 10582 | K:1 |
| 10536 | K:1 | 10583 | K:1 |
| 10537 | K:1 | 10584 | K:1 |
| 10538 | A:1 B:2 H:1 K:1 | 10585 | K:1 |
| 10539 | K:1 | 10586 | K:1 |

TABLE V-continued

(Spatial distribution)

| Seq Id No. | Tissue distribution | Seq Id No. | Tissue distribution |
|---|---|---|---|
| 10540 | K:1 | 10587 | K:1 |
| 10541 | K:1 | 10588 | K:1 |
| 10542 | K:1 | 10589 | K:1 |
| 10543 | K:1 | 10590 | K:1 |
| 10544 | K:1 | 10591 | D:1 |
| 10545 | K:1 | 10592 | K:1 |
| 10546 | K:1 | 10593 | K:1 |
| 10547 | K:1 | 10594 | K:1 |
| 10548 | K:1 | 10595 | K:1 |
| 10549 | K:1 | 10596 | K:1 |
| 10550 | K:1 | 10597 | K:2 |
| 10551 | K:1 | 10598 | K:1 |
| 10552 | K:1 | 10599 | K:1 |
| 10553 | K:1 | 10600 | K:1 |
| 10554 | C:1 | 10601 | K:1 |
| 10555 | K:1 | 10602 | K:1 |
| 10556 | K:1 | 10603 | K:1 |
| 10557 | K:1 | 10604 | K:1 |
| 10558 | K:1 | 10605 | K:1 |
| 10559 | K:1 | 10606 | K:1 |
| 10560 | K:1 | 10607 | K:1 |
| 10561 | K:1 | 10608 | K:1 |
| 10562 | K:1 | 10609 | K:1 |
| 10563 | K:1 | 10610 | K:1 |
| 10564 | K:1 | 10611 | K:1 |
| 10565 | K:1 | 10612 | K:1 |
| 10566 | K:1 | 10613 | K:1 |
| 10567 | K:1 | 10614 | K:1 |
| 10568 | K:1 | 10615 | K:1 |
| 10569 | K:1 | 10616 | K:1 |
| 10570 | K:1 | 10617 | K:1 |
| 10571 | K:1 | 10618 | K:1 |
| 10572 | K:1 | 10619 | K:1 |
| 10573 | K:1 | 10620 | K:1 |
| 10574 | K:1 | 10621 | K:1 |
| 10575 | K:1 | 10622 | K:1 |
| 10576 | K:1 | 10623 | K:1 |
| 10577 | K:1 | 10624 | K:1 |
| 10578 | K:1 | 10625 | K:1 |
| 10579 | K:1 | 10626 | K:1 |
| 10580 | K:1 | 10627 | K:1 |
| 10628 | K:1 | 10675 | K:1 |
| 10629 | K:1 | 10676 | K:1 |
| 10630 | K:1 | 10677 | K:1 |
| 10631 | K:1 | 10678 | K:1 |
| 10632 | K:1 | 10679 | F:1 K:1 |
| 10633 | K:1 | 10680 | K:1 |
| 10634 | K:1 | 10681 | K:1 |
| 10635 | K:1 | 10682 | K:1 |
| 10636 | K:1 | 10683 | K:1 |
| 10637 | K:1 | 10684 | K:1 |
| 10638 | K:1 | 10685 | K:1 |
| 10639 | K:1 | 10686 | K:1 |
| 10640 | K:1 | 10687 | K:1 |
| 10641 | K:1 | 10688 | K:1 |
| 10642 | K:1 | 10689 | K:1 |
| 10643 | K:1 | 10690 | K:1 |
| 10644 | K:1 | 10691 | K:1 |
| 10645 | K:1 | 10692 | K:1 |
| 10646 | K:1 | 10693 | K:1 |
| 10647 | K:1 | 10694 | K:1 |
| 10648 | K:1 | 10695 | K:1 |
| 10649 | K:1 | 10696 | K:1 |
| 10650 | K:1 | 10697 | K:1 |
| 10651 | K:1 | 10698 | K:1 |
| 10652 | F:1 K:3 | 10699 | K:1 |
| 10653 | K:1 | 10700 | F:2 K:1 |
| 10654 | K:1 | 10701 | K:1 |
| 10655 | K:1 | 10702 | K:1 |
| 10656 | K:1 | 10703 | K:1 |
| 10657 | K:1 | 10704 | K:1 |
| 10658 | K:1 | 10705 | K:1 |
| 10659 | K:1 | 10706 | K:1 |
| 10660 | K:1 | 10707 | K:1 |
| 10661 | C:13 | 10708 | K:1 |
| 10662 | K:1 | 10709 | C:3 |
| 10663 | K:1 | 10710 | K:1 |
| 10664 | K:1 | 10711 | K:1 |
| 10665 | K:1 | 10712 | K:1 |
| 10666 | K:1 | 10713 | K:1 |
| 10667 | K:1 | 10714 | K:1 |
| 10668 | K:1 | 10715 | K:1 |
| 10669 | K:1 | 10716 | K:1 |
| 10670 | K:1 | 10717 | K:1 |
| 10671 | K:1 | 10718 | K:1 |
| 10672 | K:1 | 10719 | K:1 |
| 10673 | K:1 | 10720 | K:1 |
| 10674 | K:1 | 10721 | K:1 |
| 10722 | K:1 | 10769 | K:1 |
| 10723 | K:1 | 10770 | K:1 |
| 10724 | K:1 | 10771 | K:1 |
| 10725 | K:1 | 10772 | K:1 |
| 10726 | K:1 | 10773 | K:1 |
| 10727 | K:1 | 10774 | K:1 |
| 10728 | K:1 | 10775 | K:1 |
| 10729 | K:1 | 10776 | K:1 |
| 10730 | K:1 | 10777 | K:1 |
| 10731 | K:1 | 10778 | K:1 |
| 10732 | K:1 | 10779 | K:1 |
| 10733 | K:1 | 10780 | K:1 |
| 10734 | H:3 | 10781 | K:1 |
| 10735 | K:1 | 10782 | K:1 |
| 10736 | K:1 | 10783 | K:1 |
| 10737 | K:1 | 10784 | K:1 |
| 10738 | K:1 | 10785 | K:1 |
| 10739 | K:1 | 10786 | K:1 |
| 10740 | K:1 | 10787 | K:1 |
| 10741 | K:1 | 10788 | K:1 |
| 10742 | K:1 | 10789 | K:1 |
| 10743 | K:1 | 10790 | K:1 |
| 10744 | K:1 | 10791 | K:1 |
| 10745 | K:1 | 10792 | K:1 |
| 10746 | K:1 | 10793 | K:1 |
| 10747 | K:1 | 10794 | K:1 |
| 10748 | K:1 | 10795 | K:1 |
| 10749 | K:1 | 10796 | K:1 |
| 10750 | K:1 | 10797 | K:1 |
| 10751 | K:1 | 10798 | C:15 |
| 10752 | K:1 | 10799 | K:1 |
| 10753 | K:1 | 10800 | K:1 |
| 10754 | K:1 | 10801 | K:1 |
| 10755 | K:1 | 10802 | K:1 |
| 10756 | K:1 | 10803 | K:1 |
| 10757 | K:1 | 10804 | K:1 |
| 10758 | K:1 | 10805 | K:1 |
| 10759 | K:1 | 10806 | K:1 |
| 10760 | K:1 | 10807 | K:1 |
| 10761 | K:1 | 10808 | K:1 |
| 10762 | K:1 | 10809 | K:1 |
| 10763 | F:1 | 10810 | K:1 |
| 10764 | K:1 | 10811 | K:1 |
| 10765 | K:1 | 10812 | K:1 |
| 10766 | K:1 | 10813 | K:1 |
| 10767 | K:1 | 10814 | K:1 |
| 10768 | K:1 | 10815 | K:1 |
| 10816 | K:1 | 10863 | K:1 |
| 10817 | C:1 | 10864 | K:1 |
| 10818 | K:1 | 10865 | K:1 |
| 10819 | K:1 | 10866 | K:1 |
| 10820 | K:1 | 10867 | K:1 |
| 10821 | K:1 | 10868 | K:1 |
| 10822 | K:1 | 10869 | K:1 |
| 10823 | K:1 | 10870 | K:1 |
| 10824 | K:1 | 10871 | K:1 |
| 10825 | K:1 | 10872 | K:1 |
| 10826 | K:1 | 10873 | K:1 |

TABLE V-continued (Spatial distribution)

| Seq Id No. | Tissue distribution | Seq Id No. | Tissue distribution |
|---|---|---|---|
| 10827 | K:1 | 10874 | K:1 |
| 10828 | K:1 | 10875 | K:1 |
| 10829 | K:1 | 10876 | K:1 |
| 10830 | K:1 | 10877 | K:1 |
| 10831 | K:1 | 10878 | K:1 |
| 10832 | K:1 | 10879 | K:1 |
| 10833 | K:1 | 10880 | K:1 |
| 10834 | B:1 C:1 H:3 | 10881 | K:1 |
| 10835 | K:2 | 10882 | K:1 |
| 10836 | K:1 | 10883 | K:1 |
| 10837 | K:1 | 10884 | K:1 |
| 10838 | K:1 | 10885 | K:1 |
| 10839 | K:1 | 10886 | K:1 |
| 10840 | K:1 | 10887 | K:1 |
| 10841 | K:1 | 10888 | K:1 |
| 10842 | K:1 | 10889 | K:1 |
| 10843 | K:1 | 10890 | K:1 |
| 10844 | K:1 | 10891 | K:1 |
| 10845 | F:3 | 10892 | K:1 |
| 10846 | K:1 | 10893 | K:1 |
| 10847 | K:1 | 10894 | K:1 |
| 10848 | K:1 | 10895 | K:1 |
| 10849 | K:1 | 10896 | K:1 |
| 10850 | K:1 | 10897 | K:1 |
| 10851 | K:1 | 10898 | K:1 |
| 10852 | F:1 | 10899 | K:1 |
| 10853 | K:1 | 10900 | K:1 |
| 10854 | K:1 | 10901 | K:1 |
| 10855 | K:1 | 10902 | K:1 |
| 10856 | K:1 | 10903 | A:3 |
| 10857 | K:1 | 10904 | K:1 |
| 10858 | K:1 | 10905 | K:1 |
| 10859 | K:1 | 10906 | K:1 |
| 10860 | K:1 | 10907 | K:1 |
| 10861 | K:1 | 10908 | K:1 |
| 10862 | K:1 | 10909 | K:1 |
| 10910 | K:1 | 10957 | K:1 |
| 10911 | K:1 | 10958 | K:1 |
| 10912 | K:1 | 10959 | K:1 |
| 10913 | K:1 | 10960 | K:1 |
| 10914 | K:1 | 10961 | K:1 |
| 10915 | K:1 | 10962 | K:1 |
| 10916 | K:1 | 10963 | H:2 |
| 10917 | K:1 | 10964 | K:1 |
| 10918 | K:1 | 10965 | K:1 |
| 10919 | K:1 | 10966 | K:1 |
| 10920 | K:1 | 10967 | K:1 |
| 10921 | K:1 | 10968 | K:1 |
| 10922 | K:1 | 10969 | K:1 |
| 10923 | K:1 | 10970 | K:1 |
| 10924 | K:1 | 10971 | K:1 |
| 10925 | K:1 | 10972 | K:1 |
| 10926 | K:1 | 10973 | K:1 |
| 10927 | K:1 | 10974 | K:1 |
| 10928 | K:1 | 10975 | K:1 |
| 10929 | K:1 | 10976 | F:4 H:4 K:1 |
| 10930 | K:1 | 10977 | K:1 |
| 10931 | K:1 | 10978 | K:1 |
| 10932 | K:1 | 10979 | K:1 |
| 10933 | K:1 | 10980 | K:1 |
| 10934 | K:1 | 10981 | K:1 |
| 10935 | K:1 | 10982 | K:1 |
| 10936 | K:1 | 10983 | K:1 |
| 10937 | K:1 | 10984 | K:1 |
| 10938 | K:1 | 10985 | K:1 |
| 10939 | K:1 | 10986 | K:1 |
| 10940 | K:1 | 10987 | K:1 |
| 10941 | K:1 | 10988 | K:1 |
| 10942 | K:1 | 10989 | K:1 |
| 10943 | K:1 | 10990 | B:1 |
| 10944 | K:1 | 10991 | K:1 |
| 10945 | K:1 | 10992 | K:1 |
| 10946 | K:1 | 10993 | K:1 |
| 10947 | K:1 | 10994 | K:1 |
| 10948 | K:1 | 10995 | K:1 |
| 10949 | K:1 | 10996 | K:1 |
| 10950 | K:1 | 10997 | K:1 |
| 10951 | K:1 | 10998 | K:1 |
| 10952 | K:1 | 10999 | K:1 |
| 10953 | K:1 | 11000 | K:1 |
| 10954 | K.1 | 11001 | K:1 |
| 10955 | K:1 | 11002 | K:1 |
| 10956 | K:1 | 11003 | K:1 |
| 11004 | A:13 | 11051 | K:1 |
| 11005 | K:1 | 11052 | K:1 |
| 11006 | K:1 | 11053 | K:1 |
| 11007 | K:1 | 11054 | K:1 |
| 11008 | K:1 | 11055 | K:1 |
| 11009 | K:1 | 11056 | A:4 |
| 11010 | K:1 | 11057 | K:1 |
| 11011 | I:2 | 11058 | K:1 |
| 11012 | K:1 | 11059 | K:1 |
| 11013 | K:1 | 11060 | K:1 |
| 11014 | K:1 | 11061 | K:1 |
| 11015 | K:1 | 11062 | K:1 |
| 11016 | K:1 | 11063 | K:1 |
| 11017 | K:1 | 11064 | K:1 |
| 11018 | K:1 | 11065 | K:1 |
| 11019 | F:6 K:1 | 11066 | K:1 |
| 11020 | K:1 | 11067 | A:12 B:15 C:58 D:6 F:3 H:57 I:1 K:7 |
| 11021 | K:1 | | |
| 11022 | K:1 | 11068 | K:1 |
| 11023 | K:1 | 11069 | K:1 |
| 11024 | K:1 | 11070 | K:1 |
| 11025 | K:1 | 11071 | K:1 |
| 11026 | K:1 | 11072 | K:1 |
| 11027 | K:1 | 11073 | K:1 |
| 11028 | K:1 | 11074 | K:1 |
| 11029 | K:1 | 11075 | K:1 |
| 11030 | K:1 | 11076 | B:1 D:1 |
| 11031 | K:1 | 11077 | K:1 |
| 11032 | K:1 | 11078 | K:1 |
| 11033 | K:1 | 11079 | K:1 |
| 11034 | K:1 | 11080 | K:1 |
| 11035 | K:1 | 11081 | K:1 |
| 11036 | C:4 | 11082 | K:1 |
| 11037 | K:1 | 11083 | K:1 |
| 11038 | K:1 | 11084 | K:1 |
| 11039 | K:1 | 11085 | K:1 |
| 11040 | K:1 | 11086 | K:1 |
| 11041 | K:1 | 11087 | K:1 |
| 11042 | K:1 | 11088 | K:1 |
| 11043 | K:1 | 11089 | K:1 |
| 11044 | K:1 | 11090 | A:1 K:1 |
| 11045 | K:1 | 11091 | K:1 |
| 11046 | K:1 | 11092 | K:1 |
| 11047 | K:1 | 11093 | K:1 |
| 11048 | K:1 | 11094 | K:1 |
| 11049 | K:1 | 11095 | K:1 |
| 11050 | K:1 | 11096 | K:1 |
| 11097 | K:1 | 11144 | B:2 |
| 11098 | K:1 | 11145 | K:1 |
| 11099 | K:1 | 11146 | K:1 |
| 11100 | K:1 | 11147 | K:1 |
| 11101 | K:1 | 11148 | K:1 |
| 11102 | K:1 | 11149 | K:1 |
| 11103 | K:1 | 11150 | K:1 |
| 11104 | K:1 | 11151 | K:1 |
| 11105 | K:1 | 11152 | K:1 |
| 11106 | K:1 | 11153 | K:1 |
| 11107 | K:1 | 11154 | K:1 |
| 11108 | K:1 | 11155 | K:1 |
| 11109 | K:1 | 11156 | K:1 |
| 11110 | K:1 | 11157 | K:1 |
| 11111 | K:1 | 11158 | H:10 |
| 11112 | K:1 | 11159 | K:1 |

TABLE V-continued (Spatial distribution)

| Seq Id No. | Tissue distribution | Seq Id No. | Tissue distribution |
|---|---|---|---|
| 11113 | K:1 | 11160 | K:1 |
| 11114 | K:1 | 11161 | K:1 |
| 11115 | K:1 | 11162 | K:1 |
| 11116 | K:1 | 11163 | K:1 |
| 11117 | K:1 | 11164 | K:1 |
| 11118 | K:1 | 11165 | K:1 |
| 11119 | K:1 | 11166 | K:1 |
| 11120 | K:1 | 11167 | K:1 |
| 11121 | K:1 | 11168 | K:1 |
| 11122 | K:1 | 11169 | K:1 |
| 11123 | K:1 | 11170 | K:1 |
| 11124 | K:1 | 11171 | K:1 |
| 11125 | K:1 | 11172 | K:3 |
| 11126 | K:1 | 11173 | K:1 |
| 11127 | K:1 | 11174 | K:1 |
| 11128 | K:1 | 11175 | K:1 |
| 11129 | K:1 | 11176 | K:1 |
| 11130 | K:1 | 11177 | K:1 |
| 11131 | K:1 | 11178 | K:1 |
| 11132 | K:1 | 11179 | F:5 |
| 11133 | K:1 | 11180 | K:1 |
| 11134 | K:1 | 11181 | K:1 |
| 11135 | K:2 | 11182 | K:1 |
| 11136 | K:1 | 11183 | K:1 |
| 11137 | K:1 | 11184 | K:1 |
| 11138 | K:1 | 11185 | K:1 |
| 11139 | K:1 | 11186 | K:1 |
| 11140 | K:1 | 11187 | K:1 |
| 11141 | K:1 | 11188 | K:1 |
| 11142 | K:1 | 11189 | F:1 K:1 |
| 11143 | K:1 | 11190 | K:1 |
| 11191 | K:1 | 11238 | K:1 |
| 11192 | K:1 | 11239 | K:1 |
| 11193 | K:1 | 11240 | K:1 |
| 11194 | K:1 | 11241 | K:1 |
| 11195 | K:1 | 11242 | K:1 |
| 11196 | K:1 | 11243 | K:1 |
| 11197 | K:1 | 11244 | K:1 |
| 11198 | K:1 | 12445 | K:1 |
| 11199 | K:1 | 11246 | K:1 |
| 11200 | K:1 | 11247 | H:1 |
| 11201 | K:1 | 11248 | K:1 |
| 11202 | K:1 | 11249 | K:1 |
| 11203 | K:1 | 11250 | A:1 |
| 11204 | K:1 | 11251 | A:1 |
| 11205 | K:1 | 11252 | A:1 |
| 11206 | K:3 | 11253 | A:1 |
| 11207 | F:1 K:4 | 11254 | A:1 |
| 11208 | K:1 | 11255 | A:1 |
| 11209 | F:1 | 11256 | A:1 |
| 11210 | F:1 | 11257 | A:1 |
| 11211 | F:1 | 11258 | A:1 |
| 11212 | F:1 | 11259 | A:1 |
| 11213 | F:1 | 11260 | A:1 |
| 11214 | C:2 | 11261 | A:1 |
| 11215 | F:1 | 11262 | A:1 |
| 11216 | F:1 | 11263 | A:1 |
| 11217 | F:1 | 11264 | A:1 |
| 11218 | F:1 | 11265 | A:1 |
| 11219 | F:1 | 11266 | A:1 |
| 11220 | F:1 | 11267 | A:1 |
| 11221 | F:1 | 11268 | A:1 |
| 11222 | F:1 | 11269 | A:1 |
| 11223 | F:1 | 11270 | A:1 |
| 11224 | F:1 | 11271 | A:1 |
| 11225 | F:1 | 11272 | A:1 |
| 11226 | F:1 | 11273 | A:1 |
| 11227 | F:1 | 11274 | A:1 |
| 11228 | F:1 | 11275 | A:1 |
| 11229 | F:1 | 11276 | A:1 |
| 11230 | F:1 | 11277 | A:1 |
| 11231 | F:1 | 11278 | A:1 |
| 11232 | F:1 | 11279 | A:1 H:2 |
| 11233 | F:1 | 11280 | A:1 |
| 11234 | F:1 | 11281 | A:1 |
| 11235 | F:1 | 11282 | A:1 |
| 11236 | F:1 | 11283 | A:1 |
| 11237 | F:1 | 11284 | A:1 |
| 11285 | A:1 | 11332 | A:1 |
| 11286 | A:1 | 11333 | A:1 |
| 11287 | A:1 | 11334 | A:1 |
| 11288 | A:1 | 11335 | A:1 |
| 11289 | A:1 | 11336 | A:1 |
| 11290 | A:1 | 11337 | A:1 |
| 11291 | A:1 | 11338 | A:1 |
| 11292 | A:1 | 11339 | A:1 |
| 11293 | A:1 | 11340 | B:1 |
| 11294 | A:1 | 11341 | A:8 |
| 11295 | A:1 | 11342 | B:1 |
| 11296 | A:1 | 11343 | B:1 |
| 11297 | A:1 | 11344 | B:1 |
| 11298 | A:1 | 11345 | B:1 |
| 11299 | A:1 | 11346 | B:1 |
| 11300 | A:1 | 11347 | B:1 |
| 11301 | A:1 | 11348 | B:1 |
| 11302 | A:1 | 11349 | B:1 |
| 11303 | A:1 | 11350 | K:2 |
| 11304 | A:1 | 11351 | B:1 |
| 11305 | A:1 | 11352 | B:1 |
| 11306 | A:1 | 11353 | B:1 |
| 11307 | A:1 | 11354 | B:1 |
| 11308 | A:1 | 11355 | B:1 |
| 11309 | A:1 | 11356 | B:1 |
| 11310 | A:5 | 11357 | B:1 |
| 11311 | A:1 | 11358 | B:1 |
| 11312 | A:1 | 11359 | B:1 |
| 11313 | A:1 | 11360 | C:2 |
| 11314 | A:1 | 11361 | B:1 |
| 11315 | A:1 | 11362 | B:1 |
| 11316 | A:1 | 11363 | B:1 |
| 11317 | A:1 | 11364 | B:1 |
| 11318 | A:1 | 11365 | B:1 |
| 11319 | A:1 | 11366 | K:2 |
| 11320 | A:1 | 11367 | B:1 |
| 11321 | H:2 | 11368 | B:1 |
| 11322 | A:1 | 11369 | B:1 |
| 11323 | A:1 | 11370 | B:1 |
| 11324 | A:1 | 11371 | B:1 |
| 11325 | A:1 | 11372 | B:1 |
| 11326 | A:1 | 11373 | B:1 |
| 11327 | A:1 | 11374 | B:1 |
| 11328 | A:1 | 11375 | B:1 |
| 11329 | A:1 | 11376 | B:1 |
| 11330 | A:1 | 11377 | B:1 |
| 11331 | A:1 | 11378 | B:3 F:1 |
| 11379 | B:1 | 11426 | B:1 |
| 11380 | B:1 | 11427 | B:1 |
| 11381 | B:1 | 11428 | B:1 |
| 11382 | B:1 | 11429 | B:1 |
| 11383 | B:1 | 11430 | B:1 |
| 11384 | B:1 | 11431 | B:1 |
| 11385 | B:1 | 11432 | B:1 |
| 11386 | B:1 | 11433 | B:1 |
| 11387 | B:3 F:11 H:2 | 11434 | B:1 |
| 11388 | B:1 | 11435 | B:1 |
| 11389 | B:1 | 11436 | B:1 |
| 11390 | B:1 | 11437 | B:1 |
| 11391 | B:1 | 11438 | B:1 |
| 11392 | B:1 | 11439 | C:1 |
| 11393 | B:1 | 11440 | C:1 |
| 11394 | B:1 | 11441 | C:1 |
| 11395 | B:1 | 11442 | C:1 |
| 11396 | B:1 | 11443 | C:1 |
| 11397 | B:1 | 11444 | C:1 |
| 11398 | B:1 | 11445 | C:1 |
| 11399 | B:1 | 11446 | C:1 |

TABLE V-continued
(Spatial distribution)

| Seq Id No. | Tissue distribution | Seq Id No. | Tissue distribution |
|---|---|---|---|
| 11400 | B:1 | 11447 | C:1 |
| 11401 | B:1 | 11448 | C:1 |
| 11402 | B:1 | 11449 | K:2 |
| 11403 | B:1 | 11450 | C:1 |
| 11404 | B:1 | 11451 | C:1 |
| 11405 | B:1 | 11452 | C:1 |
| 11406 | B:1 | 11453 | C:1 |
| 11407 | B:1 | 11454 | C:1 |
| 11408 | B:1 | 11455 | C:1 |
| 11409 | B:1 | 11456 | C:1 |
| 11410 | B:1 | 11457 | F:1 K:2 |
| 11411 | B:1 | 11458 | C:1 |
| 11412 | B:1 | 11459 | C:1 |
| 11413 | B:1 | 11460 | C:1 |
| 11414 | B:1 | 11461 | C:1 |
| 11415 | B:1 | 11462 | C:1 |
| 11416 | B:1 | 11463 | C:1 |
| 11417 | B:1 | 11464 | C:1 |
| 11418 | B:1 | 11465 | F:1 K:2 |
| 11419 | B:1 | 11466 | C:1 |
| 11420 | B:1 | 11467 | C:1 |
| 11421 | B:1 | 11468 | C:1 |
| 11422 | B:1 | 11469 | C:1 |
| 11423 | B:1 | 11470 | C:1 |
| 11424 | B:1 | 11471 | C:1 |
| 11425 | B:1 | 11472 | C:1 |
| 11473 | H:2 | 11520 | C:1 |
| 11474 | C:1 | 11521 | C:1 |
| 11475 | C:1 | 11522 | C:1 |
| 11476 | C:1 | 11523 | C:1 |
| 11477 | C:1 | 11524 | C:1 |
| 11478 | C:1 | 11525 | C:1 |
| 11479 | C:1 | 11526 | C:1 |
| 11480 | C:1 | 11527 | A:2 D:1 K:1 |
| 11481 | C:1 | 11528 | C:1 |
| 11482 | C:1 | 11529 | C:1 |
| 11483 | C:1 | 11530 | C:1 |
| 11484 | F:2 K:2 | 11531 | C:1 |
| 11485 | C:1 | 11532 | C:1 |
| 11486 | C:1 | 11533 | C:1 |
| 11487 | C:1 | 11534 | C:1 |
| 11488 | C:1 | 11535 | C:1 |
| 11489 | C:1 | 11536 | C:1 |
| 11490 | C:1 | 11537 | H:2 |
| 11491 | C:1 | 11538 | C:1 |
| 11492 | C:1 | 11539 | J:1 |
| 11493 | C:1 | 11540 | J:1 |
| 11494 | C:1 | 11541 | J:1 |
| 11495 | C:1 | 11542 | J:1 |
| 11496 | C:1 | 11543 | J:1 |
| 11497 | C:1 | 11544 | J:1 |
| 11498 | C:1 | 11545 | J:1 |
| 11499 | F:2 K:2 | 11546 | J:1 |
| 11500 | C:1 | 11547 | J:1 |
| 11501 | C:1 | 11548 | J:1 |
| 11502 | C:1 | 11549 | J:1 |
| 11503 | C:1 | 11550 | J:1 |
| 11504 | C:1 | 11551 | J:1 |
| 11505 | C:1 | 11552 | J:1 |
| 11506 | C:1 | 11553 | E:1 |
| 11507 | C:1 | 11554 | E:1 |
| 11508 | C:1 | 11555 | E:1 |
| 11509 | A:3 | 11556 | E:1 |
| 11510 | C:1 | 11557 | C:1 |
| 11511 | C:1 | 11558 | E:1 |
| 11512 | C:1 | 11559 | E:1 |
| 11513 | C:1 | 11560 | E:1 |
| 11514 | C:1 | 11561 | E:1 |
| 11515 | C:1 | 11562 | C:1 |
| 11516 | C:1 | 11563 | C:1 |
| 11517 | C:1 | 11564 | C:1 |
| 11518 | C:1 | 11565 | K:3 |
| 11519 | C:1 | 11566 | C:1 |
| 11567 | C:1 | 11614 | C:1 |
| 11568 | C:1 | 11615 | C:1 |
| 11569 | C:1 | 11616 | C:1 |
| 11570 | C:1 | 11617 | C:1 |
| 11571 | C:1 | 11618 | C:1 |
| 11572 | C:1 | 11619 | C:1 |
| 11573 | C:1 | 11620 | C:1 |
| 11574 | C:1 | 11621 | C:1 |
| 11575 | C:1 | 11622 | C:1 |
| 11576 | C:1 | 11623 | C:1 |
| 11577 | C:1 | 11624 | C:1 |
| 11578 | C:1 | 11625 | C:1 |
| 11579 | C:1 | 11626 | C:1 |
| 11580 | C:1 | 11627 | C:1 |
| 11581 | C:1 | 11628 | C:1 |
| 11582 | C:1 | 11629 | C:1 |
| 11583 | C:1 | 11630 | C:1 |
| 11584 | B:1 C:2 | 11631 | C:1 |
| 11585 | C:1 | 11632 | C:1 |
| 11586 | C:1 | 11633 | C:1 |
| 11587 | C:1 | 11634 | C:1 |
| 11588 | C:1 | 11635 | C:1 |
| 11589 | C:1 | 11636 | C:1 |
| 11590 | C:1 | 11637 | C:1 |
| 11591 | C:1 | 11638 | C:1 |
| 11592 | C:1 | 11639 | C:1 |
| 11593 | C:1 | 11640 | C:1 |
| 11594 | C:1 | 11641 | C:1 |
| 11595 | B:3 | 11642 | C:1 |
| 11596 | C:1 | 11643 | C:1 |
| 11597 | C:1 | 11644 | C:1 |
| 11598 | C:1 | 11645 | C:1 |
| 11599 | C:1 | 11646 | C:1 |
| 11600 | C:1 | 11647 | C:1 |
| 11601 | C:1 | 11648 | C:1 |
| 11602 | C:1 | 11649 | C:1 |
| 11603 | C:1 | 11650 | C:1 |
| 11604 | C:1 | 11651 | C:1 |
| 11605 | C:1 | 11652 | C:1 |
| 11606 | K:2 | 11653 | C:1 |
| 11607 | C:1 | 11654 | C:1 |
| 11608 | C:1 | 11655 | C:1 |
| 11609 | C:1 | 11656 | C:1 |
| 11610 | C:1 | 11657 | C:1 |
| 11611 | C:1 | 11658 | C:1 |
| 11612 | C:1 | 11659 | C:1 |
| 11613 | C:1 | 11660 | C:1 |
| 11661 | C:1 | 11708 | C:1 |
| 11662 | C:1 | 11709 | C:1 |
| 11663 | C:1 | 11710 | C:1 |
| 11664 | C:1 | 11711 | C:1 |
| 11665 | C:1 | 11712 | C:1 |
| 11666 | C:1 | 11713 | C:1 |
| 11667 | C:1 | 11714 | C:1 |
| 11668 | C:1 | 11715 | C:1 |
| 11669 | C:1 | 11716 | C:1 |
| 11670 | C:1 | 11717 | F:2 |
| 11671 | C:1 | 11718 | C:1 |
| 11672 | C:1 | 11719 | C:1 |
| 11673 | C:1 | 11720 | C:1 |
| 11674 | F:1 | 11721 | C:1 |
| 11675 | C:1 | 11722 | C:1 |
| 11676 | C:1 | 11723 | C:1 |
| 11677 | C:1 | 11724 | C:1 |
| 11678 | C:1 | 11725 | C:1 |
| 11679 | C:1 | 11726 | C:1 |
| 11680 | C:1 | 11727 | C:1 |
| 11681 | C:1 | 11728 | C:1 |
| 11682 | C:1 | 11729 | C:1 |
| 11683 | C:1 | 11730 | C:1 |
| 11684 | C:1 | 11731 | C:1 |
| 11685 | F:1 | 11732 | C:1 |
| 11686 | C:1 | 11733 | C:1 |

TABLE V-continued (Spatial distribution)

| Seq Id No. | Tissue distribution | Seq Id No. | Tissue distribution |
|---|---|---|---|
| 11687 | C:1 | 11734 | C:1 |
| 11688 | C:1 | 11735 | C:1 |
| 11689 | C:1 | 11736 | C:1 |
| 11690 | C:1 | 11737 | K:5 |
| 11691 | C:1 | 11738 | C:1 |
| 11692 | C:1 | 11739 | C:1 |
| 11693 | C:1 | 11740 | C:1 |
| 11694 | C:1 | 11741 | C:1 |
| 11695 | C:1 | 11742 | C:1 |
| 11696 | C:6 | 11743 | C:1 |
| 11697 | C:1 | 11744 | C:1 |
| 11698 | C:1 | 11745 | C:1 |
| 11699 | C:1 | 11746 | C:1 |
| 11700 | C:1 | 11747 | F:2 K:22 |
| 11701 | C:1 | 11748 | C:1 |
| 11702 | C:1 | 11749 | C:1 |
| 11703 | C:1 | 11750 | C:1 |
| 11704 | C:1 | 11751 | C:1 |
| 11705 | C:1 | 11752 | C:1 |
| 11706 | C:1 | 11753 | C:1 |
| 11707 | H:3 | 11754 | C:1 |
| 11755 | C:1 | 11802 | C:1 |
| 11756 | C:1 | 11803 | C:1 |
| 11757 | K:2 | 11804 | C:1 |
| 11758 | C:1 | 11805 | C:1 |
| 11759 | C:1 | 11806 | C:1 |
| 11760 | C:1 | 11807 | C:1 |
| 11761 | C:1 | 11808 | C:1 |
| 11762 | C:1 | 11809 | C:1 |
| 11763 | C:1 | 11810 | C:1 |
| 11764 | C:1 | 11811 | B:2 |
| 11765 | C:1 | 11812 | C:1 |
| 11766 | C:1 | 11813 | C:1 |
| 11767 | C:1 | 11814 | C:1 |
| 11768 | B:3 | 11815 | C:1 |
| 11769 | C:1 | 11816 | C:1 |
| 11770 | C:1 | 11817 | C:1 |
| 11771 | C:1 | 11818 | C:1 |
| 11772 | C:1 | 11819 | C:1 |
| 11773 | C:1 | 11820 | C:1 |
| 11774 | C:1 | 11821 | C:1 |
| 11775 | C:1 | 11822 | F:13 K:2 |
| 11776 | C:1 | 11823 | C:1 |
| 11777 | C:1 | 11824 | C:1 |
| 11778 | C:1 | 11825 | C:1 |
| 11779 | F:1 K:4 | 11826 | C:1 |
| 11780 | C:1 | 11827 | C:1 |
| 11781 | C:1 | 11828 | C:1 |
| 11782 | C:1 | 11829 | C:1 |
| 11783 | C:1 | 11830 | C:1 |
| 11784 | C:1 | 11831 | C:1 |
| 11785 | C:1 | 11832 | C:1 |
| 11786 | C:1 | 11833 | F:5 |
| 11787 | C:1 | 11834 | C:1 |
| 11788 | C:1 | 11835 | C:1 |
| 11789 | C:1 | 11836 | C:1 |
| 11790 | H:5 | 11837 | C:1 |
| 11791 | C:1 | 11838 | C:1 |
| 11792 | C:1 | 11839 | C:1 |
| 11793 | C:1 | 11840 | C:1 |
| 11794 | C:1 | 11841 | C:1 |
| 11795 | C:1 | 11842 | C:1 |
| 11796 | C:1 | 11843 | F:1 |
| 11797 | C:1 | 11844 | C:1 |
| 11798 | C:1 | 11845 | C:1 |
| 11799 | C:1 | 11846 | C:1 |
| 11800 | C:1 | 11847 | C:1 |
| 11801 | C:4 | 11848 | C:1 |
| 11849 | C:1 | 11896 | C:1 |
| 11850 | C:1 | 11897 | C:1 |
| 11851 | C:1 | 11898 | C:1 |
| 11852 | C:1 | 11899 | C:1 |
| 11853 | C:1 | 11900 | C:1 |
| 11854 | K:3 | 11901 | C:1 |
| 11855 | C:1 | 11902 | C:1 |
| 11856 | C:1 | 11903 | C:1 |
| 11857 | C:1 | 11904 | C:1 |
| 11858 | C:1 | 11905 | C:1 |
| 11859 | C:1 | 11906 | A:1 |
| 11860 | C:1 | 11907 | C:1 |
| 11861 | C:1 | 11908 | C:1 |
| 11862 | C:1 | 11909 | C:1 |
| 11863 | C:1 | 11910 | C:1 |
| 11864 | C:1 | 11911 | C:1 |
| 11865 | C:1 | 11912 | C:1 |
| 11866 | C:1 | 11913 | C:1 |
| 11867 | C:1 | 11914 | C:1 |
| 11868 | C:1 | 11915 | C:1 |
| 11869 | C:1 | 11916 | K:1 |
| 11870 | C:1 | 11917 | C:1 |
| 11871 | C:1 | 11918 | C:1 |
| 11872 | C:1 | 11919 | C:1 |
| 11873 | C:1 | 11920 | C:1 |
| 11874 | C:1 | 11921 | C:1 |
| 11875 | C:1 | 11922 | C:1 |
| 11876 | C:1 | 11923 | C:1 |
| 11877 | C:1 | 11924 | C:1 |
| 11878 | C:1 | 11925 | C:1 |
| 11879 | C:1 | 11926 | C:1 |
| 11880 | C:1 | 11927 | B:2 |
| 11881 | C:1 | 11928 | C:1 |
| 11882 | C:1 | 11929 | C:1 |
| 11883 | C:1 | 11930 | C:1 |
| 11884 | H:2 | 11931 | C:1 |
| 11885 | C:1 | 11932 | C:1 |
| 11886 | C:1 | 11933 | C:1 |
| 11887 | C:1 | 11934 | C:1 |
| 11888 | C:1 | 11935 | C:1 |
| 11889 | C:1 | 11936 | C:1 |
| 11890 | C:1 | 11937 | C:1 |
| 11891 | C:1 | 11938 | C:1 |
| 11892 | C:1 | 11939 | C:1 |
| 11893 | C:1 | 11940 | C:1 |
| 11894 | C:1 | 11941 | C:1 |
| 11895 | F:13 | 11942 | C:1 |
| 11943 | C:1 | 11990 | C:1 |
| 11944 | C:1 | 11991 | C:1 |
| 11945 | C:1 | 11992 | C:1 |
| 11946 | C:1 | 11993 | C:1 |
| 11947 | C:1 | 11994 | C:1 |
| 11948 | C:1 | 11995 | C:1 |
| 11949 | C:1 | 11996 | C:1 |
| 11950 | C:1 | 11997 | C:1 |
| 11951 | C:1 | 11998 | K:1 |
| 11952 | C:1 | 11999 | C:1 |
| 11953 | C:1 | 12000 | C:1 |
| 11954 | C:1 | 12001 | C:1 |
| 11955 | C:1 | 12002 | C:1 |
| 11956 | C:1 | 12003 | C:1 |
| 11957 | C:1 | 12004 | C:1 |
| 11958 | C:1 | 12005 | C:1 |
| 11959 | C:1 | 12006 | C:1 |
| 11960 | C:1 | 12007 | C:1 |
| 11961 | C:1 | 12008 | F:1 |
| 11962 | C:1 | 12009 | C:1 |
| 11963 | C:1 | 12010 | C:1 |
| 11964 | C:1 | 12011 | C:1 |
| 11965 | C:1 | 12012 | C:1 |
| 11966 | C:1 | 12013 | C:1 |
| 11967 | C:1 | 12014 | C:1 |
| 11968 | C:1 | 12015 | C:1 |
| 11969 | C:1 | 12016 | C:1 |
| 11970 | C:1 | 12017 | C:1 |
| 11971 | C:1 | 12018 | C:1 |
| 11972 | C:1 | 12019 | C:1 |
| 11973 | C:1 | 12020 | C:1 |

TABLE V-continued (Spatial distribution)

| Seq Id No. | Tissue distribution | Seq Id No. | Tissue distribution |
|---|---|---|---|
| 11974 | C:1 | 12021 | C:1 |
| 11975 | C:1 | 12022 | C:1 |
| 11976 | C:1 | 12023 | C:1 |
| 11977 | H:2 | 12024 | C:1 |
| 11978 | C:1 | 12025 | C:1 |
| 11979 | C:1 | 12026 | C:1 |
| 11980 | C:1 | 12027 | C:1 |
| 11981 | C:1 | 12028 | C:1 |
| 11982 | C:1 | 12029 | C:1 |
| 11983 | C:1 | 12030 | C:1 |
| 11984 | C:1 | 12031 | C:1 |
| 11985 | C:1 | 12032 | C:1 |
| 11986 | C:1 | 12033 | C:1 |
| 11987 | C:1 | 12034 | C:1 |
| 11988 | C:1 | 12035 | C:1 |
| 11989 | C:1 | 12036 | C:1 |
| 12037 | C:1 | 12084 | C:1 |
| 12038 | C:1 | 12085 | C:1 |
| 12039 | B:1 | 12086 | C:1 |
| 12040 | C:1 | 12087 | C:1 |
| 12041 | C:1 | 12088 | C:1 |
| 12042 | C:1 | 12089 | C:1 |
| 12043 | C:1 | 12090 | C:1 |
| 12044 | C:1 | 12091 | B:2 |
| 12045 | C:1 | 12092 | C:1 |
| 12046 | C:1 | 12093 | C:1 |
| 12047 | C:1 | 12094 | C:1 |
| 12048 | C:1 | 12095 | C:1 |
| 12049 | C:1 | 12096 | C:1 |
| 12050 | B:1 | 12097 | C:1 |
| 12051 | C:1 | 12098 | C:1 |
| 12052 | C:1 | 12099 | C:1 |
| 12053 | C:1 | 12100 | C:1 |
| 12054 | C:1 | 12101 | C:1 |
| 12055 | C:1 | 1202 | C:1 |
| 12056 | C:1 | 12103 | C:1 |
| 12057 | C:1 | 12104 | C:1 |
| 12058 | C:1 | 12105 | C:1 |
| 12059 | C:1 | 12106 | C:1 |
| 12060 | C:1 | 12107 | C:1 |
| 12061 | B:1 | 12108 | C:1 |
| 12062 | C:1 | 12109 | C:1 |
| 12063 | C:1 | 12110 | C:1 |
| 12064 | C:1 | 12111 | C:1 |
| 12065 | C:1 | 12112 | F:2 |
| 12066 | C:1 | 12113 | C:1 |
| 12067 | C:1 | 12114 | C:1 |
| 12068 | C:1 | 12115 | C:1 |
| 12069 | C:1 | 12116 | C:1 |
| 12070 | C:1 | 12117 | C:1 |
| 12071 | H:2 | 12118 | C:1 |
| 12072 | H:2 | 12119 | C:1 |
| 12073 | C:1 | 12120 | C:1 |
| 12074 | C:1 | 12121 | C:1 |
| 12075 | C:1 | 12122 | C:1 |
| 12076 | C:1 | 12123 | B:2 |
| 12077 | C:1 | 12124 | C:1 |
| 12078 | C:1 | 12125 | C:1 |
| 12079 | C:1 | 12126 | C:1 |
| 12080 | C:1 | 12127 | C:1 |
| 12081 | C:1 | 12128 | C:1 |
| 12082 | K:2 | 12129 | C:1 |
| 12083 | C:1 | 12130 | C:1 |
| 12131 | C:1 | 12178 | C:1 |
| 12132 | C:1 | 12179 | C:1 |
| 12133 | C:1 | 12180 | C:1 |
| 12134 | H:2 | 12181 | C:1 |
| 12135 | C:1 | 12182 | C:1 |
| 12136 | C:1 | 12183 | C:1 |
| 12137 | C:1 | 12184 | C:1 |
| 12138 | C:1 | 12185 | C:1 |
| 12139 | C:1 | 12186 | C:1 |
| 12140 | C:1 | 12187 | C:1 |
| 12141 | C:1 | 12188 | C:1 |
| 12142 | C:1 | 12189 | C:1 |
| 12143 | C:1 | 12190 | C:1 |
| 12144 | C:1 | 12191 | C:1 |
| 12145 | F:2 | 12192 | C:1 |
| 12146 | C:1 | 12193 | C:1 |
| 12147 | C:1 | 12194 | C:1 |
| 12148 | C:1 | 12195 | C:1 |
| 12149 | C:1 | 12196 | C:1 |
| 12150 | C:1 | 12197 | C:4 |
| 12151 | C:1 | 12198 | C:1 |
| 12152 | C:1 | 12199 | C:1 |
| 12153 | C:1 | 12200 | C:1 |
| 12154 | C:1 | 12201 | C:1 |
| 12155 | C:1 | 12202 | C:1 |
| 12156 | C:1 | 12203 | C:1 |
| 12157 | C:1 | 12204 | C:1 |
| 12158 | C:1 | 12205 | C:1 |
| 12159 | C:1 | 12206 | C:1 |
| 12160 | C:1 | 12207 | C:1 |
| 12161 | C:1 | 12208 | B:4 C:1 |
| 12162 | C:1 | 12209 | C:1 |
| 12163 | C:1 | 12210 | C:1 |
| 12164 | C:1 | 12211 | C:1 |
| 12165 | C:1 | 12212 | C:1 |
| 12166 | K:1 | 12213 | C:1 |
| 12167 | C:1 | 12214 | C:1 |
| 12168 | C:1 | 12215 | C:1 |
| 12169 | C:1 | 12216 | C:1 |
| 12170 | C:1 | 12217 | C:1 |
| 12171 | C:1 | 12218 | B:2 |
| 12172 | C:1 | 12219 | C:1 |
| 12173 | C:1 | 12220 | C:1 |
| 12174 | C:1 | 12221 | C:1 |
| 12175 | C:1 | 12222 | C:1 |
| 12176 | C:1 | 12223 | C:1 |
| 12177 | A:5 | 12224 | C:1 |
| 12225 | C:1 | 12272 | C:1 |
| 12226 | C:1 | 12273 | C:1 |
| 12227 | C:1 | 12274 | C:1 |
| 12228 | C:1 | 12275 | C:1 |
| 12229 | C:1 | 12276 | C:1 |
| 12230 | C:1 | 12277 | C:1 |
| 12231 | C:1 | 12278 | A:1 B:1 |
| 12232 | C:1 | 12279 | H:1 |
| 12233 | C:1 | 12280 | C:1 |
| 12234 | C:1 | 12281 | C:1 |
| 12235 | C:1 | 12282 | C:1 |
| 12236 | C:1 | 12283 | C:1 |
| 12237 | C:1 | 12284 | C:1 |
| 12238 | C:1 | 12285 | C:1 |
| 12239 | A:4 | 12286 | C:1 |
| 12240 | C:1 | 12287 | C:1 |
| 12241 | C:1 | 12288 | C:1 |
| 12242 | C:1 | 12289 | C:1 |
| 12243 | C:1 | 12290 | C:1 |
| 12244 | C:1 | 12291 | C:1 |
| 12245 | C:1 | 12292 | C:1 |
| 12246 | C:1 | 12293 | C:1 |
| 12247 | C:1 | 12294 | C:1 |
| 12248 | C:1 | 12295 | C:1 |
| 12249 | C:1 | 12296 | C:1 |
| 12250 | C:1 | 12297 | C:1 |
| 12251 | C:1 | 12298 | C:1 |
| 12252 | C:1 | 12299 | C:1 |
| 12253 | C:1 | 12300 | C:1 |
| 12254 | C:1 | 12301 | C:1 |
| 12255 | C:1 | 12302 | C:1 |
| 12256 | C:1 | 12303 | C:1 |
| 12257 | C:1 | 12304 | C:1 |
| 12258 | C:1 | 12305 | C:1 |
| 12259 | C:1 | 12306 | D:1 |
| 12260 | C:1 | 12307 | C:1 |

TABLE V-continued

(Spatial distribution)

| Seq Id No. | Tissue distribution | Seq Id No. | Tissue distribution |
|---|---|---|---|
| 12261 | C:1 | 12308 | C:1 |
| 12262 | C:1 | 12309 | C:1 |
| 12263 | C:1 | 12310 | C:1 |
| 12264 | C:1 | 12311 | C:1 |
| 12265 | C:1 | 12312 | C:1 |
| 12266 | C:1 | 12313 | C:1 |
| 12267 | C:1 | 12314 | C:1 |
| 12268 | C:1 | 12315 | C:1 |
| 12269 | C:1 | 12316 | C:1 |
| 12270 | C:1 | 12317 | I:2 |
| 12271 | C:1 | 12318 | C:1 |
| 12319 | C:1 | 12366 | C:1 |
| 12320 | C:1 | 12367 | C:1 |
| 12321 | C:1 | 12368 | C:1 |
| 12322 | C:1 | 12369 | C:1 |
| 12323 | C:1 | 12370 | C:1 |
| 12324 | C:1 | 12371 | C:1 |
| 12325 | C:1 | 12372 | C:1 |
| 12326 | C:1 | 12373 | C:1 |
| 12327 | C:98 | 12374 | C:1 |
| 12328 | C:1 | 12375 | C:1 |
| 12329 | C:1 | 12376 | C:1 |
| 12330 | C:1 | 12377 | C:1 |
| 12331 | C:1 | 12378 | C:1 |
| 12332 | C:1 | 12379 | C:1 |
| 12333 | C:1 | 12380 | C:1 |
| 12334 | C:1 | 12381 | C:1 |
| 12335 | C:1 | 12382 | C:1 |
| 12336 | C:1 | 12383 | C:1 |
| 12337 | C:1 | 12384 | C:1 |
| 12338 | C:1 | 12385 | C:1 |
| 12339 | C:1 | 12386 | C:1 |
| 12340 | C:1 | 12387 | C:1 |
| 12341 | C:1 | 12388 | C:1 |
| 12342 | C:1 | 12389 | C:1 |
| 12343 | C:1 | 12390 | C:1 |
| 12344 | C:1 | 12391 | C:1 |
| 12345 | C:1 | 12392 | C:1 |
| 12346 | C:1 | 12393 | C:1 |
| 12347 | C:1 | 12394 | C:1 |
| 12348 | C:1 | 12395 | C:1 |
| 12349 | C:1 | 12396 | C:1 |
| 12350 | C:1 | 12397 | C:1 |
| 12351 | C:1 | 12398 | C:1 |
| 12352 | C:1 | 12399 | C:1 |
| 12353 | C:1 | 12400 | C:1 |
| 12354 | C:1 | 12401 | C:1 |
| 12355 | C:1 | 12402 | C:1 |
| 12356 | K:1 | 12403 | C:1 |
| 12357 | C:1 | 12404 | C:1 |
| 12358 | C:1 | 12405 | C:1 |
| 12359 | C:1 | 12406 | C:1 |
| 12360 | C:1 | 12407 | C:1 |
| 12361 | C:1 | 12408 | C:1 |
| 12362 | C:1 | 12409 | C:1 |
| 12363 | C:1 | 12410 | C:1 |
| 12364 | C:1 | 12411 | C:1 |
| 12365 | C:1 | 12412 | C:1 |
| 12413 | C:1 | 12460 | K:1 |
| 12414 | C:1 | 12461 | K:1 |
| 12415 | C:1 | 12462 | K:1 |
| 12416 | C:1 | 12463 | K:1 |
| 12417 | C:1 | 12464 | K:1 |
| 12418 | C:1 | 12465 | H:1 |
| 12419 | C:1 | 12466 | K:1 |
| 12420 | C:1 | 12467 | K:1 |
| 12421 | C:1 | 12468 | K:1 |
| 12422 | C:1 | 12469 | K:1 |
| 12423 | C:1 | 12470 | K:1 |
| 12424 | C:1 | 12471 | K:1 |
| 12425 | C:1 | 12472 | K:1 |
| 12426 | C:1 | 12473 | K:1 |
| 12427 | C:1 | 12474 | K:1 |
| 12428 | C:1 | 12475 | K:1 |
| 12429 | C:1 | 12476 | K:4 |
| 12430 | C:1 | 12477 | K:1 |
| 12431 | C:1 | 12478 | K:1 |
| 12432 | C:1 | 12479 | K:1 |
| 12433 | C:1 | 12480 | K:1 |
| 12434 | C:1 | 12481 | K:1 |
| 12435 | C:1 | 12482 | K:1 |
| 12436 | C:1 | 12483 | K:1 |
| 12437 | A:8 | 12484 | K:1 |
| 12438 | C:1 | 12485 | B:7 C:1 |
| 12439 | C:1 | 12486 | K:1 |
| 12440 | C:1 | 12487 | K:1 |
| 12441 | C:1 | 12488 | K:1 |
| 12442 | C:1 | 12489 | K:1 |
| 12443 | C:1 | 12490 | K:1 |
| 12444 | C:1 | 12491 | K:1 |
| 12445 | C:1 | 12492 | K:1 |
| 12446 | C:1 | 12493 | K:1 |
| 12447 | C:1 | 12494 | K:1 |
| 12448 | C:1 | 12495 | K:1 |
| 12449 | C:1 | 12496 | K:1 |
| 12450 | C:1 | 12497 | K:1 |
| 12451 | C:1 | 12498 | K:1 |
| 12452 | C:1 | 12499 | K:1 |
| 12453 | C:1 | 12500 | K:1 |
| 12454 | C:1 | 12501 | K:1 |
| 12455 | C:1 | 12502 | K:1 |
| 12456 | K:1 | 12503 | K:1 |
| 12457 | K:1 | 12504 | K:J |
| 12458 | K:1 | 12505 | K:1 |
| 12459 | K:1 | 12506 | K:1 |
| 12507 | K:1 | 12554 | K:1 |
| 12508 | K:1 | 12555 | K:1 |
| 12509 | F:1 K:4 | 12556 | K:1 |
| 12510 | K:1 | 12557 | K:1 |
| 12511 | K:1 | 12558 | K:1 |
| 12512 | K:1 | 12559 | K:1 |
| 12513 | K:1 | 12560 | K:1 |
| 12514 | K:1 | 12561 | K:1 |
| 12515 | K:1 | 12562 | K:1 |
| 12516 | K:1 | 12563 | K:1 |
| 12517 | K:1 | 12564 | K:1 |
| 12518 | K:1 | 12565 | K:1 |
| 12519 | K:1 | 12566 | K:1 |
| 12520 | K:1 | 12567 | K:1 |
| 12521 | K:1 | 12568 | K:1 |
| 12522 | K:1 | 12569 | K:1 |
| 12523 | K:1 | 12570 | K:1 |
| 12524 | K:1 | 12571 | H:1 |
| 12525 | K:1 | 12572 | K:1 |
| 12526 | K:1 | 12573 | K:1 |
| 12527 | K:1 | 12574 | K:1 |
| 12528 | K:1 | 12575 | K:1 |
| 12529 | K:1 | 12576 | K:1 |
| 12530 | K:1 | 12577 | K:1 |
| 12531 | K:1 | 12578 | K:1 |
| 12532 | F:1 | 12579 | B:1 |
| 12533 | K:1 | 12580 | H:2 |
| 12534 | K:1 | 12581 | B:1 |
| 12535 | K:1 | 12582 | B:1 |
| 12536 | K:1 | 12583 | B:1 |
| 12537 | K:1 | 12584 | B:1 |
| 12538 | K:1 | 12585 | B:1 |
| 12539 | K:1 | 12586 | B:1 |
| 12540 | K:1 | 12587 | B:1 |
| 12541 | K:1 | 12588 | B:1 |
| 12542 | K:1 | 12589 | B:1 |
| 12543 | K:1 | 12590 | B:2 |
| 12544 | K:1 | 12591 | B:1 |
| 12545 | K:1 | 12592 | B:1 |
| 12546 | K:1 | 12593 | B:1 |
| 12547 | K:1 | 12594 | B:1 |

TABLE V-continued

(Spatial distribution)

| Seq Id No. | Tissue distribution | Seq Id No. | Tissue distribution |
|---|---|---|---|
| 12548 | K:1 | 12595 | B:1 |
| 12549 | K:1 | 12596 | B:1 |
| 12550 | K:1 | 12597 | B:1 |
| 12551 | K:1 | 12598 | B:1 |
| 12552 | K:1 | 12599 | B:1 |
| 12553 | K:1 | 12600 | B:1 |
| 12601 | B:1 | 12648 | B:1 |
| 12602 | B:1 | 12649 | B:1 |
| 12603 | B:1 | 12650 | B:1 |
| 12604 | B:1 | 12651 | B:1 |
| 12605 | H:2 | 12652 | B:1 |
| 12606 | B:1 | 12653 | B:1 |
| 12607 | B:1 | 12654 | B:1 |
| 12608 | B:1 | 12655 | B:1 |
| 12609 | B:1 | 12656 | B:1 |
| 12610 | B:1 | 12657 | B:1 |
| 12611 | B:1 | 12658 | B:1 |
| 12612 | B:1 | 12659 | B:1 |
| 12613 | B:1 | 12660 | B:1 |
| 12614 | B:1 | 12661 | B:1 |
| 12615 | B:1 | 12662 | B:1 |
| 12616 | B:1 | 12663 | B:1 |
| 12617 | B:1 | 12664 | B:1 |
| 12618 | F:2 K:5 | 12665 | B:1 |
| 12619 | B:1 | 12666 | B:1 |
| 12620 | B:1 | 12667 | B:1 |
| 12621 | B:1 | 12668 | B:1 |
| 12622 | B:1 | 12669 | B:1 |
| 12623 | B:1 | 12670 | B:1 H:2 |
| 12624 | B:1 | 12671 | B:1 |
| 12625 | D:1 I:1 | 12672 | B:1 |
| 12626 | B:1 | 12673 | B:1 |
| 12627 | B:1 | 12674 | B:1 |
| 12628 | B:1 | 12675 | B:1 |
| 12629 | B:1 | 12676 | B:1 |
| 12630 | B:1 | 12677 | B:1 |
| 12631 | B:1 | 12678 | I:2 |
| 12632 | B:1 | 12679 | B:1 |
| 12633 | B:1 | 12680 | B:1 |
| 12634 | B:1 | 12681 | B:1 |
| 12635 | K:2 | 12682 | B:1 |
| 12636 | K:2 | 12683 | B:1 |
| 12637 | B:1 | 12684 | B:1 |
| 12638 | B:1 | 12685 | B:1 |
| 12639 | B:1 | 12686 | B:1 |
| 12640 | B:1 | 12687 | A:1 B:5 F:1 H:1 |
| 12641 | B:1 | 12688 | B:1 |
| 12642 | B:1 | 12689 | B:1 |
| 12643 | B:1 | 12690 | B:1 |
| 12644 | B:1 | 12691 | B:1 |
| 12645 | B:1 | 12692 | B:1 |
| 12646 | B:1 | 12693 | B:1 |
| 12647 | B:1 | 12694 | B:1 |
| 12695 | B:1 | 12742 | B:1 |
| 12696 | B:1 | 12743 | B:1 |
| 12697 | B:1 | 12744 | B:1 |
| 12698 | B:1 | 12745 | B:1 |
| 12699 | B:1 | 12746 | B:1 |
| 12700 | B:1 | 12747 | B:1 |
| 12701 | B:1 | 12748 | B:1 |
| 12702 | B:1 | 12749 | B:1 |
| 12703 | B:1 | 12750 | B:1 |
| 12704 | B:1 | 12751 | B:1 |
| 12705 | B:1 | 12752 | B:1 |
| 12706 | B:1 | 12753 | B:1 |
| 12707 | B:1 | 12754 | B:1 |
| 12708 | B:1 | 12755 | B:1 |
| 12709 | B:1 | 12756 | B:1 |
| 12710 | B:1 | 12757 | B:1 |
| 12711 | B:1 | 12758 | B:1 |
| 12712 | B:1 | 12759 | D:1 |
| 12713 | B:1 | 12760 | B:1 |
| 12714 | B:1 | 12761 | B:1 |
| 12715 | B:1 | 12762 | B:1 |
| 12716 | B:1 | 12763 | B:1 |
| 12717 | B:1 | 12764 | B:1 |
| 12718 | B:1 | 12765 | B:1 |
| 12719 | C:2 | 12766 | B:1 |
| 12720 | B:1 | 12767 | B:1 |
| 12721 | B:1 | 12768 | B:1 |
| 12722 | B:1 | 12769 | B:1 |
| 12723 | B:1 | 12770 | B:1 |
| 12724 | B:1 | 12771 | B:1 |
| 12725 | B:1 | 12772 | B:1 |
| 12726 | B:1 | 12773 | B:1 |
| 12727 | B:1 | 12774 | B:1 |
| 12728 | B:1 | 12775 | B:1 |
| 12729 | B:1 | 12776 | B:1 |
| 12730 | B:1 | 12777 | B:1 |
| 12731 | B:1 | 12778 | B:1 |
| 12732 | B:1 | 12779 | B:1 |
| 12733 | B:1 | 12780 | B:1 |
| 12734 | B:1 | 12781 | B:1 |
| 12735 | B:1 | 12782 | B:1 |
| 12736 | B:1 | 12783 | B:1 |
| 12737 | B:1 | 12784 | B:1 |
| 12738 | B:1 | 12785 | B:1 |
| 12739 | B:1 | 12786 | B:1 |
| 12740 | B:1 | 12787 | B:1 |
| 12741 | B:1 | 12788 | B:1 |
| 12789 | B:1 | 12836 | B:1 |
| 12790 | B:1 | 12837 | B:1 |
| 12791 | B:1 | 12838 | B:1 |
| 12792 | B:1 | 12839 | B:1 |
| 12793 | B:1 | 12840 | B:1 |
| 12794 | B:1 | 12841 | B:1 |
| 12795 | H:1 | 12842 | B:1 |
| 12796 | B:1 | 12843 | B:1 |
| 12797 | B:1 | 12844 | A:3 |
| 12798 | B:1 | 12845 | B:1 |
| 12799 | B:1 | 12846 | B:1 |
| 12800 | B:1 | 12847 | B:1 |
| 12801 | B:1 | 12848 | B:1 |
| 12802 | B:1 | 12849 | B:1 |
| 12803 | B:1 | 12850 | B:1 |
| 12804 | B:1 | 12851 | B:1 |
| 12805 | B:1 | 12852 | B:1 |
| 12806 | B:1 | 12853 | B:1 |
| 12807 | B:1 | 12854 | F:1 K:3 |
| 12808 | B:1 | 12855 | B:1 |
| 12809 | H:1 | 12856 | B:1 |
| 12810 | B:1 | 12857 | B:1 |
| 12811 | B:1 | 12858 | B:1 |
| 12812 | B:1 | 12859 | B:1 |
| 12813 | B:1 | 12860 | B:1 |
| 12814 | B:1 | 12861 | B:1 |
| 12815 | B:1 | 12862 | K:1 |
| 12816 | B:1 | 12863 | B:1 |
| 12817 | B:1 | 12864 | B:1 |
| 12818 | B:1 | 12865 | B:1 |
| 12819 | B:1 | 12866 | B:1 |
| 12820 | B:1 | 12867 | B:1 |
| 12821 | B:1 | 12868 | B:1 |
| 12822 | B:1 | 12869 | B:1 |
| 12823 | B:1 | 12870 | B:1 |
| 12824 | B:1 | 12871 | B:1 |
| 12825 | B:1 | 12872 | B:1 |
| 12826 | B:1 | 12873 | B:1 |
| 12827 | B:1 | 12874 | B:1 |
| 12828 | B:1 | 12875 | B:1 |
| 12829 | B:1 | 12876 | B:1 |
| 12830 | B:1 | 12877 | B:1 |
| 12831 | B:1 | 12878 | B:1 |
| 12832 | B:1 | 12879 | A:8 B:3 C:2 |
| 12833 | B:1 | 12880 | B:1 |
| 12834 | B:1 | 12881 | B:1 |

TABLE V-continued (Spatial distribution)

| Seq Id No. | Tissue distribution | Seq Id No. | Tissue distribution |
|---|---|---|---|
| 12835 | K:2 | 12882 | B:1 |
| 12883 | B:1 | 12930 | B:1 |
| 12884 | B:1 | 12931 | B:1 |
| 12885 | B:1 | 12932 | B:1 |
| 12886 | B:1 | 12933 | B:1 |
| 12887 | B:1 | 12934 | B:1 |
| 12888 | B:1 | 12935 | B:1 |
| 12889 | B:1 | 12936 | B:1 |
| 12890 | B:1 | 12937 | B:1 |
| 12891 | B:1 | 12938 | B:1 |
| 12892 | B:1 | 12939 | B:1 |
| 12893 | B:1 | 12940 | B:1 |
| 12894 | B:1 | 12941 | B:1 |
| 12895 | B:1 | 12942 | B:1 |
| 12896 | B:1 | 12943 | B:1 |
| 12897 | B:1 | 12944 | B:1 |
| 12898 | B:1 | 12945 | A:1 B:3 I:1 K:1 |
| 12899 | B:1 | 12946 | B:1 |
| 12900 | H:3 | 12947 | B:1 |
| 12901 | B:1 | 12948 | B:1 |
| 12902 | B:1 | 12949 | B:1 |
| 12903 | B:1 | 12950 | B:1 |
| 12904 | B:1 | 12951 | B:1 |
| 12905 | B:1 | 12952 | B:1 |
| 12906 | B:1 | 12953 | B:1 |
| 12907 | B:1 | 12954 | B:1 |
| 12908 | B:1 | 12955 | B:1 |
| 12909 | B:1 | 12956 | B:1 |
| 12910 | B:1 | 12957 | B:1 |
| 12911 | B:1 | 12958 | B:1 |
| 12912 | B:1 | 12959 | B:1 |
| 12913 | B:1 | 12960 | B:1 |
| 12914 | B:1 | 12961 | B:1 |
| 12915 | B:1 | 12962 | B:1 |
| 12916 | B:1 | 12963 | B:1 |
| 12917 | B:1 | 12964 | B:1 |
| 12918 | B:1 | 12965 | B:1 |
| 12919 | B:1 | 12966 | B:1 |
| 12920 | B:1 | 12967 | B:1 |
| 12921 | B:1 | 12968 | B:1 |
| 12922 | B:1 | 12969 | B:1 |
| 12923 | B:1 | 12970 | B:1 |
| 12924 | B:1 | 12971 | B:1 |
| 12925 | B:1 | 12972 | B:1 |
| 12926 | B:1 | 12973 | B:1 |
| 12927 | B:1 | 12974 | B:1 |
| 12928 | B:1 | 12975 | B:1 |
| 12929 | B:1 | 12976 | B:1 |
| 12977 | F:1 | 13024 | B:1 |
| 12978 | B:1 | 13025 | B:1 |
| 12979 | B:1 | 13026 | B:1 |
| 12980 | B:1 | 13027 | B:1 |
| 12981 | B:1 | 13028 | B:1 |
| 12982 | B:1 | 13029 | B:1 |
| 12983 | B:1 | 13030 | B:1 |
| 12984 | B:1 | 13031 | B:1 |
| 12985 | B:1 | 13032 | B:1 |
| 12986 | B:1 | 13033 | B:1 |
| 12987 | B:1 | 13034 | B:1 |
| 12988 | B:1 | 13035 | B:1 |
| 12989 | B:1 | 13036 | B:1 |
| 12990 | B:1 | 13037 | B:1 |
| 12991 | B:1 | 13038 | B:1 |
| 12992 | B:1 | 13039 | B:1 |
| 12993 | B:1 | 13040 | B:1 |
| 12994 | B:1 | 13041 | B:1 |
| 12995 | K:1 | 13042 | B:1 |
| 12996 | B:1 | 13043 | B:1 |
| 12997 | B:1 | 13044 | B:1 |
| 12998 | B:1 | 13045 | B:1 |
| 12999 | B:1 | 13046 | B:1 |
| 13000 | B:1 | 13047 | B:1 |
| 13001 | B:1 | 13048 | B:1 |
| 13002 | B:1 | 13049 | B:1 |
| 13003 | B:1 | 13050 | B:1 |
| 13004 | B:1 | 13051 | B:1 |
| 13005 | B:1 | 13052 | B:1 |
| 13006 | B:1 | 13053 | B:1 |
| 13007 | B:1 | 13054 | B:1 |
| 13008 | K:2 | 13055 | B:1 |
| 13009 | B:1 | 13056 | F:1 K:1 |
| 13010 | B:1 | 13057 | B:1 |
| 13011 | B:1 | 13058 | B:1 |
| 13012 | B:1 | 13059 | B:1 |
| 13013 | B:1 | 13060 | B:1 |
| 13014 | B:1 | 13061 | B:1 |
| 13015 | B:1 | 13062 | B:1 |
| 13016 | B:1 | 13063 | B:1 |
| 13017 | B:1 | 13064 | B:1 |
| 13018 | B:1 | 13065 | B:1 |
| 13019 | B:1 | 13066 | B:1 |
| 13020 | B:1 | 13067 | B:1 |
| 13021 | B:1 | 13068 | B:1 |
| 13022 | B:1 | 13069 | B:1 |
| 13023 | B:1 | 13070 | B:1 |
| 13071 | B:1 | 13118 | B:1 |
| 13072 | B:1 | 13119 | B:1 |
| 13073 | B:1 | 13120 | B:1 |
| 13074 | B:1 | 13121 | B:1 |
| 13075 | B:1 | 13122 | B:1 |
| 13076 | B:1 | 13123 | B:1 |
| 13077 | B:1 | 13124 | B:1 |
| 13078 | K:3 | 13125 | B:1 |
| 13079 | B:1 | 13126 | B:1 |
| 13080 | B:1 | 13127 | B:1 |
| 13081 | B:1 | 13128 | B:1 |
| 13082 | B:1 | 13129 | B:1 |
| 13083 | B:1 | 13130 | B:1 |
| 13084 | B:1 | 13131 | B:1 |
| 13085 | B:2 | 13132 | B:1 |
| 13086 | B:1 | 13133 | A:6 |
| 13087 | B:1 | 13134 | B:1 |
| 13088 | B:1 | 13135 | B:1 |
| 13089 | B:1 | 13136 | B:1 |
| 13090 | B:2 | 13137 | B:1 |
| 13091 | B:1 | 13138 | B:1 |
| 13092 | B:1 | 13139 | B:1 |
| 13093 | B:1 | 13140 | B:1 |
| 13094 | B:1 | 13141 | B:1 |
| 13095 | B:1 | 13142 | H:2 |
| 13096 | B:1 | 13143 | B:1 |
| 13097 | B:1 | 13144 | B:1 |
| 13098 | B:1 | 13145 | B:1 |
| 13099 | B:1 | 13146 | B:1 |
| 13100 | B:1 | 13147 | B:1 |
| 13101 | B:1 | 13148 | B:1 |
| 13102 | B:1 | 13149 | B:1 |
| 13103 | B:1 | 13150 | K:3 |
| 13104 | B:1 | 13151 | B:1 |
| 13105 | B:1 | 13152 | B:1 |
| 13106 | B:1 | 13153 | B:1 |
| 13107 | B:1 | 13154 | B;1 |
| 13108 | B:1 | 13155 | B:1 |
| 13109 | B:1 | 13156 | B:1 |
| 13110 | K:2 | 13157 | B:1 |
| 13111 | B:1 | 13158 | B:1 |
| 13112 | B:1 | 13159 | B:1 |
| 13113 | B:1 | 13160 | B:1 |
| 13114 | B:1 | 13161 | B:1 |
| 13115 | B:1 | 13162 | B:1 |
| 13116 | B:1 | 13163 | B:1 |
| 13317 | A:2 | 13164 | B:1 |
| 13165 | B:1 | 13212 | C:1 |
| 13166 | B:1 | 13213 | C:1 |
| 13167 | B:1 | 13214 | C:1 |
| 13168 | C:1 | 13215 | C:1 |

TABLE V-continued (Spatial distribution)

| Seq Id No. | Tissue distribution | Seq Id No. | Tissue distribution |
|---|---|---|---|
| 13169 | C:1 | 13216 | C:1 |
| 13170 | C:1 | 13217 | C:1 |
| 13171 | C:1 | 13218 | C:1 |
| 13172 | K:2 | 13219 | C:1 |
| 13173 | C:1 | 13220 | C:1 |
| 13174 | C:1 | 13221 | C:1 |
| 13175 | C:1 | 13222 | C:1 |
| 13176 | C:1 | 13223 | K:1 |
| 13177 | C:1 | 13224 | C:1 |
| 13178 | C:1 | 13225 | C:1 |
| 13179 | C:1 | 13226 | C:1 |
| 13180 | A:1 F:1 | 13227 | C:1 |
| 13181 | C:1 | 13228 | C:1 |
| 13182 | C:1 | 13229 | C:1 |
| 13183 | C:1 | 13230 | C:1 |
| 13184 | C:1 | 13231 | C:1 |
| 13185 | C:1 | 13232 | C:1 |
| 13186 | C:1 | 13233 | A:2 |
| 13187 | C:1 | 13234 | C:1 |
| 13188 | H:2 | 13235 | C:1 |
| 13189 | C:1 | 13236 | C:1 |
| 13190 | C:1 | 13237 | C:1 |
| 13191 | C:1 | 13238 | C:1 |
| 13192 | C:1 | 13239 | C:1 |
| 13193 | H:2 | 13240 | C:2 |
| 13194 | C:1 | 13241 | C:1 |
| 13195 | C:1 | 13242 | C:1 |
| 13196 | C:1 | 13243 | C:1 |
| 13197 | C:1 | 13244 | C:1 |
| 13198 | B:3 | 13245 | C:1 |
| 13199 | C:1 | 13246 | C:1 |
| 13200 | C:1 | 13247 | C:1 |
| 13201 | C:1 | 13248 | C:1 |
| 13202 | C:1 | 13249 | C:1 |
| 13203 | C:1 | 13250 | C:1 |
| 13204 | C:1 | 13251 | C:1 |
| 13205 | C:1 | 13252 | C:1 |
| 13206 | C:1 | 13253 | C:1 |
| 13207 | F:1 K:1 | 13254 | C:1 |
| 13208 | C:1 | 13255 | C:1 |
| 13209 | C:1 | 13256 | C:1 |
| 13210 | C:1 | 13257 | C:1 |
| 13211 | C:1 | 13258 | C:1 |
| 13259 | C:1 | 13306 | C:1 |
| 13260 | C:1 | 13307 | C:1 |
| 13261 | C:1 | 13308 | C:1 |
| 13262 | C:1 | 13309 | C:1 |
| 13263 | C:1 | 13310 | C:1 |
| 13264 | C:1 | 13311 | C:1 |
| 13265 | C:1 | 13312 | C:1 |
| 13266 | C:1 | 13313 | C:1 |
| 13267 | A:9 H:1 | 13314 | C:1 |
| 13268 | C:1 | 13315 | C:1 |
| 13269 | C:1 | 13316 | C:1 |
| 13270 | C:1 | 13317 | C:1 |
| 13271 | C:1 | 13318 | C:1 |
| 13272 | C:1 | 13319 | C:1 |
| 13273 | C:1 | 13320 | C:1 |
| 13274 | C:1 | 13321 | C:1 |
| 13275 | C:1 | 13322 | C:1 |
| 13276 | C:1 | 13323 | C:1 |
| 13277 | K:2 | 13324 | C:1 |
| 13278 | C:1 | 13325 | C:1 |
| 13279 | C:1 | 13326 | C:1 |
| 13280 | C:1 | 13327 | C:1 |
| 13281 | C:1 | 13328 | C:1 |
| 13282 | C:1 | 13329 | C:1 |
| 13283 | C:1 | 13330 | K:2 |
| 13284 | C:1 | 13331 | C:1 |
| 13285 | C:1 | 13332 | C:1 |
| 13286 | B:2 | 13333 | C:1 |
| 13287 | C:1 | 13334 | C:1 |
| 13288 | C:1 | 13335 | C:1 |
| 13289 | C:1 | 13336 | K:2 |
| 13290 | C:1 | 13337 | C:1 |
| 13291 | C:1 | 13338 | C:1 |
| 13292 | C:1 | 13339 | C:1 |
| 13293 | C:1 | 13340 | C:1 |
| 13294 | K:2 | 13341 | C:1 |
| 13295 | C:1 | 13342 | C:1 |
| 13296 | C:1 | 13343 | C:1 |
| 13297 | C:1 | 13344 | C:1 |
| 13298 | C:1 | 13345 | C:1 |
| 13299 | C:1 | 13346 | B:1 |
| 13300 | C:1 | 13347 | C:1 |
| 13301 | C:1 | 13348 | C:1 |
| 13302 | C:1 | 13349 | C:1 |
| 13303 | C:1 | 13350 | C:1 |
| 13304 | C:1 | 13351 | C:1 |
| 13305 | C:1 | 13352 | C:1 |
| 13353 | C:1 | 13400 | I:1 |
| 13354 | I:1 | 13401 | I:1 |
| 13355 | I:1 | 13402 | I:1 |
| 13356 | I:1 | 13403 | I:1 |
| 13357 | I:1 | 13404 | I:1 |
| 13358 | I:1 | 13405 | I:1 |
| 13359 | C:1 | 13406 | I:1 |
| 13360 | I:1 | 13407 | C:1 |
| 13361 | I:1 | 13408 | I:1 |
| 13362 | I:1 | 13409 | I:1 |
| 13363 | I:1 | 13410 | I:1 |
| 13364 | I:1 | 13411 | I:1 |
| 13365 | I:1 | 13412 | C:1 |
| 13366 | B:8 | 13413 | I:1 |
| 13367 | C:1 | 13414 | I:1 |
| 13368 | I:1 | 13415 | I:1 |
| 13369 | I:1 | 13416 | I:1 |
| 13370 | I:1 | 13417 | I:1 |
| 13371 | I:1 | 13418 | I:1 |
| 13372 | I:1 | 13419 | I:1 |
| 13373 | I:1 | 13420 | C:1 |
| 13374 | I:1 | 13421 | I:1 |
| 13375 | C:1 | 13422 | I:1 |
| 13376 | I:1 | 13423 | I:1 |
| 13377 | I:1 | 13424 | I:1 |
| 13378 | I:1 | 13425 | I:1 |
| 13379 | I:1 | 13426 | I:1 |
| 13380 | I:1 | 13427 | I:1 |
| 13381 | I:1 | 13428 | C:1 |
| 13382 | I:1 | 13429 | I:1 |
| 13383 | I:1 | 13430 | I:1 |
| 13384 | C:1 | 13431 | I:1 |
| 13385 | I:1 | 13432 | I:1 |
| 13386 | I:1 | 13433 | I:1 |
| 13387 | I:1 | 13434 | I:1 |
| 13388 | I:1 | 13435 | C:1 |
| 13389 | I:1 | 13436 | I:1 |
| 13390 | I:1 | 13437 | I:1 |
| 13391 | I:1 | 13438 | I:1 |
| 13392 | C:1 | 13439 | I:1 |
| 13393 | I:1 | 13440 | I:1 |
| 13394 | I:1 | 13441 | I:1 |
| 13395 | I:1 | 13442 | I:1 |
| 13396 | I:1 | 13443 | C:1 |
| 13397 | I:1 | 13444 | I:1 |
| 13398 | C:1 | 13445 | I:1 |
| 13399 | I:1 | 13446 | I:1 |
| 13447 | I:1 | 13494 | C:1 |
| 13448 | I:1 | 13495 | C:1 |
| 13449 | C:122 | 13496 | C:1 |
| 13450 | I:1 | 13497 | C:1 |
| 13451 | I:1 | 13498 | C:1 |
| 13452 | I:1 | 13499 | C:1 |
| 13453 | I:1 | 13500 | C:1 |
| 13454 | I:1 | 13501 | C:1 |
| 13455 | I:1 | 13502 | C:1 |

TABLE V-continued (Spatial distribution)

| Seq Id No. | Tissue distribution | Seq Id No. | Tissue distribution |
|---|---|---|---|
| 13456 | I:1 | 13503 | C:1 |
| 13457 | C:1 | 13504 | C:1 |
| 13458 | I:1 | 13505 | C:1 |
| 13459 | I:1 | 13506 | C:1 |
| 13460 | I:1 | 13507 | C:1 |
| 13461 | I:1 | 13508 | C:1 |
| 13462 | I:1 | 13509 | C:1 |
| 13463 | I:1 | 13510 | C:1 |
| 13464 | C:1 | 13511 | C:1 |
| 13465 | I:1 | 13512 | C:1 |
| 13466 | I:1 | 13513 | C:1 |
| 13467 | I:1 | 13514 | C:1 |
| 13468 | I:1 | 13515 | C:1 |
| 13469 | I:1 | 13516 | C:1 |
| 13470 | I:1 | 13517 | C:1 |
| 13471 | I:1 | 13518 | C:1 |
| 13472 | I:1 | 13519 | C:1 |
| 13473 | I:1 | 13520 | A:10 |
| 13474 | I:1 | 13521 | C:1 |
| 13475 | I:1 | 13522 | C:1 |
| 13476 | I:1 | 13523 | C:1 |
| 13477 | I:1 | 13524 | C:1 |
| 13478 | I:1 | 13525 | C:1 |
| 13479 | I:1 | 13526 | C:1 |
| 13480 | I:1 | 13527 | C:1 |
| 13481 | I:1 | 13528 | C:1 |
| 13482 | I:1 | 13529 | C:1 |
| 13483 | I:1 | 13530 | C:1 |
| 13484 | I:1 | 13531 | C:1 |
| 13485 | I:1 | 13532 | C:1 |
| 13486 | C:1 | 13533 | C:1 |
| 13487 | C:1 | 13534 | C:1 |
| 13488 | C:1 | 13535 | C:1 |
| 13489 | C:1 | 13536 | C:1 |
| 13490 | C:1 | 13537 | C:1 |
| 13491 | F:4 | 13538 | C:1 |
| 13492 | C:1 | 13539 | C:1 |
| 13493 | C:1 | 13540 | C:1 |
| 13541 | C:1 | 13588 | C:1 |
| 13542 | C:1 | 13589 | C:1 |
| 13543 | C:1 | 13590 | C:1 |
| 13544 | C:1 | 13591 | C:1 |
| 13545 | C:1 | 13592 | H:2 |
| 13546 | C:1 | 13593 | C:1 |
| 13547 | C:1 | 13594 | C:1 |
| 13548 | C:1 | 13595 | C:1 |
| 13549 | C:1 | 13596 | C:1 |
| 13550 | C:1 | 13597 | C:1 |
| 13551 | C:1 | 13598 | C:1 |
| 13552 | C:1 | 13599 | C:1 |
| 13553 | C:1 | 13600 | C:1 |
| 13554 | C:1 | 13601 | C:1 |
| 13555 | C:1 | 13602 | C:1 |
| 13556 | C:1 | 13603 | C:1 |
| 13557 | H:1 | 13604 | C:1 |
| 13558 | C:1 | 13605 | C:1 |
| 13559 | C:1 | 13606 | C:1 |
| 13560 | C:1 | 13607 | C:1 |
| 13561 | C:1 | 13608 | C:1 |
| 13562 | C:1 | 13609 | C:1 |
| 13563 | C:1 | 13610 | D:1 |
| 13564 | C:1 | 13611 | D:1 |
| 13565 | C:1 | 13612 | D:1 |
| 13566 | C:1 | 13613 | D:1 |
| 13567 | C:1 | 13614 | H:4 |
| 13568 | C:1 | 13615 | D:1 |
| 13569 | C:1 | 13616 | D:1 |
| 13570 | C:1 | 13617 | D:1 |
| 13571 | C:1 | 13618 | D:1 |
| 13572 | C:1 | 13619 | D:1 |
| 13573 | C:1 | 13620 | D:1 |
| 13574 | C:1 | 13621 | K:6 |
| 13575 | C:1 | 13622 | D:1 |
| 13576 | C:1 | 13623 | D:1 |
| 13577 | C:1 | 13624 | D:1 |
| 13578 | C:1 | 13625 | D:1 |
| 13579 | C:1 | 13626 | D:1 |
| 13580 | C:1 | 13627 | H:48 |
| 13581 | C:1 | 13628 | D:1 |
| 13582 | C:1 | 13629 | D:1 |
| 13583 | C:1 | 13630 | D:1 |
| 13584 | C:1 | 13631 | D:1 |
| 13585 | C:1 | 13632 | D:1 |
| 13586 | C:1 | 13633 | D:1 |
| 13587 | C:1 | 13634 | D:1 |
| 13635 | D:1 | 13682 | D:1 |
| 13636 | H:1 | 13683 | D:1 |
| 13637 | D:1 | 13684 | D:1 |
| 13638 | D:1 | 13685 | D:1 |
| 13639 | D:1 | 13686 | D:1 |
| 13640 | D:1 | 13687 | D:1 |
| 13641 | D:1 | 13688 | D:1 |
| 13642 | H:1 | 13689 | D:1 |
| 13643 | D:1 | 13690 | F:2 K:7 |
| 13644 | D:1 | 13691 | D:1 |
| 13645 | D:1 | 13692 | D:1 |
| 13646 | D:1 | 13693 | D:1 |
| 13647 | D:1 | 13694 | D:1 |
| 13648 | H:1 | 13695 | D:1 |
| 13649 | D:1 | 13696 | D:1 |
| 13650 | D:1 | 13697 | D:1 |
| 13651 | D:1 | 13698 | D:1 |
| 13652 | D:1 | 13699 | D:1 |
| 13653 | A:4 | 13700 | D:1 |
| 13654 | D:1 | 13701 | D:1 |
| 13655 | D:1 | 13702 | D:1 |
| 13656 | D:1 | 13703 | D:1 |
| 13657 | D:1 | 13704 | D:1 |
| 13658 | D:1 | 13705 | D:1 |
| 13659 | D:1 | 13706 | D:1 |
| 13660 | D:1 | 13707 | D:1 |
| 13661 | D:1 | 13708 | D:1 |
| 13662 | D:1 | 13709 | D:1 |
| 13663 | D:1 | 13710 | D:1 |
| 13664 | D:1 | 13711 | D:1 |
| 13665 | D:1 | 13712 | F:1 H:7 |
| 13666 | D:1 | 13713 | D:1 |
| 13667 | D:1 | 13714 | D:1 |
| 13668 | D:1 | 13715 | D:1 |
| 13669 | D:1 | 13716 | D:1 |
| 13670 | D:1 | 13717 | D:1 |
| 13671 | D:1 | 13718 | D:1 |
| 13672 | D:1 | 13719 | D:1 |
| 13673 | D:1 | 13720 | D:1 |
| 13674 | H:1 | 13721 | D:1 |
| 13675 | H:1 I:5 | 13722 | K:4 |
| 13676 | D:1 | 13723 | D:1 |
| 13677 | D:1 | 13724 | D:1 |
| 13678 | D:1 | 13725 | D:1 |
| 13679 | D:1 | 13726 | D:1 |
| 13680 | D:1 | 13727 | D:1 |
| 13681 | D:1 | 13728 | D:1 |
| 13729 | D:1 | 13776 | D:1 |
| 13730 | D:1 | 13777 | D:1 |
| 13731 | K:3 | 13778 | D:1 |
| 13732 | D:1 | 13779 | K:2 |
| 13733 | D:1 | 13780 | D:1 |
| 13734 | D:1 | 13781 | D:1 |
| 13735 | B:2 | 13782 | D:1 |
| 13736 | D:1 | 13783 | D:1 |
| 13737 | D:1 | 13784 | D:1 |
| 13738 | D:1 | 13785 | D:1 |
| 13739 | D:1 | 13786 | D:1 |
| 13740 | D:1 | 13787 | D:1 |
| 13741 | D:1 | 13788 | B:4 D:3 F:1 H:1 K:5 |
| 13742 | D:1 | 13789 | D:1 |

TABLE V-continued (Spatial distribution)

| Seq Id No. | Tissue distribution | Seq Id No. | Tissue distribution |
|---|---|---|---|
| 13743 | D:1 | 13790 | D:1 |
| 13744 | D:1 | 13791 | D:1 |
| 13745 | D:1 | 13792 | D:1 |
| 13746 | D:1 | 13793 | D:1 |
| 13747 | D:1 | 13794 | D:1 |
| 13748 | D:1 | 13795 | D:1 |
| 13749 | D:1 | 13796 | A:1 |
| 13750 | D:1 | 13797 | D:1 |
| 13751 | K:1 | 13798 | D:1 |
| 13752 | D:1 | 13799 | D:1 |
| 13753 | D:1 | 13800 | D:1 |
| 13754 | D:1 | 13801 | C:1 |
| 13755 | D:1 | 13802 | D:1 |
| 13756 | D:1 | 13803 | D:1 |
| 13757 | D:1 | 13804 | D:1 |
| 13758 | D:1 | 13805 | D:1 |
| 13759 | D:1 | 13806 | D:1 |
| 13760 | F:1 | 13807 | D:1 |
| 13761 | D:1 | 13808 | D:1 |
| 13762 | D:1 | 13809 | F:2 K:1 |
| 13763 | D:1 | 13810 | D:1 |
| 13764 | D:1 | 13811 | D:1 |
| 13765 | D:1 | 13812 | D:1 |
| 13766 | D:1 | 13813 | D:1 |
| 13767 | H:23 | 13814 | D:1 |
| 13768 | D:1 | 13815 | D:1 |
| 13769 | D:1 | 13816 | D:1 |
| 13770 | D:1 | 13817 | D:1 |
| 13771 | D:1 | 13818 | D:1 |
| 13772 | D:1 | 13819 | D:1 |
| 13773 | D:1 | 13820 | D:1 |
| 13774 | F:3 K:17 | 13821 | D:1 |
| 13775 | D:1 | 13822 | D:1 |
| 13823 | D:1 | 13870 | F:1 K:1 |
| 13824 | D:1 | 13871 | D:1 |
| 13825 | D:1 | 13872 | D:1 |
| 13826 | D:1 | 13873 | D:1 |
| 13827 | D:1 | 13874 | D:1 |
| 13828 | D:1 | 13875 | D:1 |
| 13829 | D:1 | 13876 | D:1 |
| 13830 | D:1 | 13877 | D:1 |
| 13831 | D:1 | 13878 | C:1 |
| 13832 | D:1 | 13879 | K:2 |
| 13833 | D:1 | 13880 | D:1 |
| 13834 | D:1 | 13881 | D:1 |
| 13835 | C:8 | 13882 | D:1 |
| 13836 | D:1 | 13883 | D:1 |
| 13837 | D:1 | 13884 | D:1 |
| 13838 | D:1 | 13885 | D:1 |
| 13839 | D:1 | 13886 | D:1 |
| 13840 | D:1 | 13887 | D:1 |
| 13841 | D:1 | 13888 | D:1 |
| 13842 | D:1 | 13889 | D:1 |
| 13843 | D:1 | 13890 | D:1 |
| 13844 | D:1 | 13891 | K:2 |
| 13845 | D:1 | 13892 | D:1 |
| 13846 | D:1 | 13893 | D:1 |
| 13847 | D:1 | 13894 | D:1 |
| 13848 | D:1 | 13895 | D:1 |
| 13849 | D:1 | 13896 | D:1 |
| 13850 | F:1 K:3 | 13897 | D:1 |
| 13851 | D:1 | 13898 | D:1 |
| 13852 | D:1 | 13899 | D:1 |
| 13853 | D:1 | 13900 | D:1 |
| 13854 | D:1 | 13901 | D:1 |
| 13855 | D:1 | 13902 | D:1 |
| 13856 | D:1 | 13903 | D:1 |
| 13857 | D:1 | 13904 | D:1 |
| 13858 | D:1 | 13905 | D:1 |
| 13859 | F:16 K:3 | 13906 | D:1 |
| 13860 | D:1 | 13907 | D:1 |
| 13861 | D:1 | 13908 | D:1 |
| 13862 | D:1 | 13909 | D:1 |
| 13863 | D:1 | 13910 | D:1 |
| 13864 | D:1 | 13911 | K:2 |
| 13865 | D:1 | 13912 | D:1 |
| 13866 | D:1 | 13913 | D:1 |
| 13867 | D:1 | 13914 | D:1 |
| 13868 | D:1 | 13915 | D:1 |
| 13869 | D:1 | 13916 | D:1 |
| 13917 | D:1 | 13964 | F:1 |
| 13918 | D:1 | 13965 | F:1 |
| 13919 | D:1 | 13966 | F:1 |
| 13920 | D:1 | 13967 | F:1 |
| 13921 | D:1 | 13968 | F:1 |
| 13922 | A:1 F:1 | 13969 | F:1 K:1 |
| 13923 | D:1 | 13970 | F:1 |
| 13924 | D:1 | 13971 | F:1 |
| 13925 | D:1 | 13972 | F:1 |
| 13926 | D:1 | 13973 | F:1 |
| 13927 | D:1 | 13974 | F:1 |
| 13928 | D:1 | 13975 | F:1 |
| 13929 | D:1 | 13976 | F:1 |
| 13930 | D:1 | 13977 | F:1 |
| 13931 | K:2 | 13978 | F:1 |
| 13932 | D:1 | 13979 | F:1 |
| 13933 | D:1 | 13980 | F:1 |
| 13934 | D:1 | 13981 | F:1 |
| 13935 | D:1 | 13982 | F:1 |
| 13936 | D:1 | 13983 | F:1 |
| 13937 | D:1 | 13984 | F:1 |
| 13938 | D:1 | 13985 | F:1 |
| 13939 | D:1 | 13986 | F:1 |
| 13940 | D:1 | 13987 | F:1 |
| 13941 | D:1 | 13988 | F:1 |
| 13942 | D:1 | 13989 | F:1 |
| 13943 | F:1 | 13990 | F:1 |
| 13944 | F:1 | 13991 | F:1 |
| 13945 | F:1 | 13992 | F:1 |
| 13946 | F:1 | 13993 | F:1 |
| 13947 | F:6 | 13994 | F:1 |
| 13948 | F:1 | 13995 | F:1 |
| 13949 | F:1 | 13996 | F:1 |
| 13950 | F:1 | 13997 | F:1 |
| 13951 | F:1 | 13998 | F:1 |
| 13952 | F:1 | 13999 | F:1 |
| 13953 | F:1 | 14000 | F:1 |
| 13954 | F:1 | 14001 | F:1 |
| 13955 | F:1 | 14002 | F:1 |
| 13956 | F:1 | 14003 | F:1 |
| 13957 | A:1 | 14004 | F:1 |
| 13958 | F:1 | 14005 | F:1 |
| 13959 | F:1 | 14006 | F:1 |
| 13960 | F:1 | 14007 | F:1 |
| 13961 | F:1 | 14008 | F:1 |
| 13962 | F:1 | 14009 | F:1 |
| 13963 | F:1 | 14010 | F:1 |
| 14011 | F:1 | 14058 | A:1 |
| 14012 | F:1 | 14059 | A:1 |
| 14013 | F:1 | 14060 | A:1 |
| 14014 | F:1 | 14061 | A:1 |
| 14015 | F:1 | 14062 | A:1 |
| 14016 | F:1 | 14063 | A:1 |
| 14017 | F:1 | 14064 | A:1 |
| 14018 | F:1 | 14065 | 1:2 |
| 14019 | F:1 | 14066 | A:1 |
| 14020 | F:1 | 14067 | A:1 |
| 14021 | F:1 | 14068 | A:1 |
| 14022 | F:10 K:2 | 14069 | A:1 |
| 14023 | F:1 | 14070 | A:1 |
| 14024 | F:1 | 14071 | A:1 |
| 14025 | F:1 | 14072 | A:1 |
| 14026 | F:1 | 14073 | A:1 |
| 14027 | F:1 | 14074 | A:1 |
| 14028 | F:1 | 14075 | K:2 |
| 14029 | F:1 | 14076 | A:1 |

TABLE V-continued (Spatial distribution)

| Seq Id No. | Tissue distribution | Seq Id No. | Tissue distribution |
|---|---|---|---|
| 14030 | F:1 | 14077 | A:1 |
| 14031 | F:1 | 14078 | A:1 |
| 14032 | F:1 | 14079 | A:1 |
| 14033 | F:1 | 14080 | A:1 |
| 14034 | F:1 | 14081 | A:1 |
| 14035 | A:1 | 14082 | A:1 |
| 14036 | A:1 | 14083 | A:1 |
| 14037 | A:1 | 14084 | A:1 |
| 14038 | A:1 | 14085 | A:1 |
| 14039 | A:1 | 14086 | A:1 |
| 14040 | A:1 | 14087 | A:1 |
| 14041 | A:1 | 14088 | K:3 |
| 14042 | A:1 | 14089 | A:1 |
| 14043 | A:1 | 14090 | A:1 |
| 14044 | A:1 | 14091 | A:1 |
| 14045 | A:1 | 14092 | A:1 |
| 14046 | A:1 | 14093 | F:1 K:2 |
| 14047 | A:1 | 14094 | K:2 |
| 14048 | A:1 | 14095 | A:1 |
| 14049 | A:1 | 14096 | A:1 |
| 14050 | A:1 | 14097 | A:1 |
| 14051 | A:1 | 14098 | A:1 |
| 14052 | A:1 | 14099 | A:1 |
| 14053 | A:1 | 14100 | A:1 |
| 14054 | A:1 | 14101 | A:1 |
| 14055 | A:1 | 14102 | A:1 |
| 14056 | A:1 | 14103 | A:1 |
| 14057 | A:1 | 14104 | B:3 |
| 14105 | A:1 | 14152 | A:1 |
| 14106 | A:1 | 14153 | A:1 |
| 14107 | A:1 | 14154 | A:1 |
| 14108 | A:1 | 14155 | A:1 |
| 14109 | A:1 | 14156 | A:1 |
| 14110 | A:1 | 14157 | A:1 |
| 14111 | A:1 | 14158 | A:1 |
| 14112 | A:1 | 14159 | A:1 |
| 14113 | A:1 | 14160 | A:1 |
| 14114 | A:1 | 14161 | A:1 |
| 14115 | A:1 | 14162 | A:1 |
| 14116 | A:1 | 14163 | A:1 |
| 14117 | A:1 | 14164 | A:1 |
| 14118 | A:1 | 14165 | A:1 |
| 14119 | A:1 | 14166 | A:1 |
| 14120 | A:1 | 14167 | A:1 |
| 14121 | A:1 | 14168 | A:1 |
| 14122 | A:1 | 14169 | A:1 |
| 14123 | A:1 | 14170 | A:1 |
| 14124 | A:1 | 14171 | A:1 |
| 14125 | A:1 | 14172 | A:1 |
| 14126 | A:1 | 14173 | A:1 |
| 14127 | A:1 | 14174 | A:1 |
| 14128 | A:1 | 14175 | A:1 |
| 14129 | A:1 | 14176 | A:1 |
| 14130 | A:1 | 14177 | A:1 |
| 14131 | A:1 | 14178 | A:1 |
| 14132 | A:1 | 14179 | A:1 |
| 14133 | A:1 | 14180 | B:3 |
| 14134 | D:1 J:2 | 14181 | A:1 |
| 14135 | A:1 | 14182 | A:1 |
| 14136 | A:1 | 14183 | A:1 |
| 14137 | A:1 | 14184 | A:1 |
| 14138 | A:1 | 14185 | A:1 |
| 14139 | A:1 | 14186 | A:1 |
| 14140 | A:1 | 14187 | A:1 |
| 14141 | A:1 | 14188 | A:1 |
| 14142 | A:1 | 14189 | A:1 |
| 14143 | A:1 J:2 | 14190 | A:1 |
| 14144 | A:1 | 14191 | A:1 |
| 14145 | A:1 | 14192 | A:1 |
| 14146 | A:1 | 14193 | A:1 |
| 14147 | A:1 | 14194 | A:1 |
| 14148 | A:1 | 14195 | A:1 |
| 14149 | A:1 | 14196 | A:1 |
| 14150 | A:1 | 14197 | A:1 |
| 14151 | A:1 | 14198 | A:1 |
| 14199 | A 1 | 14246 | A:1 |
| 14200 | A:1 | 14247 | A:1 |
| 14201 | A:1 | 14248 | A:1 |
| 14202 | A:1 | 14249 | A:1 |
| 14203 | A:1 | 14250 | C:8 |
| 14204 | A:1 | 14251 | A:1 |
| 14205 | A:1 | 14252 | A:1 |
| 14206 | A:1 | 14253 | A:1 |
| 14207 | A:1 | 14254 | A:1 |
| 14208 | A:1 | 14255 | A:1 |
| 14209 | A:1 | 14256 | A:1 |
| 14210 | B:1 | 14257 | A:1 |
| 14211 | A:1 | 14258 | A:1 |
| 14212 | A:1 | 14259 | A:1 |
| 14213 | A:1 | 14260 | A:1 |
| 14214 | A:1 | 14261 | A:1 |
| 14215 | A:1 | 14262 | A:1 |
| 14216 | A:1 | 14263 | A:1 |
| 14217 | A:1 | 14264 | A:1 |
| 14218 | A:1 | 14265 | A:1 |
| 14219 | A:1 | 14266 | H:1 |
| 14220 | A:1 | 14267 | A:1 |
| 14221 | A:1 | 14268 | A:1 |
| 14222 | A:1 | 14269 | A:1 |
| 14223 | A:1 | 14270 | A:1 |
| 14224 | C:1 F:1 K:1 | 14271 | A:1 |
| 14225 | A:1 | 14272 | A:1 |
| 14226 | A:1 | 14273 | A:1 |
| 14227 | A:1 | 14274 | A:1 |
| 14228 | A:1 | 14275 | A:1 |
| 14229 | A:1 | 14276 | A:1 |
| 14230 | A:1 | 14277 | A:1 |
| 14231 | A:1 | 14278 | B:3 C:6 H:1 |
| 14232 | B:1 C:1 | 14279 | A:1 |
| 14233 | A:1 | 14280 | A:1 |
| 14234 | A:1 | 14281 | A:1 |
| 14235 | A:1 | 14282 | A:1 |
| 14236 | A:1 | 14283 | A:1 |
| 14237 | A:1 | 14284 | A:1 |
| 14238 | A:1 | 14285 | A:1 |
| 14239 | A:1 | 14286 | F:13 K:6 |
| 14240 | D:1 | 14287 | A:1 |
| 14241 | A:1 | 14288 | A:1 |
| 14242 | A:1 | 14289 | A:1 |
| 14243 | A:1 | 14290 | A:1 |
| 14244 | A:1 | 14291 | A:1 |
| 14245 | A:1 | 14292 | A:1 |
| 14293 | A 1 | 14340 | A:1 |
| 14294 | A:1 | 14341 | C:2 |
| 14295 | A:1 C:5 | 14342 | A:1 |
| 14296 | A:1 | 14343 | A:1 |
| 14297 | A:1 | 14344 | A:1 |
| 14298 | A:1 | 14345 | A:1 |
| 14299 | A:1 | 14346 | A:1 |
| 14300 | A:1 | 14347 | A:1 |
| 14301 | A:1 | 14348 | A:1 |
| 14302 | A:1 | 14349 | A:1 |
| 14303 | A:1 | 14350 | A:1 |
| 14304 | F:5 K:1 | 14351 | A:1 |
| 14305 | A:1 | 14352 | A:1 |
| 14306 | A:1 | 14353 | A:1 |
| 14307 | A:1 | 14354 | A:1 |
| 14308 | A:1 | 14355 | A:1 |
| 14309 | A:1 | 14356 | A:1 |
| 14310 | A:1 | 14357 | A:1 |
| 14311 | A:1 | 14358 | A:1 |
| 14312 | K:2 | 14359 | A:1 |
| 14313 | A:1 | 14360 | A:1 |
| 14314 | A:1 | 14361 | A:1 |
| 14315 | A:1 | 14362 | A:1 |
| 14316 | A:1 | 14363 | A:1 |

TABLE V-continued

(Spatial distribution)

| Seq Id No. | Tissue distribution | Seq Id No. | Tissue distribution |
|---|---|---|---|
| 14317 | A:1 | 14364 | A:1 |
| 14318 | K:1 | 14365 | A:1 |
| 14319 | A:1 | 14366 | A:1 |
| 14320 | A:1 | 14367 | H:3 |
| 14321 | A:1 | 14368 | A:1 |
| 14322 | A:1 | 14369 | A:1 |
| 14323 | A:1 | 14370 | A:1 |
| 14324 | A:1 | 14371 | A:1 |
| 14325 | A:1 | 14372 | A:1 |
| 14326 | A:1 | 14373 | A:1 |
| 14327 | A:1 | 14374 | A:1 |
| 14328 | A:1 | 14375 | A:1 |
| 14329 | A:1 | 14376 | A:1 |
| 14330 | A:1 | 14377 | A:1 |
| 14331 | A:1 | 14378 | A:1 |
| 14332 | A:1 | 14379 | A:1 |
| 14333 | A:1 | 14380 | A:1 |
| 14334 | A:1 | 14381 | A:1 |
| 14335 | A:1 | 14382 | A:1 |
| 14336 | A:1 | 14383 | A:1 |
| 14337 | A:1 | 14384 | A:1 |
| 14338 | A:1 | 14385 | A:1 |
| 14339 | A:1 | 14386 | K:2 |
| 14387 | A:1 | 14434 | A:1 |
| 14388 | A:1 | 14435 | A:1 |
| 14389 | A:1 | 14436 | A:1 |
| 14390 | A:1 | 14437 | A:1 |
| 14391 | A:1 | 14438 | A:1 |
| 14392 | K:1 | 14439 | A:1 |
| 14393 | A:1 | 14440 | A:1 |
| 14394 | A:1 | 14441 | A:1 |
| 14395 | A:1 | 14442 | A:1 |
| 14396 | A:1 | 14443 | A:1 |
| 14397 | A:1 | 14444 | A:1 |
| 14398 | A:1 | 14445 | A:1 |
| 14399 | A:1 | 14446 | A:1 |
| 14400 | A:1 | 14447 | A:1 |
| 14401 | A:1 | 14448 | A:1 |
| 14402 | A:1 | 14449 | A:1 |
| 14403 | A:1 | 14450 | A:1 |
| 14404 | A:1 | 14451 | A:1 |
| 14405 | A:1 | 14452 | A:1 |
| 14406 | A:1 | 14453 | A:1 |
| 14407 | A:1 | 14454 | A:1 |
| 14408 | A:1 | 14455 | H:2 |
| 14409 | A:1 | 14456 | A:1 |
| 14410 | A:1 | 14457 | A:1 |
| 14411 | A:1 | 14458 | A:1 |
| 14412 | A:1 | 14459 | A:1 |
| 14413 | A:1 | 14460 | A:1 |
| 14414 | A:1 | 14461 | A:1 |
| 14415 | A:1 | 14462 | A:1 |
| 14416 | A:1 | 14463 | A:1 |
| 14417 | A:1 | 14464 | A:1 |
| 14418 | A:1 | 14465 | F:1 K:1 |
| 14419 | A:1 | 14466 | A:1 |
| 14420 | A:1 | 14467 | A:1 |
| 14421 | A:1 | 14468 | A:1 |
| 14422 | A:1 | 14469 | A:1 |
| 14423 | A:1 | 14470 | A:1 |
| 14424 | A:1 | 14471 | A:1 |
| 14425 | A:1 | 14472 | A:1 |
| 14426 | A:1 | 14473 | A:1 |
| 14427 | F:1 K:1 | 14474 | A:1 |
| 14428 | A:1 | 14475 | H:3 |
| 14429 | A:1 | 14476 | A:1 |
| 14430 | A:1 | 14477 | A:1 |
| 14431 | A:1 | 14478 | A:1 |
| 14432 | A:1 | 14479 | A:1 |
| 14433 | A:1 | 14480 | A:1 |
| 14481 | A:1 | 14528 | A:1 |
| 14482 | A:1 | 14529 | F:1 K:1 |
| 14483 | A:1 | 14530 | A:1 |
| 14484 | A:1 | 14531 | A:1 |
| 14485 | A:1 | 14532 | A:1 |
| 14486 | A:1 | 14533 | A:1 |
| 14487 | A:1 | 14534 | A:1 |
| 14488 | A:1 | 14535 | A:1 |
| 14489 | A:1 | 14536 | A:1 |
| 14490 | A:1 | 14537 | A:1 |
| 14491 | A:1 | 14538 | H:3 |
| 14492 | A:1 | 14539 | A:1 |
| 14493 | A:1 | 14540 | A:1 |
| 14494 | A:1 | 14541 | A:1 |
| 14495 | A:1 | 14542 | A:1 |
| 14496 | A:1 | 14543 | A:1 |
| 14497 | A:1 | 14544 | A:1 |
| 14498 | A:1 | 14545 | A:1 |
| 14499 | A:1 | 14546 | A:19 B:16 C:31 D:14 F:2 H:17 K:3 |
| 14500 | A:1 | 14547 | A:1 |
| 14501 | A:1 | 14548 | A:1 |
| 14502 | A:1 | 14549 | A:1 |
| 14503 | A:1 | 14550 | A:1 |
| 14504 | A:1 | 14551 | A:1 |
| 14505 | A:1 | 14552 | A:1 |
| 14506 | A:1 | 14553 | A:1 |
| 14507 | A:1 | 14554 | A:1 |
| 14508 | B:4 | 14555 | A:1 |
| 14509 | A:1 | 14556 | A:1 |
| 14510 | A:1 | 14557 | A:1 |
| 14511 | A:1 | 14558 | A:1 |
| 14512 | A:1 | 14559 | H:3 |
| 14513 | A:1 | 14560 | A:1 |
| 14514 | A:1 | 14561 | A:1 |
| 14515 | A:1 | 14562 | A:1 |
| 14516 | A:1 | 14563 | A:1 |
| 14517 | A:1 | 14564 | A:1 |
| 14518 | A:1 | 14565 | A:1 |
| 14519 | K:2 | 14566 | A:1 |
| 14520 | A:1 | 14567 | A:1 |
| 14521 | A:1 | 14568 | A:1 |
| 14522 | A:1 | 14569 | A:1 |
| 14523 | A:1 | 14570 | A:1 |
| 14524 | A:1 | 14571 | A:1 |
| 14525 | A:1 | 14572 | A:1 |
| 14526 | A:1 | 14573 | A:1 |
| 14527 | A:1 | 14574 | A:1 |
| 14575 | A:1 | 14621 | A:1 |
| 14576 | A:1 | 14622 | A:1 |
| 14577 | A:1 | 14623 | A:1 |
| 14578 | A:1 | 14624 | B:2 |
| 14579 | A:1 | 14625 | A:1 |
| 14580 | A:1 | 14626 | A:1 |
| 14581 | A:1 | 14627 | A:1 |
| 14582 | A:1 | 14628 | A:1 |
| 14583 | A:1 | 14629 | A:1 |
| 14584 | A:1 | 14630 | F:10 K:5 |
| 14585 | A:1 | 14631 | A:1 |
| 14586 | A:1 | 14632 | A:1 |
| 14587 | A:1 | 14633 | A:1 |
| 14588 | A:1 | 14634 | A:1 |
| 14589 | A:1 | 14635 | A:1 |
| 14590 | A:1 | 14636 | A:1 |
| 14591 | A:1 | 14637 | A:1 |
| 14592 | A:1 | 14638 | A:1 |
| 14593 | A:1 | 14639 | A:1 |
| 14594 | A:1 | 14640 | A:1 |
| 14595 | K:2 | 14641 | A:1 |
| 14596 | A:1 | 14642 | A:1 |
| 14597 | A:1 | 14643 | A:1 |
| 14598 | A:1 | 14644 | A:1 |
| 14599 | A:1 | 14645 | A:1 |
| 14600 | A:1 | 14646 | A:1 |
| 14601 | A:1 | 14647 | A:1 |
| 14602 | A:1 | 14648 | A:1 |
| | | 14649 | A:1 |

TABLE V-continued

(Spatial distribution)

| Seq Id No. | Tissue distribution | Seq Id No. | Tissue distribution |
|---|---|---|---|
| 14603 | A:1 | 14650 | A:1 |
| 14604 | B:4 | 14651 | A:1 |
| 14605 | A:1 | 14652 | A:1 |
| 14606 | A:1 | 14653 | A:1 |
| 14607 | A:1 | 14654 | B:1 C:106 H:1 |
| 14608 | A:1 | 14655 | A:1 |
| 14609 | A:1 | 14656 | A:1 |
| 14610 | H:2 | 14657 | A:1 |
| 14611 | A:1 | 14658 | A:1 |
| 14612 | A:1 | 14659 | A:1 |
| 14613 | A:1 | 14660 | A:1 |
| 14614 | A:1 | 14661 | A:1 |
| 14615 | A:1 | 14662 | A:1 |
| 14616 | A:1 | 14663 | A:1 |
| 14617 | A:1 | 14664 | A:1 |
| 14618 | A:1 | 14665 | A:1 |
| 14619 | A:1 | 14666 | A:1 |
| 14620 | A:1 | 14667 | A:1 |
| 14668 | A:1 | 14715 | A:1 |
| 14669 | A:1 | 14716 | A:1 |
| 14670 | A:1 | 14717 | A:1 |
| 14671 | A:1 | 14718 | A:1 |
| 14672 | A:1 | 14719 | K:2 |
| 14673 | B:1 | 14720 | A:1 |
| 14674 | A:1 | 14721 | A:1 |
| 14675 | A:1 | 14722 | A:1 |
| 14676 | A:1 | 14723 | A:1 |
| 14677 | A:1 | 14724 | A:1 |
| 14678 | A:1 | 14725 | A:1 |
| 14679 | A:1 | 14726 | A:1 |
| 14680 | A:1 | 14727 | A:1 |
| 14681 | A:1 | 14728 | A:1 |
| 14682 | A:1 | 14729 | A:1 |
| 14683 | A:1 | 14730 | B:3 |
| 14684 | A:1 | 14731 | A:1 |
| 14685 | A:1 | 14732 | A:1 |
| 14686 | A:1 | 14733 | A:1 |
| 14687 | A:1 | 14734 | A:1 |
| 14688 | A:1 | 14735 | A:1 |
| 14689 | A:1 | 14736 | A:1 |
| 14690 | A:1 | 14737 | A:1 |
| 14691 | C:1 | 14738 | A:1 |
| 14692 | A:1 | 14739 | A:1 |
| 14693 | A:1 | 14740 | A:1 |
| 14694 | A:1 | 14741 | A:1 |
| 14695 | A:1 | 14742 | A:1 |
| 14696 | A:1 | 14743 | A:1 |
| 14697 | A:1 | 14744 | A:1 |
| 14698 | A:1 | 14745 | A:1 |
| 14699 | A:1 | 14746 | F:1 K:2 |
| 14700 | A:1 | 14747 | A:1 |
| 14701 | B:1 | 14748 | A:1 |
| 14702 | A:1 | 14749 | A:1 |
| 14703 | A:1 | 14750 | A:1 |
| 14704 | A:1 | 14751 | A:1 |
| 14705 | A:1 | 14752 | A:1 |
| 14706 | A:1 | 14753 | A:1 |
| 14707 | A:1 | 14754 | A:1 |
| 14708 | A:1 | 14755 | A:1 |
| 14709 | F:3 K:2 | 14756 | A:1 |
| 14710 | A:1 | 14757 | A:1 |
| 14711 | A:1 | 14758 | A:1 |
| 14712 | A:1 | 14759 | A:1 |
| 14713 | A:1 | 14760 | A:1 |
| 14714 | A:1 | 14761 | A:1 |
| 14762 | A:1 | 14809 | A:1 |
| 14763 | A:1 | 14810 | A:1 |
| 14764 | A:1 | 14811 | A:1 |
| 14765 | A:1 | 14812 | A:1 |
| 14766 | A:1 | 14813 | A:1 |
| 14767 | A:1 | 14814 | A:1 |
| 14768 | A:1 | 14815 | A:1 |
| 14769 | A:1 | 14816 | A:1 |
| 14770 | A:1 | 14817 | B:4 C:1 D:1 |
| 14771 | A:1 | 14818 | A:1 |
| 14772 | A:1 | 14819 | A:1 |
| 14773 | A:1 | 14820 | A:1 |
| 14774 | A:1 | 14821 | A:1 |
| 14775 | A:1 | 14822 | A:1 |
| 14776 | A:1 | 14823 | A:1 |
| 14777 | A:1 | 14824 | A:1 |
| 14778 | A:1 | 14825 | A:1 |
| 14779 | A:1 | 14826 | A:1 |
| 14780 | A:1 | 14827 | A:1 |
| 14781 | B:1 | 14828 | A:1 |
| 14782 | A:1 | 14829 | A:1 |
| 14783 | A:1 | 14830 | A:1 |
| 14784 | A:1 | 14831 | A:1 |
| 14785 | A:1 | 14832 | A:1 |
| 14786 | A:1 | 14833 | A:1 |
| 14787 | A:1 | 14834 | A:1 |
| 14788 | A:1 | 14835 | A:1 |
| 14789 | K:1 | 14836 | A:1 |
| 14790 | A:1 | 14837 | A:1 |
| 14791 | A:1 | 14838 | A:1 |
| 14792 | A:1 | 14839 | A:1 |
| 14793 | A:1 | 14840 | A:1 |
| 14794 | A:1 | 14841 | A:1 |
| 14795 | A:1 | 14842 | A:1 |
| 14796 | A:1 | 14843 | A:1 |
| 14797 | A:1 | 14844 | A:1 |
| 14798 | B:1 | 14845 | A:1 |
| 14799 | A:1 | 14846 | A:1 |
| 14800 | A:1 | 14847 | A:1 |
| 14801 | A:1 | 14848 | A:1 |
| 14802 | A:1 | 14849 | A:1 |
| 14803 | A:1 | 14850 | A:1 |
| 14804 | A:1 | 14851 | A:1 |
| 14805 | A:1 | 14852 | C:9 |
| 14806 | A:1 | 14853 | A:1 |
| 14807 | F:1 | 14854 | A:1 |
| 14808 | A:1 | 14855 | A:1 |
| 14856 | A:1 | 14903 | A:1 |
| 14857 | A:1 | 14904 | A:1 |
| 14858 | A:1 | 14905 | A:1 |
| 14859 | A:1 | 14906 | A:1 |
| 14860 | A:1 | 14907 | A:1 |
| 14861 | A:1 | 14908 | A:1 |
| 14862 | B:1 | 14909 | A:1 |
| 14863 | A:1 | 14910 | A:1 |
| 14864 | A:1 | 14911 | A:1 |
| 14865 | A:1 | 14912 | A:1 |
| 14866 | A:1 | 14913 | A:1 |
| 14867 | A:1 | 14914 | A:1 |
| 14868 | A:1 | 14915 | A:1 |
| 14869 | A:1 | 14916 | A:1 |
| 14870 | F:1 | 14917 | A:1 |
| 14871 | A:1 | 14918 | A:1 |
| 14872 | A:1 | 14919 | A:1 |
| 14873 | A:1 | 14920 | A:1 |
| 14874 | A:1 | 14921 | A:1 |
| 14875 | A:1 | 14922 | A:1 |
| 14876 | A:1 | 14923 | A:1 |
| 14877 | A:1 | 14924 | A:1 |
| 14878 | A:1 | 14925 | A:1 |
| 14879 | A:1 | 14926 | A:1 |
| 14880 | A:1 | 14927 | A:1 |
| 14881 | A:1 | 14928 | A:1 |
| 14882 | A:1 | 14929 | A:1 |
| 14883 | A:1 | 14930 | A:1 |
| 14884 | A:1 | 14931 | A:1 |
| 14885 | A:1 | 14932 | A:1 |
| 14886 | A:1 | 14933 | F:1 K:1 |
| 14887 | A:1 | 14934 | A:1 |
| 14888 | A:1 | 14935 | A:1 |
| 14889 | A:1 | 14936 | A:1 |

TABLE V-continued

(Spatial distribution)

| Seq Id No. | Tissue distribution |
|---|---|
| 14890 | A:1 |
| 14891 | A:1 |
| 14892 | A:1 |
| 14893 | A:1 |
| 14894 | A:1 |
| 14895 | A:1 |
| 14896 | A:1 |
| 14897 | A:1 |
| 14898 | A:1 |
| 14899 | A:1 |
| 14900 | A:1 |
| 14901 | A:1 |
| 14902 | A:1 |
| 14950 | A:1 |
| 14951 | A:1 |
| 14952 | A:1 |
| 14953 | A:1 |
| 14954 | A:1 |
| 14955 | A:1 |
| 14956 | F:1 K:1 |
| 14957 | A:1 |
| 14958 | A:1 |
| 14959 | A:1 |
| 14960 | A:1 |
| 14961 | A:1 |
| 14962 | A:1 |
| 14963 | A:1 |
| 14964 | H:5 |
| 14965 | A:1 |
| 14966 | A:1 |
| 14967 | A:1 |
| 14968 | A:1 |
| 14969 | A:1 |
| 14970 | A:1 |
| 14971 | A:1 |
| 14972 | A:1 |
| 14973 | A:1 |
| 14974 | A:1 |
| 14975 | A:1 |
| 14976 | A:1 |
| 14977 | A:1 |
| 14978 | A:1 |
| 14979 | A:1 |
| 14980 | A:1 |
| 14981 | A:1 |
| 14982 | A:1 |
| 14983 | A:1 |
| 14984 | A:1 |
| 14985 | A:1 |
| 14986 | F:1 |
| 14987 | A:1 |
| 14988 | A:1 |
| 14989 | A:1 |
| 14990 | A:1 |
| 14991 | A:1 |
| 14992 | A:1 |
| 14993 | A:1 |
| 14994 | A:1 |
| 14995 | K:1 |
| 14996 | A:1 |
| 15044 | A:1 |
| 15045 | A:1 |
| 15046 | A:1 |
| 15047 | A:1 |
| 15048 | A:1 |
| 15049 | A:1 |
| 15050 | A:1 |
| 15051 | A:1 |
| 15052 | A:1 |
| 15053 | A:5 |
| 15054 | A:1 |
| 15055 | A:1 |
| 14937 | A:1 |
| 14938 | A:1 |
| 14939 | A:1 |
| 14940 | A:1 |
| 14941 | A:1 |
| 14942 | A:1 |
| 14943 | A:1 |
| 14944 | A:1 |
| 14945 | A:1 |
| 14946 | A:1 |
| 14947 | A:1 |
| 14948 | A:1 |
| 14949 | A:1 |
| 14997 | A:1 |
| 14998 | A:1 |
| 14999 | A:1 |
| 15000 | A:1 |
| 15001 | A:1 |
| 15002 | A:1 |
| 15003 | A:1 |
| 15004 | A:1 |
| 15005 | B:4 |
| 15006 | A:1 |
| 15007 | A:1 |
| 15008 | A:1 |
| 15009 | A:1 |
| 15010 | A:1 |
| 15011 | A:1 |
| 15012 | A:1 |
| 15013 | A:8 B:23 C:7 D:1 H:1 I:1 K:3 |
| 15014 | A:1 |
| 15015 | A:1 |
| 15016 | A:1 |
| 15017 | A:1 |
| 15018 | A:1 |
| 15019 | A:1 |
| 15020 | A:1 |
| 15021 | A:1 |
| 15022 | A:1 |
| 15023 | B:1 |
| 15024 | A:1 |
| 15025 | A:1 |
| 15026 | A:1 |
| 15027 | A:1 |
| 15028 | A:1 |
| 15029 | A:1 |
| 15030 | A:1 |
| 15031 | A:1 |
| 15032 | H:1 K:1 |
| 15033 | A:1 |
| 15034 | A:1 |
| 15035 | A:1 |
| 15036 | A:1 |
| 15037 | A:1 |
| 15038 | A:1 |
| 15039 | A:1 |
| 15040 | A:1 |
| 15041 | A:1 |
| 15042 | F:1 K:4 |
| 15043 | A:1 |
| 15091 | A:1 |
| 15092 | A:1 |
| 15093 | A:1 |
| 15094 | A:1 |
| 15095 | F:1 K:1 |
| 15096 | K:1 |
| 15097 | A:1 H:1 |
| 15098 | A:3 |
| 15099 | F:1 |
| 15100 | H:1 |
| 15101 | C:3 F:1 J:2 |
| 15102 | H:2 |
| 15056 | A:1 |
| 15057 | A:1 |
| 15058 | A:1 |
| 15059 | A:1 |
| 15060 | A:1 |
| 15061 | A:1 |
| 15062 | A:1 |
| 15063 | A:1 |
| 15064 | A:1 |
| 15065 | A:1 |
| 15066 | A:1 |
| 15067 | A:1 |
| 15068 | A:1 |
| 15069 | A:1 |
| 15070 | A:1 |
| 15071 | A:1 |
| 15072 | A:1 |
| 15073 | A:1 |
| 15074 | A:1 |
| 15075 | A:1 |
| 15076 | A:1 |
| 15077 | C:3 |
| 15078 | A:1 |
| 15079 | A:1 |
| 15080 | A:1 |
| 15081 | A:1 |
| 15082 | A:1 |
| 15083 | A:1 |
| 15084 | A:1 |
| 15085 | A:1 |
| 15086 | A:1 |
| 15087 | A:1 |
| 15088 | B:4 C:1 |
| 15089 | A:1 |
| 15090 | A:1 |
| 15138 | A:4 |
| 15139 | F:9 K:2 |
| 15140 | A:3 |
| 15141 | A:8 B:2 C:23 J:1 |
| 15142 | K:1 |
| 15143 | B:2 |
| 15144 | K:1 |
| 15145 | F:2 |
| 15146 | C:3 |
| 15147 | H:2 |
| 15148 | K:3 |
| 15149 | B:4 |
| 15150 | F:1 K:3 |
| 15151 | A:2 |
| 15152 | H:1 |
| 15153 | F:1 K:1 |
| 15154 | I:3 |
| 15155 | C:1 H:3 |
| 15156 | K:1 |
| 15157 | K:3 |
| 15158 | B:2 |
| 15159 | A:2 |
| 15160 | B:1 C:1 |
| 15161 | H:1 |
| 15162 | H:3 |
| 15163 | A:1 |
| 15164 | F:2 K:6 |
| 15165 | F:1 K:4 |
| 15166 | C:6 |
| 15167 | K:1 |
| 15168 | B:2 |
| 15169 | C:1 |
| 15170 | C:10 |
| 15171 | K:2 |
| 15172 | A:1 |
| 15173 | A:1 B:1 |
| 15174 | A:6 |
| 15175 | A:5 |
| 15103 | A:2 H:5 |
| 15104 | F:4 K:8 |
| 15105 | F:3 K:4 |
| 15106 | K:1 |
| 15107 | K:1 |
| 15108 | A:4 |
| 15109 | K:1 |
| 15110 | H:2 |
| 15111 | B:5 |
| 15112 | K:1 |
| 15113 | H:2 |
| 15114 | F:2 H:4 K:2 |
| 15115 | C:1 H:2 |
| 15116 | F:11 |
| 15117 | H:1 |
| 15118 | F:1 K:1 |
| 15119 | F:1 K:1 |
| 15120 | K:3 |
| 15121 | K:2 |
| 15122 | K:3 |
| 15123 | H:3 |
| 15124 | B:2 |
| 15125 | F:11 K:3 |
| 15126 | A:2 |
| 15127 | A:1 |
| 15128 | A:1 |
| 15129 | C:55 H:1 K:2 |
| 15130 | A:2 |
| 15131 | F:1 K:2 |
| 15132 | K:2 |
| 15133 | K:1 |
| 15134 | K:1 |
| 15135 | B:2 |
| 15136 | F:5 K:2 |
| 15137 | H:5 |
| 15185 | A:4 |
| 15186 | A:3 |
| 15187 | H:2 |
| 15188 | K:3 |
| 15189 | F:1 K:1 |
| 15190 | F:1 K:1 |
| 15191 | F:1 K:1 |
| 15192 | B:3 |
| 15193 | C:2 |
| 15194 | F:2 K:1 |
| 15195 | F:1 K:1 |
| 15196 | A:1 B:11 C:20 D:1 H:2 K:1 |
| 15197 | B: C:1 D:1 K:1 |
| 15198 | A:1 B:1 C:7 D:1 H:1 K:1 |
| 15199 | B:1 C:1 D:2 K:1 |
| 15200 | A:4 B:31 C:72 D:20 F:3 H:29 I:3 J:3 K:19 |
| 15201 | A:6 B:2 F:2 H:3 K:1 |
| 15202 | A:4 B:27 C:60 D:18 F:1 H:16 I:3 J:2 K:12 |
| 15203 | H:1 |
| 15204 | C:1 |
| 15205 | D:1 |
| 15206 | C:1 |
| 15207 | C:1 |
| 15208 | B:1 |
| 15209 | C:1 |
| 15210 | H:1 |
| 15211 | K:3 |
| 15212 | F:1 K:1 |
| 15213 | K:3 |
| 15214 | F:1 K:1 |
| 15215 | F:1 K:1 |
| 15216 | H:2 |
| 15217 | K:2 |
| 15218 | K:2 |
| 15219 | F:7 K:1 |
| 15220 | A:1 C:10 D:1 |

TABLE V-continued

(Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 15176 | K:1 | 15221 | F:1 | 15340 | B:2 | 15387 | B:1 |
| 15177 | B:2 | 15222 | F:1 K:4 | 15341 | C:45 | 15388 | K:1 |
| 15178 | H:2 | 15223 | F:5 | 15342 | K:1 | 15389 | K:1 |
| 15179 | B:2 | 15224 | K:2 | 15343 | C:1 | 15390 | C:3 J:2 |
| 15180 | A:1 H:1 | 15225 | D:1 H:1 | 15344 | H:8 | 15391 | B:3 |
| 15181 | K:3 | 15226 | A:6 | 15345 | A:12 | 15392 | H:5 |
| 15182 | H:14 | 15227 | B:3 C:1 | 15346 | F:2 | 15393 | K:1 |
| 15183 | K:2 | 15228 | K:2 | 15347 | F:4 | 15394 | B:6 |
| 15184 | F:1 K:3 | 15229 | C:10 | 15348 | F:9 K:2 | 15395 | F:1 |
| 15230 | C:1 | 15277 | A:1 | 15349 | H:2 | 15396 | K:1 |
| 15231 | A:1 B:5 C:2 F:1 K:2 | 15278 | A:1 | 15350 | F:1 | 15397 | F:2 |
| 15232 | A:2 | 15279 | B:2 | 15351 | K:1 | 15398 | F:2 |
| 15233 | F:1 | 15280 | B:2 | 15352 | K:1 | 15399 | B:3 |
| 15234 | F:1 | 15281 | F:8 K:1 | 15353 | A:1 | 15400 | D:1 I:1 |
| 15235 | H:2 | 15282 | F:10 K:2 | 15354 | K:2 | 15401 | K:2 |
| 15236 | H:6 | 15283 | F:1 K:1 | 15355 | K:1 | 15402 | H:2 |
| 15237 | A:1 C:1 H:3 K:1 | 15284 | B:2 | 15356 | F:11 K:6 | 15403 | K:5 |
| 15238 | A:1 C:1 H:4 | 15285 | B:3 | 15357 | F:1 | 15404 | A:2 B:3 C:2 D:1 F:1 H:21 I:1 K:1 |
| 15239 | K:2 | 15286 | F:1 | | | | |
| 15240 | F:1 K:2 | 15287 | K:1 | 15358 | F:1 | 15405 | A:9 B:9 C:12 D:5 E:1 F:1 H:1 I:1 K:4 |
| 15241 | B:5 | 15288 | A:2 B:1 | 15359 | F:1 | | |
| 15242 | H:2 | 15289 | B:2 | 15360 | F:1 | 15406 | A:2 B:3 C:3 D:1 E:1 H:2 I:1 K:1 |
| 15243 | C:6 | 15290 | B:4 | | | | |
| 15244 | H:42 | 15291 | B:2 | | | 15407 | A:2 |
| 15245 | F:1 K:2 | 15292 | B:2 | 15361 | K:1 | 15408 | K:2 |
| 15246 | H:1 | 15293 | B:2 | 15362 | F:1 | 15409 | C:1 |
| 15247 | K:2 | 15294 | F:277 K:66 | 15363 | H:6 | 15410 | C:1 |
| 15248 | K:3 | 15295 | K:1 | 15364 | F:1 | 15411 | K:1 |
| 15249 | H:1 | 15296 | B:2 | 15365 | F:1 | 15412 | F:1 |
| 15250 | B:2 | 15297 | D:3 F:6 K:25 | 15366 | K:1 | 15413 | A:4 |
| 15251 | C:1 H:1 | 15298 | K:1 | 15367 | F:1 | 15414 | K:1 |
| 15252 | A:1 | 15299 | F:1 K:2 | 15368 | F:1 K:2 | 15415 | C:4 |
| 15253 | I:3 | 15300 | H:2 | 15369 | F:2 K:6 | 15416 | A:6 |
| 15254 | K:2 | 15301 | C:26 | 15370 | F:1 | | |
| 15255 | D:1 | 15302 | C:1 | 15417 | F:2 | 15464 | F:1 K:1 |
| 15256 | B:3 | 15303 | F:1 K:6 | 15418 | C:5 J:1 | 15465 | H:1 |
| 15257 | K:4 | 15304 | A:2 | 15419 | D:1 F:8 H:3 K:64 | 15466 | A:1 B:3 C:1 |
| 15258 | F:1 K:1 | 15305 | A:2 | 15420 | B:3 | 15467 | H:1 |
| 15259 | C:1 J:1 | 15306 | A:1 | 15421 | F:2 | 15468 | H:1 |
| 15260 | H:2 | 15307 | A:1 | 15422 | K:2 | 15469 | H:1 |
| 15261 | K:7 | 15308 | B:3 | 15423 | A:3 | 15470 | H:1 |
| 15262 | K:2 | 15309 | F:1 K:6 | 15424 | F:5 | 15471 | K:2 |
| 15263 | K:1 | 15310 | K:3 | 15425 | C:7 | 15472 | D:1 |
| 15264 | C:2 | 15311 | C:6 | 15426 | A:1 B:2 | 15473 | B:3 |
| 15265 | K:2 | 15312 | F:12 K:6 | 15427 | K:1 | 15474 | B:3 |
| 15266 | B:2 | 15313 | K:1 | 15428 | F:3 | 15475 | A:2 |
| 15267 | F:4 | 15314 | F:1 | 15429 | B:3 | 15476 | B:1 F:6 H:4 |
| 15268 | K:1 | 15315 | F:1 K:1 | 15430 | H:3 | 15477 | K:3 |
| 15269 | K:1 | 15316 | K:1 | 15431 | H:2 | 15478 | D:1 H:1 |
| 15270 | K:1 | 15317 | K:1 | 15432 | K:3 | 15479 | B:2 |
| 15271 | F:1 | 15318 | K:1 | 15433 | A:1 C:1 I:2 | 15480 | H:2 |
| 15272 | C:1 | 15319 | F:1 | 15434 | C:1 | 15481 | F:1 K:1 |
| 15273 | I:2 | 15320 | F:1 | 15435 | F:2 | 15482 | C:3 J:1 |
| 15274 | H:1 | 15321 | F:1 | 15436 | K:1 | 15483 | H:3 |
| 15275 | J:1 | 15322 | F:1 | 15437 | F:1 | 15484 | A:2 |
| 15276 | C:1 | 15323 | K:1 | 15438 | F:1 | 15485 | A:4 |
| 15324 | C:3 | 15371 | A:2 | 15439 | F:1 | 15486 | K:3 |
| 15325 | F:1 K:3 | 15372 | F:5 | 15440 | F:1 | 15487 | A:2 |
| 15326 | B:2 | 15373 | C:2 | 15441 | F:1 | 15488 | B:5 |
| 15327 | F:6 K:2 | 15374 | C:4 | 15442 | F:3 K:1 | 15489 | K:2 |
| 15328 | B:2 | 15375 | B:2 | 15443 | C:10 | 15490 | A:3 B:5 C:253 D:5 F:5 H:6 J:7 K:6 |
| 15329 | K:1 | 15376 | K:2 | 15444 | A:4 | | |
| 15330 | F:7 K:3 | 15377 | A:3 | 15445 | F:1 K:5 | 15491 | A:8 B:3 D:2 |
| 15331 | I:2 | 15378 | A:2 B:1 C:1 D:1 H:1 I:1 K:1 | 15446 | K:1 | 15492 | F:3 K:2 |
| | | | | 15447 | F:9 K:7 | 15493 | C:2 |
| 15332 | A:1 | 15379 | A:7 | 15448 | K:2 | 15494 | C:8 |
| 15333 | K:1 | 15380 | B:2 | 15449 | B:2 | 15495 | A:1 |
| 15334 | A:2 | 15381 | F:3 | 15450 | C:10 | 15496 | A:1 |
| 15335 | K:1 | 15382 | H:1 | 15451 | F:2 | 15497 | K:1 |
| 15336 | F:3 | 15383 | H:2 | 15452 | C:3 | 15498 | F:2 |
| 15337 | K:1 | 15384 | F:2 | 15453 | F:15 K:84 | 15499 | A:2 |
| 15338 | K:2 | 15385 | F:2 | 15454 | K:2 | 15500 | B:2 |
| 15339 | F:14 K:2 | 15386 | F:1 K:4 | 15455 | A:1 B:1 | 15501 | K:2 |
| | | | | 15456 | K:1 | 15502 | K:2 |

TABLE V-continued (Spatial distribution)

| Seq Id No. | Tissue distribution |
|---|---|
| 15457 | C:2 |
| 15458 | H:1 |
| 15459 | F:3 K:1 |
| 15460 | F:2 K:1 |
| 15461 | K:1 |
| 15462 | A:2 |
| 15463 | H:5 |
| 15510 | K:1 |
| 15511 | C:1 |
| 15512 | F:24 K:4 |
| 15513 | A:2 B:1 C:1 I:1 |
| 15514 | C:1 |
| 15515 | F:5 |
| 15516 | H:2 |
| 15517 | F:3 K:1 |
| 15518 | B:5 |
| 15519 | F:3 K:1 |
| 15520 | A:13 B:69 C:71 D:3 F:2 H:33 I:3 K:1 |
| 15521 | K:1 |
| 15522 | K:1 |
| 15523 | A:11 |
| 15524 | K:3 |
| 15525 | K:3 |
| 15526 | K:1 |
| 15527 | K:1 |
| 15528 | K:1 |
| 15529 | K:2 |
| 15530 | K:1 |
| 15531 | B:3 |
| 15532 | F:5 K:2 |
| 15533 | K:1 |
| 15534 | B:2 |
| 15535 | K:1 |
| 15536 | H:2 |
| 15537 | H:3 |
| 15538 | K:1 |
| 15539 | K:2 |
| 15540 | F:1 K:1 |
| 15541 | A:1 C:1 |
| 15542 | A:339 |
| 15543 | A:1 |
| 15544 | F:1 K:5 |
| 15545 | F:1 K:1 |
| 15546 | H:2 |
| 15547 | H:2 |
| 15548 | C:7 |
| 15549 | C:1 |
| 15550 | A:5 |
| 15551 | A:1 |
| 15552 | C:4 |
| 15553 | H:44 |
| 15554 | C:3 |
| 15555 | K:5 |
| 15602 | I:1 |
| 15603 | C:14 |
| 15604 | B:3 |
| 15605 | C:14 |
| 15606 | F:1 K:2 |
| 15607 | K:2 |
| 15608 | K:2 |
| 15609 | B:2 |
| 15610 | F:1 K:4 |
| 15611 | B:1 |
| 15612 | F:1 K:1 |
| 15613 | F:33 K:7 |
| 15614 | A:11 B:2 C:1 D:2 H:3 K:1 |
| 15615 | F:3 |
| 15616 | A:1 |
| 15617 | B:2 |
| 15618 | F:1 K:1 |
| 15503 | K:3 |
| 15504 | H:1 |
| 15505 | H:1 |
| 15506 | K:1 |
| 15507 | F:1 |
| 15508 | K:1 |
| 15509 | K:1 |
| 15556 | H:4 |
| 15557 | C:26 |
| 15558 | A:1 C:24 |
| 15559 | C:1 |
| 15560 | J:4 |
| 15561 | I:2 |
| 15562 | F:3 K:9 |
| 15563 | A:2 |
| 15564 | F:13 |
| 15565 | F:1 K:1 |
| 15566 | F:5 K:2 |
| 15567 | A:7 |
| 15568 | A:34 B:8 |
| 15569 | I:2 |
| 15570 | F:3 |
| 15571 | F:1 K:1 |
| 15572 | K:2 |
| 15573 | A:17 B:53 C:55 D:4 F:3 H:25 J:3 K:1 |
| 15574 | K:3 |
| 15575 | H:2 |
| 15576 | A:2 |
| 15577 | F:1 K:3 |
| 15578 | K:4 |
| 15579 | A:1 |
| 15580 | I:2 |
| 15581 | H:2 |
| 15582 | I:2 |
| 15583 | A:2 |
| 15584 | H:2 |
| 15585 | D:1 |
| 15586 | F:1 K:12 |
| 15587 | K:1 |
| 15588 | C:21 |
| 15589 | A:1 |
| 15590 | K:2 |
| 15591 | K:3 |
| 15592 | B:3 |
| 15593 | F:2 K:1 |
| 15594 | H:29 |
| 15595 | C:1 H:1 |
| 15596 | C:5 |
| 15597 | B:2 |
| 15598 | F:1 H:1 |
| 15599 | H:1 |
| 15600 | A:5 |
| 15601 | I:1 |
| 15649 | F:1 K:1 |
| 15650 | A:1 H:1 |
| 15651 | B:1 C:32 H:1 |
| 15652 | B:1 |
| 15653 | D:1 |
| 15654 | B:1 |
| 15655 | B:1 |
| 15656 | B:1 |
| 15657 | F:4 K:11 |
| 15658 | A:5 B:4 C:8 D:3 F:1 H:8 K:1 |
| 15659 | D:1 F:6 K:25 |
| 15660 | C:1 |
| 15661 | K:2 |
| 15662 | A:4 |
| 15663 | A:4 |
| 15664 | A:1 |
| 15665 | F:1 K:1 |
| 15619 | F:1 K:2 |
| 15620 | D:1 |
| 15621 | A:2 |
| 15622 | K:2 |
| 15623 | C:1 H:5 |
| 15624 | K:1 |
| 15625 | K:1 |
| 15626 | K:1 |
| 15627 | K:3 |
| 15628 | A:2 |
| 15629 | F:1 K:2 |
| 15630 | H:1 K:1 |
| 15631 | B:6 |
| 15632 | A:2 |
| 15633 | H:3 |
| 15634 | F:1 K:1 |
| 15635 | K:2 |
| 15636 | K:3 |
| 15637 | F:1 K:1 |
| 15638 | I:2 |
| 15639 | C:4 H:1 K:1 |
| 15640 | C:75 |
| 15641 | F:2 |
| 15642 | F:1 K:1 |
| 15643 | C:16 |
| 15644 | F:1 |
| 15645 | K:1 |
| 15646 | B:2 |
| 15647 | K:2 |
| 15648 | F:1 |
| 15696 | F:1 |
| 15697 | K:2 |
| 15698 | H:4 |
| 15699 | F:1 |
| 15700 | K:1 |
| 15701 | F:1 |
| 15702 | K:2 |
| 15703 | I:2 |
| 15704 | F:5 K:2 |
| 15705 | A:2 C:7 J:1 |
| 15706 | C:1 |
| 15707 | K:1 |
| 15708 | C:1 |
| 15709 | H:2 |
| 15710 | H:4 |
| 15711 | A:19 B:70 C:72 D:4 F:3 H:37 I:3 K:1 |
| 15712 | H:4 |
| 15713 | I:1 |
| 15714 | F:3 |
| 15715 | A:5 |
| 15716 | A:1 |
| 15717 | A:1 C:2 |
| 15718 | C:3 |
| 15719 | A:2 |
| 15720 | H:1 |
| 15721 | F:4 K:5 |
| 15722 | A:1 C:1 H:2 |
| 15723 | H:1 |
| 15724 | K:1 |
| 15725 | A:1 |
| 15726 | K:3 |
| 15727 | B:2 |
| 15728 | I:2 |
| 15729 | D:1 |
| 15730 | A:4 B:1 |
| 15731 | A:3 H:1 |
| 15732 | C:1 |
| 15733 | H:2 |
| 15734 | B:1 C:1 |
| 15735 | H:2 |
| 15736 | F:3 |
| 15737 | B:1 |
| 15666 | K:2 |
| 15667 | H:1 |
| 15668 | B:1 |
| 15669 | H:1 |
| 15670 | F:3 |
| 15671 | F:1 |
| 15672 | K:1 |
| 15673 | F:2 |
| 15674 | F:3 |
| 15675 | B:3 |
| 15676 | A:2 I:3 H:1 |
| 15677 | K:6 |
| 15678 | F:7 K:17 |
| 15679 | A:4 |
| 15680 | H:2 |
| 15681 | H:2 |
| 15682 | B:4 |
| 15683 | A:2 |
| 15684 | F:2 |
| 15685 | H:23 |
| 15686 | H:1 |
| 15687 | H:2 I:1 |
| 15688 | H:3 |
| 15689 | A:1 |
| 15690 | F:2 K:1 |
| 15691 | F:3 K:1 |
| 15692 | B:1 |
| 15693 | K:3 |
| 15694 | F:1 H:2 |
| 15695 | K:1 |
| 15742 | H:2 |
| 15743 | F:3 K:1 |
| 15744 | |
| 15745 | C:1 H:2 |
| 15746 | C:11 |
| 15747 | C:38 H:154 I:1 |
| 15748 | A:15 B:46 C:53 D:8 F:4 H:28 J:3 K:2 |
| 15749 | B:1 |
| 15750 | C:1 |
| 15751 | C:1 |
| 15752 | C:1 |
| 15753 | C:1 |
| 15754 | C:1 |
| 15755 | C:1 |
| 15756 | C:1 |
| 15757 | C:1 |
| 15758 | C:1 |
| 15759 | C:1 |
| 15760 | B:1 |
| 15761 | H:1 |
| 15762 | C:1 |
| 15763 | H:1 |
| 15764 | C:1 |
| 15765 | C:1 |
| 15766 | C:1 |
| 15767 | C:1 |
| 15768 | C:1 |
| 15769 | C:1 |
| 15770 | C:1 |
| 15771 | C:1 |
| 15772 | C:1 |
| 15773 | C:1 |
| 15774 | C:1 |
| 15775 | C:1 |
| 15776 | C:1 |
| 15777 | H:1 |
| 15778 | C:1 |
| 15779 | C:1 |
| 15780 | C:1 |
| 15781 | C:1 |
| 15782 | C:1 |
| 15783 | C:1 |

TABLE V-continued

(Spatial distribution)

| Seq Id No. | Tissue distribution |
|---|---|
| 15738 | H:2 K:1 |
| 15739 | K:2 |
| 15740 | A:1 B:1 |
| 15741 | B:1 |
| 15788 | C:1 |
| 15789 | H:1 |
| 15790 | C:1 |
| 15791 | C:4 |
| 15792 | C:1 |
| 15793 | C:1 |
| 15794 | H:1 |
| 15795 | C:1 |
| 15796 | C:1 |
| 15797 | C:1 |
| 15798 | H:1 |
| 15799 | C:1 |
| 15800 | C:1 |
| 15801 | H:1 |
| 15802 | K:3 |
| 15803 | C:1 |
| 15804 | C:1 |
| 15805 | C:1 |
| 15806 | C:1 |
| 15807 | C:1 |
| 15808 | C:1 |
| 15809 | C:1 |
| 15810 | C:1 |
| 15811 | C:1 |
| 15812 | C:1 |
| 15813 | C:1 |
| 15814 | C:1 |
| 15815 | C:1 |
| 15816 | C:1 |
| 15817 | C:1 |
| 15818 | C:1 |
| 15819 | C:1 |
| 15820 | C:1 |
| 15821 | C:1 |
| 15822 | C:1 |
| 15823 | K:2 |
| 15824 | C:1 |
| 15825 | C:1 |
| 15826 | C:1 |
| 15827 | C:1 |
| 15828 | C:1 |
| 15829 | C:1 |
| 15830 | C:1 |
| 15831 | H:1 |
| 15832 | H:1 |
| 15833 | C:1 |
| 15834 | C:1 |
| 15835 | C:1 |
| 15836 | C:1 |
| 15837 | C:1 |
| 15838 | C:1 |
| 15839 | C:1 |
| 15840 | C:1 |
| 15841 | C:1 |
| 15842 | C:1 |
| 15843 | C:1 |
| 15844 | F:1 |
| 15845 | C:1 |
| 15846 | C:1 |
| 15847 | C:1 |
| 15848 | C:1 |
| 15849 | C:1 |
| 15850 | C:1 |
| 15851 | C:1 |
| 15852 | C:1 |
| 15853 | C:1 |
| 15854 | C:1 |
| 15855 | H:1 |
| 15856 | C:1 |
| 15857 | C:1 |
| 15858 | C:1 |
| 15859 | C:1 |
| 15860 | C:1 |
| 15861 | H:1 |
| 15862 | C:1 |
| 15863 | H:1 |
| 15864 | C:1 |
| 15865 | C:1 |
| 15866 | C:1 |
| 15867 | C:1 |
| 15868 | C:1 |
| 15869 | C:1 |
| 15870 | C:1 |
| 15871 | C:1 |
| 15872 | C:1 |
| 15873 | C:1 |
| 15874 | H:1 |
| 15875 | C:1 |
| 15876 | C:1 |
| 15877 | H:1 |
| 15878 | C:1 |
| 15879 | C:1 |
| 15880 | C:1 |
| 15881 | H:1 |
| 15882 | C:1 |
| 15883 | C:1 |
| 15884 | C:1 |
| 15885 | H:1 |
| 15886 | C:1 |
| 15887 | C:1 |
| 15888 | H:1 |
| 15889 | H:1 |
| 15890 | H:1 |
| 15891 | C:1 |
| 15892 | C:1 |
| 15893 | C:1 |
| 15894 | H:1 |
| 15895 | C:1 |
| 15896 | C:1 |
| 15897 | C:1 |
| 15898 | C:1 |
| 15899 | C:1 |
| 15900 | C:1 |
| 15901 | C:1 |
| 15902 | H:1 |
| 15903 | C:1 |
| 15784 | C:1 |
| 15785 | C:1 |
| 15786 | C:1 |
| 15787 | C:1 |
| 15929 | C:1 |
| 15930 | H:1 |
| 15931 | H:1 |
| 15932 | C:1 |
| 15933 | C:1 |
| 15934 | C:1 |
| 15935 | C:1 |
| 15936 | C:1 |
| 15937 | C:1 |
| 15938 | C:1 |
| 15939 | C:1 |
| 15940 | C:1 |
| 15941 | C:1 |
| 15942 | C:1 |
| 15943 | C:1 |
| 15944 | C:1 |
| 15945 | C:1 |
| 15946 | H:1 |
| 15947 | C:1 |
| 15948 | C:1 |
| 15949 | C:1 |
| 15950 | C:1 |
| 15904 | H:1 |
| 15905 | C:1 |
| 15906 | C:1 |
| 15907 | C:1 |
| 15908 | C:1 |
| 15909 | C:1 |
| 15910 | C:1 |
| 15911 | C:1 |
| 15912 | C:1 |
| 15913 | C:1 |
| 15914 | C:1 |
| 15915 | H:1 |
| 15916 | C:1 |
| 15917 | H:1 |
| 15918 | C:1 |
| 15919 | H:1 |
| 15920 | C:1 |
| 15921 | H:1 |
| 15922 | C:1 |
| 15923 | C:1 |
| 15924 | C:1 |
| 15925 | C:1 |
| 15926 | C:1 |
| 15927 | C:1 |
| 15928 | C:1 |
| 15976 | C:1 |
| 15977 | K:1 |
| 15978 | H:1 |
| 15979 | H:1 |
| 15980 | C:1 |
| 15981 | H:1 |
| 15982 | C:1 |
| 15983 | C:1 |
| 15984 | C:1 |
| 15985 | C:1 |
| 15986 | C:1 |
| 15987 | H:1 |
| 15988 | C:1 |
| 15989 | H:1 |
| 15990 | B:1 |
| 15991 | A:1 |
| 15992 | H:4 |
| 15993 | H:1 |
| 15994 | H:1 |
| 15995 | H:1 |
| 15996 | F:1 |
| 15997 | H:1 |
| 15998 | H:1 |
| 15999 | H:1 |
| 16000 | H:1 |
| 16001 | H:1 |
| 16002 | A:2 |
| 16003 | H:3 |
| 16004 | K:5 |
| 16005 | A:1 |
| 16006 | H:1 |
| 16007 | A:12 |
| 16008 | A:1 |
| 16009 | A:1 |
| 16010 | A:1 |
| 16011 | A:1 |
| 16012 | A:1 |
| 16013 | A:1 |
| 16014 | A:1 |
| 16015 | A:1 |
| 16016 | A:1 |
| 16017 | A:1 |
| 16018 | A:1 |
| 16019 | A:1 |
| 16020 | A:1 |
| 16021 | A:1 |
| 16022 | A:1 |
| 16070 | K:2 |
| 15951 | C:1 |
| 15952 | C:1 |
| 15953 | C:1 |
| 15954 | C:1 |
| 15955 | C:1 |
| 15956 | B:1 |
| 15957 | C:1 |
| 15958 | C:1 |
| 15959 | H:1 |
| 15960 | H:1 |
| 15961 | C:1 |
| 15962 | C:1 |
| 15963 | C:1 |
| 15964 | C:1 |
| 15965 | C:1 |
| 15966 | C:1 |
| 15967 | C:1 |
| 15968 | C:1 |
| 15969 | C:1 |
| 15970 | C:1 |
| 15971 | C:1 |
| 15972 | C:1 |
| 15973 | C:1 |
| 15974 | C:1 |
| 15975 | C:1 |
| 16023 | A:1 |
| 16024 | A:1 |
| 16025 | H:1 |
| 16026 | A:1 |
| 16027 | A:1 |
| 16028 | A:1 |
| 16029 | A:1 |
| 16030 | A:1 |
| 16031 | A:1 |
| 16032 | A:1 |
| 16033 | A:1 |
| 16034 | A:1 |
| 16035 | A:1 |
| 16036 | F:2 |
| 16037 | A:1 |
| 16038 | A:1 |
| 16039 | A:1 |
| 16040 | A:1 |
| 16041 | A:1 |
| 16042 | A:1 |
| 16043 | A:1 |
| 16044 | A:1 |
| 16045 | A:1 |
| 16046 | A:1 |
| 16047 | A:2 |
| 16048 | A:1 |
| 16049 | A:1 |
| 16050 | A:1 |
| 16051 | A:1 |
| 16052 | A:1 |
| 16053 | A:1 |
| 16054 | A:1 |
| 16055 | A:1 |
| 16056 | A:1 |
| 16057 | A:1 |
| 16058 | A:1 |
| 16059 | A:1 |
| 16060 | A:1 |
| 16061 | A:1 |
| 16062 | K:2 |
| 16063 | H:2 |
| 16064 | F:1 K:6 |
| 16065 | C:27 |
| 16066 | K:3 |
| 16067 | A:1 I:1 |
| 16068 | B:2 |
| 16069 | K:2 |
| 16117 | F:1 K:6 |

TABLE V-continued

(Spatial distribution)

| Seq Id No. | Tissue distribution | Seq Id No. | Tissue distribution |
|---|---|---|---|
| 16071 | A:5 | 16118 | K:1 |
| 16072 | A:1 F:3 H:10 I:10 K:1 | 16119 | H:2 |
| 16073 | A:4 B:1 | 16120 | H:1 |
| 16074 | B:3 | 16121 | K:2 |
| 16075 | K:2 | 16122 | H:1 |
| 16076 | F:7 | 16123 | B:2 |
| 16077 | F:1 | 16124 | B:2 |
| 16078 | F:1 K:1 | 16125 | H:1 |
| 16079 | B:2 | 16126 | C:1 |
| 16080 | K:1 | 16127 | H:58 |
| 16081 | K:1 | 16128 | H:1 |
| 16082 | K:1 | 16129 | H:1 |
| 16083 | F:8 K:2 | 16130 | H:1 |
| 16084 | H:2 | 16131 | H:1 |
| 16085 | H:3 | 16132 | H:1 |
| 16086 | H:2 | 16133 | H:1 |
| 16087 | F:1 K:2 | 16134 | H:1 |
| 16088 | A:3 | 16135 | H:1 |
| 16089 | D:2 | 16136 | H:1 |
| 16090 | K:1 | 16137 | H:1 |
| 16091 | B:3 C:40 | 16138 | H:1 |
| 16092 | C:1 | 16139 | H:1 |
| 16093 | C:1 | 16140 | H:1 |
| 16094 | K:5 | 16141 | H:1 |
| 16095 | B:2 C:1 D:1 | 16142 | H:1 |
| 16096 | F:1 | 16143 | H:1 |
| 16097 | H:1 | 16144 | H:1 |
| 16098 | F:1 K:1 | 16145 | H:1 |
| 16099 | K:1 | 16146 | C:2 |
| 16100 | K:1 | 16147 | K:1 |
| 16101 | E:1 | 16148 | H:1 |
| 16102 | C:3 | 16149 | I:1 |
| 16103 | F:3 | 16150 | A:1 C:1 |
| 16104 | K:2 | 16151 | B:6 C:100 |
| 16105 | C:4 | 16152 | C:1 |
| 16106 | A:4 | 16153 | F:20 K:102 |
| 16107 | F:1 K:2 | 16154 | F:1 K:2 |
| 16108 | B:1 | 16155 | K:1 |
| 16109 | B:1 | 16156 | B:1 |
| 16110 | B:1 | 16157 | K:2 |
| 16111 | B:1 | 16158 | D:2 |
| 16112 | H:4 | 16159 | F:3 H:1 |
| 16113 | K:2 | 16160 | A:2 |
| 16114 | K:1 | 16161 | A:1 |
| 16115 | K:1 | 16162 | A:1 |
| 16116 | K:4 | 16163 | A:1 |
| 16164 | A:1 | 16211 | B:2 |
| 16165 | A:1 | 16212 | D:1 K:1 |
| 16166 | A:1 | 16213 | F:3 |
| 16167 | A:1 | 16214 | B:2 |
| 16168 | A:8 | 16215 | K:1 |
| 16169 | B:2 | 16216 | C:1 |
| 16170 | F:3 K:1 | 16217 | K:1 |
| 16171 | A:1 B:2 | 16218 | D:1 |
| 16172 | B:6 | 16219 | B:1 |
| 16173 | F:2 | 16220 | K:2 |
| 16174 | H:2 | 16221 | B:4 |
| 16175 | H:1 | 16222 | H:3 |
| 16176 | F:1 K:1 | 16223 | I:3 |
| 16177 | H:1 | 16224 | K:4 |
| 16178 | F:2 | 16225 | D:1 |
| 16179 | A:2 I:1 | 16226 | K:1 |
| 16180 | A:1 | 16227 | K:1 |
| 16181 | K:2 | 16228 | K:3 |
| 16182 | F:3 K:23 | 16229 | K:4 |
| 16183 | K:2 | 16230 | F:8 K:3 |
| 16184 | K:2 | 16231 | H:19 |
| 16185 | A:1 C:43 | 16232 | H:3 |
| 16186 | C:2 | 16233 | K:1 |
| 16187 | B:4 | 16234 | F:1 |
| 16188 | D:1 | 16235 | A:3 |
| 16189 | B:1 | 16236 | C:4 H:2 |
| 16190 | D:1 | 16237 | A:98 F:2 K:2 |
| 16191 | F:18 K:4 | 16238 | A:488 |
| 16192 | F:18 K:4 | 16239 | A:1 |
| 16193 | F:2 | 16240 | A:1 |
| 16194 | B:1 | 16241 | F:13 K:5 |
| 16195 | K:1 | 16242 | H:14 |
| 16196 | A:3 | 16243 | F:9 K:16 |
| 16197 | C:1 | 16244 | A:2 |
| 16198 | C:1 | 16245 | K:2 |
| 16199 | C:1 | 16246 | F:2 K:2 |
| 16200 | C:1 | 16247 | D:2 |
| 16201 | C:1 | 16248 | A:11 B:10 C:16 D:2 E:1 F:241 H:6 I:13 K:62 |
| 16202 | C:1 | | |
| 16203 | C:1 | 16249 | F:1 |
| 16204 | C:1 | 16250 | K:1 |
| 16205 | C:1 | 16251 | K:1 |
| 16206 | C:1 | 16252 | A:1 |
| 16207 | A:1 B:2 | 16253 | F:1 |
| 16208 | H:1 | 16254 | K:1 |
| 16209 | B:1 | 16255 | K:1 |
| 16210 | B:3 | 16256 | K:1 |
| 16257 | K:1 | 16304 | B:1 |
| 16258 | H:1 | 16305 | I:1 |
| 16259 | F:1 | 16306 | A:1 |
| 16260 | K:1 | 16307 | D:1 H:1 |
| 16261 | F:1 | 16308 | H:3 |
| 16262 | K:1 | 16309 | F:2 K:1 |
| 16263 | B:2 | 16310 | B:2 |
| 16264 | B:6 | 16311 | B:5 |
| 16265 | B:2 | 16312 | C:28 |
| 16266 | H:2 | 16313 | C:1 |
| 16267 | F:1 | 16314 | A:1 |
| 16268 | A:1 | 16315 | H:5 |
| 16269 | A:2 | 16316 | H:1 |
| 16270 | C:2 | 16317 | H:1 |
| 16271 | C:3 | 16318 | H:1 |
| 16272 | A:2 | 16319 | H:1 |
| 16273 | K:1 | 16320 | H:1 |
| 16274 | F:1 K:1 | 16321 | H:1 |
| 16275 | A:2 | 16322 | H:1 |
| 16276 | C:5 | 16323 | H:1 |
| 16277 | H:23 | 16324 | H:1 |
| 16278 | F:2 | 16325 | K:2 |
| 16279 | B:1 | 16326 | A:1 |
| 16280 | D:1 | 16327 | C:7 K:2 |
| 16281 | D:1 | 16328 | C:2 K:3 |
| 16282 | F:2 | 16329 | K:2 |
| 16283 | D:1 | 16330 | H:1 |
| 16284 | D:1 | 16331 | F:1 |
| 16285 | B:2 | 16332 | A:2 B:3 C:35 D:1 H:1 I:3 K:3 |
| 16286 | B:1 | 16333 | K:2 |
| 16287 | B:2 | 16334 | B:2 |
| 16288 | K:1 | 16335 | B:2 |
| 16289 | K:1 | 16336 | F:5 |
| 16290 | K:1 | 16337 | F:4 K:1 |
| 16291 | F:1 | 16338 | F:5 |
| 16292 | F:1 | 16339 | F:1 |
| 16293 | F:1 | 16340 | F:1 |
| 16294 | K:1 | 16341 | F:1 |
| 16295 | F:1 | 16342 | F:1 |
| 16296 | H:2 | 16343 | F:1 |
| 16297 | F:1 K:1 | 16344 | F:1 |
| 16298 | F:1 | 16345 | F:1 |
| 16299 | F:4 | 16346 | K:3 |
| 16300 | K:2 | 16347 | K:1 |
| 16301 | F:1 H:2 | 16348 | F:2 |
| 16302 | F:3 K:41 | 16349 | K:1 |
| 16303 | K:2 | 16350 | K:1 |
| 16351 | B:7 C:28 D:1 H:1 K:1 | 16397 | A:1 D:1 |
| 16352 | B:11 C:58 D:1 H:1 K:1 | 16398 | C:1 |
| 16353 | B:1 | 16399 | A:2 C:1 |

TABLE V-continued (Spatial distribution)

| Seq Id No. | Tissue distribution | Seq Id No. | Tissue distribution |
|---|---|---|---|
| 16354 | A:1 B:4 C:4 H:2 | 16400 | A:1 |
| 16355 | B:10 C:6 H:2 | 16401 | A:1 C:1 |
| 16356 | K:1 | 16402 | A:8 |
| 16357 | A:1 | 16403 | K:2 |
| 16358 | H:2 | 16404 | A:2 |
| 16359 | H:5 | 16405 | C:1 |
| 16360 | K:3 | 16406 | C:1 |
| 16361 | B:1 C:1 | 16407 | B:1 |
| 16362 | C:1 | 16408 | B:1 |
| 16363 | A:2 | 16409 | B:1 |
| 16364 | B:2 | 16410 | D:1 H:2 I:6 |
| 16365 | A:2 | 16411 | B:2 D:1 H:1 J:346 |
| 16366 | F:1 | 16412 | J:17 |
| 16367 | K:2 | 16413 | H:1 |
| 16368 | B:10 C:7 | 16414 | C:1 |
| 16369 | D:1 H:1 | 16415 | J:1 |
| 16370 | F:2 K:1 | 16416 | J:1 |
| 16371 | H:2 | 16417 | J:1 |
| 16372 | C:10 D:2 F:1 H:1 K:1 | 16418 | J:1 |
| 16373 | C:1 | 16419 | C:1 |
| 16374 | C:5 | 16420 | J:1 |
| 16375 | H:1 | 16421 | J:1 |
| 16376 | F:7 | 16422 | A:2 |
| 16377 | K:1 | 16423 | H:3 |
| 16378 | H:4 | 16424 | C:1 |
| 16379 | H:2 | 16425 | F:1 K:1 |
| 16380 | K:2 | 16426 | F:1 |
| 16381 | C:1 | 16427 | F:1 K:1 |
| 16382 | F:10 K:5 | 16428 | F:1 |
| 16383 | A:3 | 16429 | F:1 |
| 16384 | F:2 | 16430 | F:1 |
| 16385 | K:4 | 16431 | F:1 |
| 16386 | A:4 | 16432 | F:1 |
| 16387 | H:2 | 16433 | K:1 |
| 16388 | K:2 | 16434 | F:1 |
| 16389 | C:8 | 16435 | F:1 |
| 16390 | A:2 | 16436 | K:6 |
| 16391 | K:1 | 16437 | K:1 |
| 16392 | C:1 | 16438 | K:1 |
| 16393 | A:16 B:13 C:44 | 16439 | C:3 D:2 F:1 |
| 16394 | B:1 | 16440 | H:1 |
| 16395 | A:5 | 16441 | A:1 |
| 16396 | A:15 B:14 C:17 D:9 H:6 I:1 J:4 K:2 | 16442 | H:1 |
| 16444 | K:2 | 16443 | F:1 K:3 |
| 16445 | B:4 | 16491 | F:1 |
| 16446 | A:3 | 16492 | F:1 |
| 16447 | H:2 | 16493 | B:1 |
| 16448 | A:1 C:3 I:1 | 16494 | F:1 |
| 16449 | B:6 D:1 H:1 | 16495 | F:1 |
| 16450 | A:1 | 16496 | F:1 |
| 16451 | J:2 | 16497 | F:3 K:29 |
| 16452 | B:2 C:6 J:1 | 16498 | K:4 |
| 16453 | C:8 J:1 | 16499 | K:1 |
| 16454 | D:1 | 16500 | K:1 |
| 16455 | C:1 | 16501 | K:1 |
| 16456 | A:1 | 16502 | F:2 |
| 16457 | C:1 | 16503 | B:6 C:1 |
| 16458 | K:1 | 16504 | B:1 |
| 16459 | F:1 K:1 | 16505 | H:1 |
| 16460 | F:2 K:3 | 16506 | B:1 H:1 |
| 16461 | A:6 K:1 | 16507 | K:3 |
| 16462 | B:2 C:2 | 16508 | A:4 |
| 16463 | A:1 B:1 | 16509 | H:1 |
| 16464 | K:1 | 16510 | D:1 |
| 16465 | F:1 | 16511 | A:8 |
| 16466 | A:2 | 16512 | C:1 |
| 16467 | A:2 | 16513 | A:2 |
| 16468 | I:1 | 16514 | K:1 |
| 16469 | I:1 | 16515 | K:1 |
| 16470 | B:1 H:1 | 16516 | K:1 |
| 16471 | A:11 B:3 C:7 D:1 I:2 | 16517 | A:3 |
| 16472 | B:1 | 16518 | I:3 |
|  |  | 16519 | F:1 K:2 |
| 16473 | C:3 | 16520 | K:1 |
| 16474 | B:1 F:1 | 16521 | C:3 |
| 16475 | A:1 | 16522 | C:1 |
| 16476 | B:1 | 16523 | F:1 K:1 |
| 16477 | B:5 C:96 | 16524 | H:1 |
| 16478 | C:1 | 16525 | K:4 |
| 16479 | C:1 | 16526 | F:1 K:4 |
| 16480 | C:1 | 16527 | K:1 |
| 16481 | C:1 | 16528 | A:1 |
| 16482 | C:1 | 16529 | K:7 |
| 16483 | C:1 | 16530 | A:1 |
| 16484 | K:2 | 16531 | A:1 |
| 16485 | C:1 | 16532 | K:1 |
| 16486 | C:1 | 16533 | K:1 |
| 16487 | C:1 | 16534 | F:2 K:1 |
| 16488 | A:3 B:1 C:7 F:6 H:2 K:8 | 16535 | F:1 |
| 16489 | F:1 | 16536 | F:1 |
| 16490 | A:1 | 16537 | F:1 |
| 16538 | F:1 | 16585 | C:3 |
| 16539 | F:1 | 16586 | H:2 K:1 |
| 16540 | F:1 | 16587 | K:1 |
| 16541 | F:1 | 16588 | K:1 |
| 16542 | F:1 | 16589 | F:4 K:1 |
| 16543 | F:1 | 16590 | H:2 |
| 16544 | F:1 | 16591 | F:3 K:1 |
| 16545 | F:1 | 16592 | A:1 B:1 |
| 16546 | F:1 | 16593 | B:2 |
| 16547 | F:1 | 16594 | H:1 |
| 16548 | K:1 | 16595 | B:3 |
| 16549 | C:1 | 16596 | H:2 |
| 16550 | K:1 | 16597 | F:4 K:23 |
| 16551 | K:1 | 16598 | F:1 K:5 |
| 16552 | K:1 | 16599 | A:5 B:2 |
| 16553 | K:1 | 16600 | H:2 |
| 16554 | A:3 | 16601 | H:2 |
| 16555 | K:1 | 16602 | H:3 |
| 16556 | K:1 | 16603 | F:11 K:2 |
| 16557 | K:1 | 16604 | F:1 K:1 |
| 16558 | K:1 | 16605 | B:4 H:1 |
| 16559 | K:1 | 16606 | K:1 |
| 16560 | H:2 | 16607 | C:1 |
| 16561 | A:1 B:2 | 16608 | D:1 |
| 16562 | K:1 | 16609 | I:1 |
| 16563 | B:1 K:1 | 16610 | K:1 |
| 16564 | B:2 | 16611 | K:1 |
| 16565 | A:2 B:2 | 16612 | H:2 |
| 16566 | H:2 | 16613 | F:2 |
| 16567 | A:3 | 16614 | B:1 K:1 |
| 16568 | D:2 | 16615 | B:1 F:3 K:1 |
| 16569 | H:1 | 16616 | H:2 |
| 16570 | C:1 | 16617 | H:2 |
| 16571 | C:4 | 16618 | F:9 K:3 |
| 16572 | K:2 | 16619 | A:1 |
| 16573 | C:2 | 16620 | D:1 |
| 16574 | A:4 B:3 I:1 | 16621 | K:2 |
| 16575 | A:1 | 16622 | C:5 |
| 16576 | B:4 | 16623 | C:2 |
| 16577 | B:4 | 16624 | A:2 |
| 16578 | B:1 | 16625 | F:1 K:3 |
| 16579 | B:2 | 16626 | F:1 K:1 |
| 16580 | K:2 | 16627 | A:10 |
| 16581 | F:1 | 16628 | H:5 |
| 16582 | C:5 | 16629 | H:1 |
| 16583 | A:4 | 16630 | K:1 |
| 16584 | H:1 | 16631 | K:1 |
| 16632 | B:1 | 16679 | C:7 |
| 16633 | F:2 K:1 | 16680 | B:1 |
| 16634 | A:7 | 16681 | K:7 |
| 16635 | H:2 | 16682 | F:1 K:3 |
| 16636 | B:1 | 16683 | F:11 K:2 |
| 16637 | F:3 | 16684 | F:27 K:2 |
| 16638 | A:2 | 16685 | F:1 |
| 16639 | B:2 | 16686 | F:1 |

TABLE V-continued (Spatial distribution)

| Seq Id No. | Tissue distribution | Seq Id No. | Tissue distribution |
|---|---|---|---|
| 16640 | A:2 | 16687 | F:1 |
| 16641 | F:1 K:1 | 16688 | F:1 |
| 16642 | F:2 | 16689 | F:1 |
| 16643 | B:1 C:9 | 16690 | F:1 |
| 16644 | F:4 K:1 | 16691 | F:1 |
| 16645 | F:2 | 16692 | K:1 |
| 16646 | K:1 | 16693 | K:1 |
| 16647 | H:1 | 16694 | K:1 |
| 16648 | C:2 | 16695 | F:1 |
| 16649 | F:1 | 16696 | F:1 |
| 16650 | F:1 | 16697 | I:2 |
| 16651 | F:3 | 16698 | F:1 K:3 |
| 16652 | K:3 | 16699 | K:2 |
| 16653 | F:3 K:7 | 16700 | F:1 K:6 |
| 16654 | A:5 | 16701 | A:2 |
| 16655 | B:2 | 16702 | F:11 |
| 16656 | K:2 | 16703 | K:2 |
| 16657 | A:5 B:19 C:13 D:6 F:1 H:1 J:2 | 16704 | A:4 |
| 16658 | C:1 | 16705 | H:1 |
| 16659 | F:1 K:2 | 16706 | H:1 |
| 16660 | F:4 | 16707 | K:1 |
| 16661 | C:4 | 16708 | C:1 |
| 16662 | I:2 | 16709 | A:2 F:8 K:5 |
| 16663 | H:1 I:2 | 16710 | H:1 |
| 16664 | I:1 | 16711 | H:1 |
| 16665 | A:1 I:2 | 16712 | K:1 |
| 16666 | A:1 | 16713 | C:1 |
| 16667 | C:6 | 16714 | H:1 |
| 16668 | B:2 | 16715 | A:4 |
| 16669 | B:1 | 16716 | F:2 K:1 |
| 16670 | F:1 K:5 | 16717 | B:2 |
| 16671 | F:1 K:6 | 16718 | A:8 |
| 16672 | K:1 | 16719 | H:1 |
| 16673 | K:1 | 16720 | D:1 |
| 16674 | H:11 | 16721 | F:1 |
| 16675 | B:1 K:1 | 16722 | F:3 K:11 |
| 16676 | F:1 K:1 | 16723 | K:2 |
| 16677 | B:1 | 16724 | K:1 |
| 16678 | B:1 | 16725 | K:1 |
| 16819 | H:1 | 16866 | I:3 |
| 16820 | C:4 | 16867 | F:31 K:9 |
| 16821 | B:2 | 16868 | F:2 |
| 16822 | B:5 | 16869 | F:1 |
| 16823 | H:2 | 16870 | F:1 |
| 16824 | A:2 B:1 F:1 H:2 K:2 | 16871 | K:1 |
| 16825 | F:1 | 16872 | F:1 |
| 16826 | F:1 H:1 | 16873 | K:1 |
| 16827 | H:1 | 16874 | K:2 |
| 16828 | K:2 | 16875 | K:2 |
| 16829 | A:1 | 16876 | K:2 |
| 16830 | B:2 | 16877 | F:2 |
| 16831 | K:1 | 16878 | F:11 K:51 |
| 16832 | K:1 | 16879 | K:1 |
| 16833 | K:1 | 16880 | A:1 C:5 H:2 K:1 |
| 16834 | K:1 | 16881 | H:1 K:1 |
| 16835 | K:1 | 16882 | H:4 |
| 16836 | H:1 | 16883 | K:2 |
| 16837 | F:1 | 16884 | C:4 J:2 |
| 16838 | B:3 | 16885 | F:1 K:2 |
| 16839 | F:1 K:8 | 16886 | A:3 |
| 16840 | K:3 | 16887 | A:21 |
| 16841 | B:3 | 16888 | D:1 H:1 |
| 16842 | K:1 | 16889 | K:2 |
| 16843 | C:1 | 16890 | A:1 B:1 D:1 H:2 |
| 16844 | A:2 | 16891 | F:2 K:2 |
| 16845 | F:2 K:3 | 16892 | H:2 |
| 16846 | H:3 | 16893 | A:1 |
| 16847 | A:4 | 16894 | A:2 |
| 16848 | K:2 | 16895 | H:2 |
| 16849 | H:5 | 16896 | K:4 |
| 16850 | F:1 K:1 | 16897 | C:1 |
| 16851 | A:1 I:1 | 16898 | K:5 |
| 16852 | K:1 | 16899 | A:6 |
| 16853 | B:4 C:3 H:2 | 16900 | A:2 |
| 16854 | A:1 | 16901 | C:1 H:4 |
| 16855 | B:2 | 16902 | K:3 |
| 16856 | A:2 | 16903 | F:1 |
| 16857 | B:2 | 16904 | C:4 |
| 16858 | K:1 | 16905 | J:49 |
| 16859 | C:6 | 16906 | I:2 |
| 16860 | A:3 | 16907 | C:1 |
| 16861 | A:2 | 16908 | B:3 |
| 16862 | H:1 | 16909 | B:3 |
| 16863 | K:2 | 16910 | F:4 |
| 16864 | F:1 I:1 | 16911 | H:2 |
| 16865 | C:38 | 16912 | K:2 |
| 16913 | K:2 | 16960 | C:1 |
| 16914 | H:2 | 16961 | C:1 |
| 16915 | F:4 | 16962 | C:1 |
| 16916 | A:6 | 16963 | C:1 |
| 16917 | F:9 K:2 | 16964 | C:1 |
| 16918 | B:1 | 16965 | D:1 |
| 16919 | H:2 | 16966 | C:1 |
| 16920 | A:2 | 16967 | C:1 |
| 16921 | K:1 | 16968 | C:1 |
| 16922 | A:1 | 16969 | C:1 |
| 16923 | C:1 | 16970 | C:1 |
| 16924 | F:3 | 16971 | C:1 |
| 16925 | B:1 C:10 | 16972 | C:1 |
| 16926 | C:1 | 16973 | C:1 |
| 16927 | C:1 | 16974 | C:1 |
| 16928 | C:1 | 16975 | C:1 |
| 16929 | B:1 | 16976 | C:1 |
| 16930 | A:1 | 16977 | C:1 |
| 16931 | B:1 | 16978 | C:1 |
| 16932 | C:1 | 16979 | C:1 |
| 16933 | F:1 | 16980 | C:1 |
| 16934 | C:1 | 16981 | C:1 |
| 16935 | C:1 | 16982 | C:1 |
| 16936 | C:1 | 16983 | D:1 |
| 16937 | B:1 | 16984 | C:1 |
| 16938 | C:1 | 16985 | B:1 |
| 16939 | C:1 | 16986 | C:1 |
| 16940 | C:1 | 16987 | C:1 |
| 16941 | C:1 | 16988 | C:1 |
| 16942 | C:1 | 16989 | H:1 |
| 16943 | C:1 | 16990 | C:1 |
| 16944 | C:1 | 16991 | C:1 |
| 16945 | C:1 | 16992 | J:1 |
| 16946 | C:1 | 16993 | C:1 |
| 16947 | K:3 | 16994 | C:1 |
| 16948 | A:1 C:1 | 16995 | C:1 |
| 16949 | C:1 | 16996 | C:1 |
| 16950 | C:1 | 16997 | C:1 |
| 16951 | C:1 | 16998 | C:1 |
| 16952 | C:1 | 16999 | C:1 |
| 16953 | J:1 | 17000 | H:4 |
| 16954 | C:1 | 17001 | C:1 |
| 16955 | C:1 | 17002 | C:1 |
| 16956 | C:1 | 17003 | C:1 |
| 16957 | B:1 | 17004 | B:1 |
| 16958 | C:1 | 17005 | C:1 |
| 16959 | B:1 C:1 H:19 J:3 | 17006 | C:1 |
| 17007 | C:1 | 17054 | K:1 |
| 17008 | C:1 | 17055 | B:1 |
| 17009 | C:1 | 17056 | J:1 |
| 17010 | C:1 | 17057 | B:1 |
| 17011 | H:4 | 17058 | C:1 |
| 17012 | B:1 | 17059 | C:1 |
| 17013 | H:1 | 17060 | C:1 |
| 17014 | C:1 | 17061 | C:1 |
| 17015 | C:1 | 17062 | C:1 |
| 17016 | C:1 | 17063 | C:1 |
| 17017 | C:1 | 17064 | C:1 |
| 17018 | B:1 | 17065 | B:4 C:1 |

TABLE V-continued

(Spatial distribution)

| Seq Id No. | Tissue distribution | Seq Id No. | Tissue distribution |
|---|---|---|---|
| 17019 | C:1 | 17066 | C:1 |
| 17020 | B:1 | 17067 | D:1 |
| 17021 | C:1 | 17068 | C:1 |
| 17022 | C:1 | 17069 | C:1 |
| 17023 | C:1 | 17070 | C:1 |
| 17024 | C:1 | 17071 | D:1 |
| 17025 | B:1 | 17072 | C:1 |
| 17026 | C:1 | 17073 | C:1 |
| 17027 | C:1 | 17074 | C:1 |
| 17028 | C:1 | 17075 | C:1 |
| 17029 | C:1 | 17076 | C:3 |
| 17030 | C:1 | 17077 | C:1 |
| 17031 | C:1 | 17078 | C:1 |
| 17032 | K:2 | 17079 | C:1 |
| 17033 | C:1 | 17080 | C:1 |
| 17034 | C:1 | 17081 | C:1 |
| 17035 | C:1 | 17082 | C:1 |
| 17036 | C:1 | 17083 | C:1 |
| 17037 | C:1 | 17084 | K:2 |
| 17038 | C:1 | 17085 | B:4 |
| 17039 | B:1 | 17086 | F:4 |
| 17040 | C:1 | 17087 | A:2 |
| 17041 | C:1 | 17088 | A:1 |
| 17042 | C:1 | 17089 | A:2 |
| 17043 | A:2 | 17090 | K:1 |
| 17044 | C:1 | 17091 | A:3 C:1 F:1 I:1 |
| 17045 | C:1 | 17092 | K:2 |
| 17046 | C:1 | 17093 | K:2 |
| 17047 | C:1 | 17094 | B:3 |
| 17048 | C:1 | 17095 | F:1 |
| 17049 | H:1 | 17096 | F:1 |
| 17050 | B:1 | 17097 | F:1 |
| 17051 | J:1 | 17098 | F:5 K:1 |
| 17052 | C:1 | 17099 | C:2 |
| 17053 | C:1 | 17100 | B:1 D:1 H:1 |
| 17101 | H:11 | 17148 | C:1 |
| 17102 | A:7 | 17149 | C:1 |
| 17103 | H:1 | 17150 | K:4 |
| 17104 | K:1 | 17151 | C:1 |
| 17105 | K:2 | 17152 | A:15 |
| 17106 | H:2 | 17153 | B:2 |
| 17107 | K:2 | 17154 | C:4 F:1 |
| 17108 | F:2 | 17155 | K:2 |
| 17109 | C:1 | 17156 | C:3 |
| 17110 | F:3 K:1 | 17157 | F:2 K:1 |
| 17111 | H:1 | 17158 | B:2 |
| 17112 | A:2 | 17159 | K:1 |
| 17113 | K:2 | 17160 | K:1 |
| 17114 | A:1 | 17161 | H:2 |
| 17115 | A:1 | 17162 | F:2 K:3 |
| 17116 | K:1 | 17163 | K:3 |
| 17117 | H:9 | 17164 | I:4 |
| 17118 | C:9 | 17165 | C:1 |
| 17119 | B:1 H:1 | 17166 | F:6 K:17 |
| 17120 | C:1 | 17167 | F:7 K:30 |
| 17121 | C:2 | 17168 | K:1 |
| 17122 | F:1 K:1 | 17169 | K:1 |
| 17123 | C:13 | 17170 | F:6 K:13 |
| 17124 | A:1 | 17171 | F:1 K:8 |
| 17125 | F:1 K:4 | 17172 | K:1 |
| 17126 | K:1 | 17173 | K:1 |
| 17127 | K:3 | 17171 | F:2 |
| 17128 | K:2 | 17175 | F:2 |
| 17129 | A:7 | 17176 | C:8 H:1 |
| 17130 | F:3 K:1 | 17177 | K:2 |
| 17131 | I:2 K:1 | 17178 | F:42 K:13 |
| 17132 | A:2 | 17179 | F:1 K:1 |
| 17133 | C:11 | 17180 | K:2 |
| 17134 | F:2 K:1 | 17181 | B:2 |
| 17135 | A:2 | 17182 | K:1 |
| 17136 | F:1 | 17183 | K:1 |
| 17137 | K:3 | 17184 | K:1 |
| 17138 | K:2 | 17185 | K:1 |
| 17139 | C:6 J:1 | 17186 | K:1 |
| 17140 | K:1 | 17187 | K:1 |
| 17141 | K:3 | 17188 | K:1 |
| 17142 | K:1 | 17189 | K:2 |
| 17143 | C:67 | 17190 | H:2 |
| 17144 | C:1 | 17191 | K:2 |
| 17145 | C:1 | 17192 | K:3 |
| 17146 | C:1 | 17193 | F:2 K:7 |
| 17147 | C:1 | 17194 | F:1 K:8 |
| 17195 | C:8 | 17242 | I:2 |
| 17196 | B:2 | 17243 | K:2 |
| 17197 | F:7 K:17 | 17244 | B:2 |
| 17198 | F:32 K:6 | 17245 | A:1 D:1 F:1 H:1 I:1 |
| 17199 | C:1 | 17246 | K:1 |
| 17200 | B:1 | 17247 | B:2 |
| 17201 | F:16 K:3 | 17248 | B:1 H:1 |
| 17202 | H:1 | 17249 | K:3 |
| 17203 | A:2 | 17250 | H:2 |
| 17204 | A:3 | 17251 | F:3 K:1 |
| 17205 | C:5 | 17252 | C:1 |
| 17206 | C:15 | 17253 | C:4 |
| 17207 | K:2 | 17254 | H:1 K:1 |
| 17208 | F:1 K:1 | 17255 | B:3 |
| 17209 | F:1 | 17256 | A:1 H:1 |
| 17210 | I:1 | 17257 | F:1 H:2 K:1 |
| 17211 | B:3 | 17258 | C:1 F:1 H:2 |
| 17212 | F:1 K:1 | 17259 | B:2 |
| 17213 | F:1 | 17260 | F:2 |
| 17214 | I:1 | 17261 | A:1 |
| 17215 | H:2 | 17262 | F:1 K:1 |
| 17216 | K:2 | 17263 | F:1 K:3 |
| 17217 | A:1 D:1 | 17264 | H:5 |
| 17218 | C:3 | 17265 | A:2 |
| 17219 | C:8 | 17266 | C:2 J:29 |
| 17220 | C:8 J:1 | 17267 | K:9 |
| 17221 | A:1 B:4 C:1 | 17268 | C:3 F:6 K:49 |
| 17222 | A:1 B:3 C:1 D:1 | 17269 | C:3 F:12 K:112 |
| 17223 | H:1 | 17270 | H:3 K:3 |
| 17224 | F:19 K:9 | 17271 | K:1 |
| 17225 | F:1 K:1 | 17272 | H:1 |
| 17226 | F:1 K:2 | 17273 | B:1 |
| 17227 | F:19 | 17274 | K:2 |
| 17228 | C:2 | 17275 | B:2 |
| 17229 | B:1 | 17276 | I:1 |
| 17230 | K:2 | 17277 | H:1 |
| 17231 | C:18 | 17278 | F:1 K:2 |
| 17232 | D:1 | 17279 | F:2 |
| 17233 | D:1 | 17280 | A:2 C:5 |
| 17234 | C:1 | 17281 | B:3 |
| 17235 | C:1 | 17282 | K:2 |
| 17236 | H:2 | 17283 | H:1 K:1 |
| 17237 | F:3 K:2 | 17284 | K:4 |
| 17238 | A:1 H:1 I:2 K:1 | 17285 | H:1 |
| 17239 | H:2 | 17286 | C:1 |
| 17240 | F:2 | 17287 | B:1 C:1 |
| 17241 | K:2 | 17288 | B:2 |
| 17289 | B:3 | 17336 | K:1 |
| 17290 | F:1 K:1 | 17337 | H:3 |
| 17291 | K:1 | 17338 | D:2 |
| 17292 | K:1 | 17339 | K:2 |
| 17293 | A:3 | 17340 | F:10 K:4 |
| 17294 | C:1 | 17341 | K:2 |
| 17295 | B:1 | 17342 | A:1 B:1 |
| 17296 | B:1 | 17343 | F:12 K:5 |
| 17297 | B:1 | 17344 | F:1 |
| 17298 | A:3 | 17345 | B:2 |
| 17299 | H:1 | 17346 | H:1 |
| 17300 | A:11 B:5 C:1 D:1 H:2 I:1 | 17347 | C:2 D:1 |
| 17301 | A:4 B:3 | 17348 | A:3 C:1 |
| 17302 | K:2 | 17349 | A:5 B:1 K:1 |
| 17303 | K:1 | 17350 | C:36 |
| 17304 | B:2 | 17351 | C:99 |
| 17305 | B:2 | 17352 | B:4 |

TABLE V-continued (Spatial distribution)

| Seq Id No. | Tissue distribution | Seq Id No. | Tissue distribution |
|---|---|---|---|
| 17306 | K:2 | 17353 | K:2 |
| 17307 | K:2 | 17354 | F:6 |
| 17308 | A:13 | 17355 | H:2 |
| 17309 | K:2 | 17356 | C:1 F:8 |
| 17310 | H:1 | 17357 | F:12 K:3 |
| 17311 | H:1 | 17358 | B:2 |
| 17312 | H:1 | 17359 | F:1 K:4 |
| 17313 | H:1 | 17360 | H:3 |
| 17314 | F:3 | 17361 | K:2 |
| 17315 | F:1 H:1 | 17362 | K:1 |
| 17316 | F:1 K:11 | 17363 | A:3 |
| 17317 | F:4 K:2 | 17364 | F:2 K:2 |
| 17318 | H:21 | 17365 | F:1 K:2 |
| 17319 | B:4 | 17366 | C:1 |
| 17320 | F:2 | 17367 | A:3 |
| 17321 | H:2 | 17368 | A:1 B:2 |
| 17322 | H:2 | 17369 | A:1 B:3 D:1 |
| 17323 | H:1 | 17370 | A:5 |
| 17324 | B:2 | 17371 | H:1 |
| 17325 | B:4 | 17372 | A:1 |
| 17326 | K:2 | 17373 | F:2 |
| 17327 | B:2 | 17374 | K:2 |
| 17328 | K:3 | 17375 | B:6 |
| 17329 | B:3 | 17376 | F:1 K:2 |
| 17330 | A:1 H:38 K:1 | 17377 | K:2 |
| 17331 | A:2 | 17378 | F:1 |
| 17332 | F:2 K:1 | 17379 | K:1 |
| 17333 | B:3 C:1 | 17380 | B:1 |
| 17334 | K:2 | 17381 | B:1 C:10 |
| 17335 | K:1 | 17382 | D:1 |
| 17383 | C:38 | 17430 | B:3 |
| 17384 | C:1 | 17431 | B:3 |
| 17385 | H:1 | 17432 | H:3 |
| 17386 | K:2 | 17433 | A:3 |
| 17387 | F:1 | 17434 | H:3 |
| 17388 | H:6 | 17435 | I:2 |
| 17389 | C:6 | 17436 | A:1 |
| 17390 | B:2 | 17437 | A:2 B:1 |
| 17391 | A:3 B:7 C:59 D:1 F:3 H:5 J:6 K:7 | 17438 | F:1 K:1 |
| 17392 | B:3 C:1 | 17439 | C:1 |
| 17393 | A:1 | 17440 | B:3 |
| 17394 | H:2 | 17441 | A:1 C:1 |
| 17395 | H:1 | 17442 | B:1 C:1 H:4 |
| 17396 | H:3 | 17443 | H:2 |
| 17397 | B:2 | 17444 | I:1 |
| 17398 | B:3 | 17445 | B:5 |
| 17399 | C:21 | 17446 | H:1 |
| 17400 | F:4 | 17447 | H:1 |
| 17401 | F:4 K:1 | 17448 | H:1 |
| 17402 | A:3 H:4 | 17449 | H:1 |
| 17403 | F:1 K:2 | 17450 | H:1 |
| 17404 | B:5 | 17451 | H:1 |
| 17405 | H:3 | 17452 | H:1 |
| 17406 | H:1 | 17453 | H:1 |
| 17407 | A:6 | 17454 | H:1 |
| 17408 | F:3 K:1 | 17455 | H:1 |
| 17409 | B:2 | 17456 | K:2 |
| 17410 | B:1 I:1 | 17457 | F:1 |
| 17411 | H:2 I:1 | 17458 | F:5 K:2 |
| 17412 | C:59 | 17459 | A:1 C:1 F:7 K:1 |
| 17413 | C:1 | 17460 | A:1 C:1 F:5 K:2 |
| 17414 | C:1 | 17461 | K:2 |
| 17415 | C:1 | 17462 | H:4 |
| 17416 | C:1 | 17463 | K:5 |
| 17417 | C:1 | 17464 | A:15 |
| 17418 | C:1 | 17465 | A:1 |
| 17419 | C:1 | 17466 | A:1 |
| 17420 | C:1 | 17467 | F:1 |
| 17421 | C:1 | 17468 | C:3 |
| 17422 | C:1 | 17469 | A:1 C:1 |
| 17423 | C:1 | 17470 | D:1 |
| 17424 | B:3 | 17471 | K:2 |
| 17425 | K:2 | 17472 | K:2 |
| 17426 | B:2 | 17473 | B:4 |
| 17427 | A:2 | 17474 | F:1 K:1 |
| 17428 | C:3 | 17475 | K:1 |
| 17429 | A:4 | 17476 | B:3 |
| 17477 | F:23 K:4 | 17524 | A:1 D:1 |
| 17478 | K:1 | 17525 | K:2 |
| 17479 | K:4 | 17526 | F:1 K:2 |
| 17480 | F:1 | 17527 | F:1 |
| 17481 | B:4 D:1 H:1 | 17528 | F:2 |
| 17482 | B:1 H:1 K:1 | 17529 | K:3 |
| 17483 | B:1 | 17530 | B:7 C:91 |
| 17484 | H:7 | 17531 | A:2 |
| 17485 | K:1 | 17532 | B:3 |
| 17486 | F:1 | 17533 | H:17 |
| 17487 | B:2 | 17534 | K:2 |
| 17488 | F:7 K:31 | 17535 | I:2 |
| 17489 | C:3 | 17536 | A:2 |
| 17490 | D:1 | 17537 | A:3 B:1 C:1 |
| 17491 | F:1 | 17538 | A:4 |
| 17492 | H:1 K:1 | 17539 | A:3 |
| 17493 | H:1 | 17540 | B:2 |
| 17494 | K:1 | 17541 | F:13 K:77 |
| 17495 | K:1 | 17542 | F:2 |
| 17496 | A:7 | 17543 | F:2 K:1 |
| 17497 | K:1 | 17544 | H:3 |
| 17498 | H:2 | 17545 | A:1 H:1 |
| 17499 | A:1 | 17546 | F:10 K:1 |
| 17500 | F:1 K:1 | 17547 | K:1 |
| 17501 | K:1 | 17548 | K:1 |
| 17502 | F:1 | 17549 | C:2 |
| 17503 | F:1 | 17550 | F:2 K:1 |
| 17504 | A:2 | 17551 | H:2 |
| 17505 | D:2 | 17552 | A:1 B:1 |
| 17506 | F:11 K:2 | 17553 | H:3 |
| 17507 | F:1 K:7 | 17554 | K:1 |
| 17508 | H:4 | 17555 | H:2 |
| 17509 | K:2 | 17556 | D:1 |
| 17510 | K:1 | 17557 | A:1 |
| 17511 | F:2 K:1 | 17558 | H:1 |
| 17512 | F:5 K:1 | 17559 | H:1 |
| 17513 | K:3 | 17560 | K:11 |
| 17514 | F:2 | 17561 | A:5 |
| 17515 | B:3 C:1 | 17562 | F:1 K:2 |
| 17516 | C:1 | 17563 | D:3 |
| 17517 | H:3 | 17564 | F:2 K:1 |
| 17518 | H:2 | 17565 | A:44 |
| 17519 | K:2 | 17566 | H:1 |
| 17520 | H:1 | 17567 | F:1 K:1 |
| 17521 | F:10 K:11 | 17568 | K:2 |
| 17522 | F:11 K:10 | 17569 | A:2 B:1 |
| 17523 | A:2 | 17570 | F:2 K:1 |
| 17571 | A:3 B:6 C:2 D:2 | 17618 | H:2 |
| 17572 | B:79 C:62 D:2 H:25 I:2 J:4 K:2 | 17619 | H:7 |
| 17573 | H:1 | 17620 | B:2 |
| 17574 | H:1 K:6 | 17621 | K:6 |
| 17575 | B:4 | 17622 | E:1 |
| 17576 | K:3 | 17623 | F:1 |
| 17577 | F:2 K:6 | 17624 | K:1 |
| 17578 | C:4 | 17625 | K:1 |
| 17579 | A:1 B:1 C:5 | 17626 | K:1 |
| 17580 | A:7 B:22 C:34 D:3 H:10 J:1 K:1 | 17627 | K:2 |
| 17581 | K:3 | 17628 | B:1 H:2 |
| 17582 | H:2 | 17629 | H:1 |
| 17583 | C:1 | 17630 | K:1 |
| 17584 | D:1 | 17631 | K:1 |
| 17585 | B:1 | 17632 | H:6 |
| 17586 | B:2 | 17633 | C:15 |
| 17587 | B:2 | 17634 | K:2 |
| 17588 | F:3 | 17635 | A:1 |
| 17589 | K:1 | 17636 | F:1 K:1 |

TABLE V-continued
(Spatial distribution)

| Seq Id No. | Tissue distribution | Seq Id No. | Tissue distribution |
|---|---|---|---|
| 17590 | H:1 | 17637 | B:1 |
| 17591 | H:3 | 17638 | F:4 K:25 |
| 17592 | A:5 | 17639 | F:1 K:6 |
| 17593 | C:1 D:1 | 17640 | F:2 K:22 |
| 17594 | H:1 | 17641 | B:1 C:1 |
| 17595 | A:4 | 17642 | F:1 K:1 |
| 17596 | A:3 B:1 K:2 | 17643 | A:7 |
| 17597 | F:1 K:1 | 17644 | C:263 |
| 17598 | H:1 | 17645 | C:1 |
| 17599 | B:2 | 17646 | I:4 |
| 17600 | B:4 | 17647 | D:1 |
| 17601 | H:2 | 17648 | A:1 |
| 17602 | F:5 K:1 | 17649 | A:14 |
| 17603 | A:8 | 17650 | A:4 B:1 |
| 17604 | K:3 | 17651 | C:10 D:1 H:1 I:2 J:5 |
| 17605 | C:4 | 17652 | F:3 K:42 |
| 17606 | F:1 K:1 | 17653 | K:2 |
| 17607 | F:1 | 17654 | F:1 |
| 17608 | A:1 | 17655 | K:1 |
| 17609 | A:1 | 17656 | A:11 |
| 17610 | A:1 | 17657 | C:8 J:1 |
| 17611 | C:1 | 17658 | C:6 |
| 17612 | C:1 | 17659 | H:2 |
| 17613 | B:1 C:1 | 17660 | F:3 |
| 17614 | K:2 | 17661 | A:1 K:1 |
| 17615 | H:2 | 17662 | A:2 |
| 17616 | B:5 | 17663 | K:1 |
| 17617 | C:10 | 17664 | K:1 |
| 17665 | F:3 | 17712 | F:20 K:5 |
| 17666 | F:1 K:1 | 17713 | B:1 |
| 17667 | K:2 | 17714 | B:2 |
| 17668 | C:2 | 17715 | A:1 I:4 K:2 |
| 17669 | C:3 | 17716 | A:1 F:1 I:4 K:1 |
| 17670 | C:1 | 17717 | A:1 B:21 C:45 D:3 E:1 F:4 H:4 I:4 J:7 K:16 |
| 17671 | A:3 | | |
| 17672 | H:1 | 17718 | H:1 |
| 17673 | F:2 K:12 | 17719 | A:1 B:1 C:1 K:1 |
| 17674 | F:2 K:10 | 17720 | C:8 |
| 17675 | F:1 K:1 | 17721 | K:2 |
| 17676 | F:2 | 17722 | H:18 |
| 17677 | B:2 | 17723 | B:1 H:1 |
| 17678 | B:6 | 17724 | B:3 |
| 17679 | F:7 K:2 | 17725 | K:3 |
| 17680 | F:1 K:2 | 17726 | F:7 |
| 17681 | K:5 | 17727 | K:1 |
| 17682 | K:5 | 17728 | F:1 K:11 |
| 17683 | F:3 K:4 | 17729 | D:1 |
| 17684 | K:1 | 17730 | K:1 |
| 17685 | A:1 B:2 | 17731 | H:2 |
| 17686 | B:2 | 17732 | D:1 |
| 17687 | A:1 | 17733 | C:1 F:1 K:1 |
| 17688 | I:4 | 17734 | K:2 |
| 17689 | F:2 K:1 | 17735 | F:1 K:3 |
| 17690 | H:1 | 17736 | F:3 K:1 |
| 17691 | A:1 | 17737 | J:2 |
| 17692 | H:2 | 17738 | I:4 |
| 17693 | B:2 | 17739 | K:2 |
| 17694 | H:2 | 17740 | K:2 |
| 17695 | B:2 | 17741 | F:2 K:1 |
| 17696 | B:1 | 17742 | F:8 K:2 |
| 17697 | H:3 | 17743 | A:8 |
| 17698 | H:2 | 17744 | K:2 |
| 17699 | K:1 | 17745 | A:2 |
| 17700 | B:3 | 17746 | B:2 |
| 17701 | K:1 | 17747 | F:17 K:4 |
| 17702 | C:2 D:2 | 17748 | C:34 |
| 17703 | H:3 | 17749 | C:9 J:1 |
| 17704 | B:2 | 17750 | H:2 |
| 17705 | F:1 K:3 | 17751 | K:5 |
| 17706 | F:27 K:4 | 17752 | D:3 |
| 17707 | A:5 | 17753 | K:1 |
| 17708 | H:1 | 17754 | A:1 |
| 17709 | H:1 | 17755 | A:1 |
| 17710 | C:49 | 17756 | F:1 |
| 17711 | C:1 D:1 | 17757 | H:1 |
| 17758 | F:3 K:8 | 17805 | A:2 |
| 17759 | A:2 | 17806 | K:2 |
| 17760 | F:1 K:1 | 17807 | C:4 |
| 17761 | K:2 | 17808 | H:2 |
| 17762 | K:1 | 17809 | K:2 |
| 17763 | K:1 | 17810 | C:1 H:1 |
| 17764 | A:6 | 17811 | A:11 |
| 17765 | A:1 | 17812 | H:1 |
| 17766 | F:1 | 17813 | I:2 |
| 17767 | D:1 | 17814 | C:1 |
| 17768 | C:5 D:1 | 17815 | F:6 K:1 |
| 17769 | K:2 | 17816 | F:1 |
| 17770 | F:2 K:2 | 17817 | B:1 C:9 |
| 17771 | B:2 | 17818 | H:1 |
| 17772 | I:2 | 17819 | K:1 |
| 17773 | B:3 | 17820 | A:11 C:17 |
| 17774 | C:23 | 17821 | F:1 K:1 |
| 17775 | H:5 | 17822 | B:1 |
| 17776 | C:11 | 17823 | B:1 |
| 17777 | I:3 | 17824 | K:1 |
| 17778 | B:3 | 17825 | A:3 |
| 17779 | A:2 | 17826 | K:1 |
| 17780 | A:2 H:1 | 17827 | I:3 |
| 17781 | K:2 | 17828 | A:2 B:1 H:2 |
| 17782 | H:2 | 17829 | B:1 H:2 |
| 17783 | F:3 | 17830 | H:2 |
| 17784 | F:2 | 17831 | A:3 |
| 17785 | K:2 | 17832 | A:2 |
| 17786 | H:4 | 17833 | A:1 D:2 |
| 17787 | B:2 | 17834 | F:3 K:2 |
| 17788 | A:1 | 17835 | B:4 |
| 17789 | F:4 | 17836 | F:1 K:3 |
| 17790 | H:2 | 17837 | B:7 |
| 17791 | B:1 C:1 H:1 | 17838 | F:3 K:1 |
| 17792 | I:1 | 17839 | C:2 |
| 17793 | C:4 | 17840 | F:1 K:1 |
| 17794 | A:2 | 17841 | C:2 |
| 17795 | A:1 B:1 D:1 | 17842 | B:2 |
| 17796 | C:62 | 17843 | F:4 K:1 |
| 17797 | F:2 | 17844 | F:2 |
| 17798 | C:1 | 17845 | A:12 |
| 17799 | F:9 K:5 | 17846 | C:1 H:1 |
| 17800 | K:1 | 17847 | C:13 |
| 17801 | H:4 | 17848 | K:2 |
| 17802 | F:2 | 17849 | H:2 |
| 17803 | F:18 | 17850 | C:45 |
| 17804 | K:2 | 17851 | B:1 |
| 17852 | A:1 H:1 | 17899 | C:4 |
| 17853 | F:1 K:2 | 17900 | H:3 |
| 17854 | K:1 | 17901 | F:1 K:1 |
| 17855 | K:4 | 17902 | K:2 |
| 17856 | K:2 | 17903 | F:3 K:1 |
| 17857 | F:2 K:3 | 17904 | K:2 |
| 17858 | A:1 | 17905 | C:7 H:1 |
| 17859 | K:4 | 17906 | C:1 |
| 17860 | A:1 | 17907 | F:1 |
| 17861 | A:1 | 17908 | C:1 |
| 17862 | K:2 | 17909 | K:1 |
| 17863 | B:1 | 17910 | C:1 |
| 17864 | A:1 | 17911 | A:4 |
| 17865 | H:2 | 17912 | K:4 |
| 17866 | A:1 | 17913 | C:171 |
| 17867 | A:1 | 17914 | C:1 |
| 17868 | D:1 | 17915 | D:1 H:1 |
| 17869 | B:3 | 17916 | K:4 |
| 17870 | C:4 | 17917 | K:2 |
| 17871 | I:1 | 17918 | K:1 |
| 17872 | I:1 | 17919 | K:7 |
| 17873 | F:2 K:4 | 17920 | F:1 |
| 17874 | F:7 | 17921 | F:1 |
| 17875 | K:1 | 17922 | F:1 |

TABLE V-continued (Spatial distribution)

| Seq Id No. | Tissue distribution | Seq Id No. | Tissue distribution |
|---|---|---|---|
| 17876 | F:1 K:1 | 17923 | F:1 |
| 17877 | B:3 | 17924 | F:1 |
| 17878 | K:2 | 17925 | F:1 |
| 17879 | C:17 | 17926 | K:1 |
| 17880 | C:1 | 17927 | F:1 |
| 17881 | F:32 K:110 | 17928 | F:1 |
| 17882 | F:2 K:8 | 17929 | F:1 |
| 17883 | F:29 K:110 | 17930 | F:1 |
| 17884 | K:1 | 17931 | F:1 |
| 17885 | K:1 | 17932 | F:1 |
| 17886 | K:1 | 17933 | F:1 |
| 17887 | H:9 | 17934 | F:1 |
| 17888 | F:3 K:1 | 17935 | F:1 |
| 17889 | F:2 | 17936 | F:1 |
| 17890 | A:2 | 17937 | F:1 |
| 17891 | H:5 | 17938 | F:1 |
| 17892 | A:3 B:2 H:1 K:1 | 17939 | F:1 |
| 17893 | F:1 K:1 | 17940 | F:1 |
| 17894 | K:4 | 17941 | F:1 |
| 17895 | H:1 | 17942 | F:1 |
| 17896 | A:15 | 17943 | F:1 |
| 17897 | C:5 H:1 | 17944 | F:1 |
| 17898 | B:1 H:1 K:1 | 17945 | K:1 |
| 17946 | F:1 | 17993 | K:2 |
| 17947 | K:1 | 17994 | C:3 |
| 17948 | F:1 | 17995 | K:3 |
| 17949 | F:1 | 17996 | B:2 |
| 17950 | F:4 K:3 | 17997 | B:6 |
| 17951 | F:1 K:1 | 17998 | K:1 |
| 17952 | A:8 | 17999 | H:2 |
| 17953 | K:2 | 18000 | A:4 F:1 |
| 17954 | K:2 | 18001 | A:1 |
| 17955 | K:2 | 18002 | B:1 |
| 17956 | H:6 | 18003 | H:1 |
| 17957 | H:3 | 18004 | F:1 |
| 17958 | A:3 | 18005 | K:1 |
| 17959 | K:2 | 18006 | H:3 |
| 17960 | F:6 K:1 | 18007 | B:1 |
| 17961 | A:2 | 18008 | K:2 |
| 17962 | K:2 | 18009 | F:1 K:1 |
| 17963 | K:1 | 18010 | A:16 |
| 17964 | K:1 | 18011 | C:2 |
| 17965 | K:1 | 18012 | B:2 |
| 17966 | K:1 | 18013 | B:2 |
| 17967 | F:6 K:2 | 18014 | C:2 I:2 |
| 17968 | F:2 | 18015 | F:5 |
| 17969 | F:3 | 18016 | K:4 |
| 17970 | A:213 | 18017 | A:2 |
| 17971 | A:4 | 18018 | B:1 |
| 17972 | A:2 B:2 | 18019 | B:1 |
| 17973 | A:15 C:2 F:1 | 18020 | H:1 |
| 17974 | A:5 C:3 | 18021 | H:1 |
| 17975 | B:2 | 18022 | H:1 |
| 17976 | A:6 | 18023 | F:2 |
| 17977 | A:5 C:3 | 18024 | A:1 I:2 |
| 17978 | H:7 | 18025 | B:3 C:1 |
| 17979 | F:5 K:2 | 18026 | F:1 K:2 |
| 17980 | F:4 K:5 | 18027 | F:1 |
| 17981 | F:1 K:6 | 18028 | K:1 |
| 17982 | K:3 | 18029 | H:3 |
| 17983 | F:16 K:5 | 18030 | H:1 |
| 17984 | B:2 C:1 | 18031 | F:1 H:5 |
| 17985 | K:3 | 18032 | C:2 H:1 |
| 17986 | C:3 | 18033 | F:1 K:1 |
| 17987 | K:2 | 18034 | K:2 |
| 17988 | A:13 | 18035 | B:3 |
| 17989 | C:26 | 18036 | F:4 K:1 |
| 17990 | A:2 B:1 I:1 | 18037 | F:1 K:1 |
| 17991 | A:1 B:2 | 18038 | B:1 C:1 |
| 17992 | C:3 | 18039 | H:2 |
| 18040 | A:2 | 18087 | B:1 |
| 18041 | A:7 | 18088 | H:1 |
| 18042 | K:1 | 18089 | A:7 |
| 18043 | K:1 | 18090 | B:3 |
| 18044 | A:2 | 18091 | A:1 |
| 18045 | K:3 | 18092 | K:2 |
| 18046 | B:2 | 18093 | H:3 |
| 18047 | H:1 | 18094 | H:7 |
| 18048 | H:2 | 18095 | F:4 |
| 18049 | B:4 | 18096 | H:6 |
| 18050 | A:4 B:2 C:4 H:1 | 18097 | K:7 |
| 18051 | B:1 | 18098 | K:2 |
| 18052 | C:6 | 18099 | B:2 |
| 18053 | A:2 | 18100 | B:3 |
| 18054 | H:1 | 18101 | A:1 |
| 18055 | B:1 D:1 | 18102 | D:2 |
| 18056 | F:1 K:1 | 18103 | F:1 |
| 18057 | B:2 | 18104 | F:1 |
| 18058 | H:1 | 18105 | K:1 |
| 18059 | H:3 I:3 | 18106 | C:1 |
| 18060 | A:9 | 18107 | K:2 |
| 18061 | A:1 | 18108 | A:1 H:1 |
| 18062 | H:1 | 18109 | K:1 |
| 18063 | H:1 | 18110 | K:1 |
| 18064 | D:2 | 18111 | F:4 K:1 |
| 18065 | H:1 | 18112 | B:2 |
| 18066 | H:1 | 18113 | K:2 |
| 18067 | A:4 | 18114 | F:1 |
| 18068 | H:1 | 18115 | A:3 |
| 18069 | D:1 | 18116 | H:3 |
| 18070 | B:2 | 18117 | H:1 |
| 18071 | H:1 | 18118 | A:1 |
| 18072 | B:1 | 18119 | F:9 K:8 |
| 18073 | K:7 | 18120 | K:2 |
| 18074 | H:37 | 18121 | K:8 |
| 18075 | H:1 | 18122 | A:2 |
| 18076 | B:1 | 18123 | K:3 |
| 18077 | H:3 | 18124 | A:8 |
| 18078 | K:2 | 18125 | B:2 |
| 18079 | F:14 K:4 | 18126 | F:14 H:1 K:32 |
| 18080 | H:2 | 18127 | K:5 |
| 18081 | F:2 K:10 | 18128 | K:1 |
| 18082 | A:1 B:1 F:1 | 18129 | F:3 |
| 18083 | A:2 | 18130 | J:73 |
| 18084 | K:1 | 18131 | F:1 K:1 |
| 18085 | F:22 K:62 | 18132 | A:2 B:5 C:3 F:9 H:1 K:5 |
| 18086 | I:1 K:2 | 18133 | C:4 |
| 18134 | F:5 K:1 | 18181 | F:2 |
| 18135 | B:1 | 18182 | C:22 |
| 18136 | F:1 K:1 | 18183 | C:1 |
| 18137 | B:1 | 18184 | K:1 |
| 18138 | K:3 | 18185 | K:1 |
| 18139 | J:10 | 18186 | K:2 |
| 18140 | K:1 | 18187 | F:1 |
| 18141 | J:1 | 18188 | F:1 |
| 18142 | J:1 | 18189 | B:3 |
| 18143 | J:1 | 18190 | F:4 K:1 |
| 18144 | J:1 | 18191 | A:1 |
| 18145 | J:1 | 18192 | H:1 |
| 18146 | J:1 | 18193 | B:2 |
| 18147 | J:1 | 18194 | A:1 |
| 18148 | F:1 | 18195 | B:4 |
| 18149 | J:1 | 18196 | F:5 K:1 |
| 18150 | J:1 | 18197 | F:1 |
| 18151 | J:1 | 18198 | K:1 |
| 18152 | K:1 | 18199 | A:1 B:2 C:3 D:1 F:1 K:3 |
| 18153 | J:1 | 18200 | K:1 |
| 18154 | J:1 | 18201 | K:1 |
| 18155 | J:1 | 18202 | K:1 |
| 18156 | J:1 | 18203 | K:1 |
| 18157 | J:1 | 18204 | K:1 |
| 18158 | K:1 | 18205 | K:1 |
| 18159 | J:1 | 18206 | K:1 |
| 18160 | J:1 | 18207 | K:1 |
| 18161 | J:1 | 18208 | F:1 |

TABLE V-continued
(Spatial distribution)

| Seq Id No. | Tissue distribution | Seq Id No. | Tissue distribution |
|---|---|---|---|
| 18162 | J:1 | 18209 | K:1 |
| 18163 | J:1 | 18210 | A:4 |
| 18164 | J:1 | 18211 | K:1 |
| 18165 | J:1 | 18212 | A:3 |
| 18166 | J:1 | 18213 | K:1 |
| 18167 | F:1 | 18214 | K:1 |
| 18168 | J:1 | 18215 | K:1 |
| 18169 | J:1 | 18216 | K:1 |
| 18170 | K:1 | 18217 | K:1 |
| 18171 | J:1 | 18218 | K:2 |
| 18172 | K:1 | 18219 | B:2 |
| 18173 | C:6 | 18220 | H:1 |
| 18174 | A:19 B:20 C:11 D:46 F:22 | 18221 | K:1 |
| 18175 | K:1 | 18222 | H:2 |
| 18176 | H:1 | 18223 | F:1 K:20 |
| 18177 | A:1 K:2 | 18224 | K:4 |
| 18178 | C:9 | 18225 | B:2 |
| 18179 | H:1 | 18226 | B:3 H:1 K:1 |
| 18180 | C:1 K:6 | 18227 | A:8 B:5 C:20 D:9 F:3 H:10 J:2 |
| | | 18274 | A:2 |
| 18228 | C:1 | 18275 | F:1 K:2 |
| 18229 | K:1 | 18276 | K:1 |
| 18230 | H:2 | 18277 | B:2 |
| 18231 | D:2 | 18278 | B:3 |
| 18232 | A:2 | 18279 | K:1 |
| 18233 | I:1 | 18280 | C:6 |
| 18234 | I:1 | 18281 | H:3 |
| 18235 | F:2 | 18282 | K:2 |
| 18236 | H:1 | 18283 | B:8 C:1 |
| 18237 | A:1 D:1 | 18284 | C:8 |
| 18238 | F:2 | 18285 | A:1 |
| 18239 | F:1 K:2 | 18286 | B:1 |
| 18240 | B:3 | 18287 | B:2 |
| 18241 | F:1 K:1 | 18288 | D:2 |
| 18242 | K:2 | 18289 | A:1 B:20 C:21 F:3 H:6 K:1 |
| 18243 | K:1 | 18290 | B:1 |
| 18244 | K:1 | 18291 | C:1 |
| 18245 | K:2 | 18292 | F:1 |
| 18246 | K:1 | 18293 | F:1 |
| 18247 | H:4 | 18294 | B:4 |
| 18248 | A:3 H:1 | 18295 | H:1 |
| 18249 | A:2 | 18296 | K:2 |
| 18250 | A:1 | 18297 | F:1 K:2 |
| 18251 | F:3 K:9 | 18298 | F:1 K:1 |
| 18252 | F:2 K:2 | 18299 | F:1 |
| 18253 | C:2 | 18300 | F:2 K:2 |
| 18254 | K:2 | 18301 | F:23 K:6 |
| 18255 | K:1 | 18302 | H:1 |
| 18256 | D:1 | 18303 | K:2 |
| 18257 | C:1 H:1 | 18304 | F:1 K:6 |
| 18258 | C:6 | 18305 | C:1 H:2 K:1 |
| 18259 | D:1 F:1 | 18306 | A:1 |
| 18260 | I:2 | 18307 | K:2 |
| 18261 | H:11 | 18308 | B:2 |
| 18262 | F:1 | 18309 | K:2 |
| 18263 | K:1 | 18310 | B:2 C:1 |
| 18264 | K:2 | 18311 | K:1 |
| 18265 | A:7 | 18312 | F:1 |
| 18266 | K:7 | 18313 | F:1 |
| 18267 | I:1 | 18314 | F:1 |
| 18268 | H:1 | 18315 | K:3 |
| 18269 | A:1 | 18316 | K:3 |
| 18270 | C:2 | 18317 | H:1 |
| 18271 | H:1 | 18318 | C:2 |
| 18272 | B:1 | 18319 | F:1 I:2 |
| 18273 | A:2 | 18320 | K:2 |
| 18321 | H:2 | 18368 | K:1 |
| 18322 | C:25 | 18369 | C:1 |
| 18323 | A:4 | 18370 | H:1 |
| 18324 | K:2 | 18371 | K:1 |
| 18325 | C:31 | 18372 | B:4 |

TABLE V-continued
(Spatial distribution)

| Seq Id No. | Tissue distribution | Seq Id No. | Tissue distribution |
|---|---|---|---|
| 18326 | K:2 | 18373 | B:2 C:24 |
| 18327 | C:7 | 18374 | C:1 |
| 18328 | K:1 | 18375 | B:1 |
| 18329 | K:1 | 18376 | B:1 |
| 18330 | F:1 | 18377 | B:1 H:2 |
| 18331 | C:35 | 18378 | A:2 |
| 18332 | F:1 | 18379 | H:3 |
| 18333 | K:1 | 18380 | A:3 |
| 18334 | K:1 | 18381 | A:2 |
| 18335 | F:1 H:1 | 18382 | A:1 |
| 18336 | A:2 | 18383 | F:1 |
| 18337 | K:2 | 18384 | C:1 K:1 |
| 18338 | F:3 K:1 | 18385 | C:2 |
| 18339 | K:2 | 18386 | A:11 |
| 18340 | B:2 K:1 | 18387 | K:2 |
| 18341 | K:1 | 18388 | H:1 I:2 |
| 18342 | F:5 | 18389 | I:3 |
| 18343 | F:1 | 18390 | K:1 |
| 18344 | F:4 K:1 | 18391 | K:1 |
| 18345 | F:6 K:1 | 18392 | C:22 |
| 18346 | B:1 | 18393 | C:1 |
| 18347 | C:1 | 18394 | F:4 K:1 |
| 18348 | D:1 | 18395 | F:1 K:1 |
| 18349 | F:1 K:2 | 18396 | B:4 |
| 18350 | H:6 | 18397 | A:1 |
| 18351 | C:5 | 18398 | D:1 |
| 18352 | K:2 | 18399 | B:3 |
| 18353 | D:1 H:2 | 18400 | F:8 |
| 18354 | F:11 K:2 | 18401 | K:3 |
| 18355 | F:1 | 18402 | C:17 |
| 18356 | F:1 | 18403 | A:7 |
| 18357 | K:2 | 18404 | H:1 |
| 18358 | K:2 | 18405 | F:1 K:2 |
| 18359 | C:1 | 18406 | K:1 |
| 18360 | B:3 | 18407 | A:2 |
| 18361 | B:3 | 18408 | B:2 |
| 18362 | A:5 B:3 C:6 D:6 | 18409 | K:1 |
| 18363 | K:1 | 18410 | A:1 |
| 18364 | A:4 B:3 C:12 D:6 H:2 K:1 | 18411 | H:3 |
| 18365 | A:4 B:3 C:10 D:6 H:4 K:1 | 18412 | H:1 |
| 18366 | B:1 C:5 D:1 | 18413 | A:1 |
| 18367 | K:1 | 18414 | B:1 |
| 18415 | C:5 | 18462 | H:3 |
| 18416 | K:2 | 18463 | A:6 |
| 18417 | B:2 C:1 | 18464 | H:3 |
| 18418 | K:1 | 18465 | D:1 |
| 18419 | H:13 | 18466 | F:1 |
| 18420 | C:2 | 18467 | H:2 |
| 18421 | F:1 K:4 | 18468 | B:1 |
| 18422 | K:2 | 18469 | H:1 |
| 18423 | A:1 | 18470 | C:1 |
| 18424 | B:2 | 18471 | H:2 |
| 18425 | A:1 | 18472 | H:1 |
| 18426 | I:3 | 18473 | A:1 |
| 18427 | A:1 | 18474 | K:3 |
| 18428 | K:2 | 18475 | A:1 |
| 18429 | K:3 | 18476 | F:1 K:2 |
| 18430 | D:1 | 18477 | F:2 |
| 18431 | B:2 | 18478 | A:2 B:66 C:96 D:3 F:3 H:114 I:3 J:1 K:5 |
| 18432 | H:1 | 18479 | K:1 |
| 18433 | H:1 | 18480 | K:1 |
| 18434 | H:1 | 18481 | H:1 |
| 18435 | F:1 K:1 | 18482 | A:1 |
| 18436 | F:1 | 18483 | A:1 |
| 18437 | F:1 | 18484 | A:2 |
| 18438 | A:2 | 18485 | F:1 K:1 |
| 18439 | A:2 | 18486 | B:1 |
| 18440 | K:2 | 18487 | A:5 |
| 18441 | F:2 K:1 | 18488 | K:1 |
| 18442 | K:1 | 18489 | F;1 |
| 18443 | K:1 | | |

TABLE V-continued

(Spatial distribution)

| Seq Id No. | Tissue distribution | Seq Id No. | Tissue distribution |
|---|---|---|---|
| 18444 | K:1 | 18490 | C:9 |
| 18445 | K:1 | 18491 | H:4 |
| 18446 | C:34 | 18492 | A:12 |
| 18447 | B:8 C:26 | 18493 | A:3 |
| 18448 | H:2 | 18494 | A:5 C:1 |
| 18449 | C:24 | 18495 | A:2 B:2 |
| 18450 | A:3 B:3 D:1 | 18496 | C:2 |
| 18451 | A:5 B:1 | 18497 | F:6 K:1 |
| 18452 | A:2 B:2 C:1 H:2 | 18498 | B:4 |
| 18453 | B:1 | 18499 | K:1 |
| 18454 | K:1 | 18500 | F:9 K:1 |
| 18455 | B:1 | 18501 | K:2 |
| 18456 | B:1 | 18502 | K:1 |
| 18457 | C:1 | 18503 | H:1 |
| 18458 | A:2 | 18504 | H:1 |
| 18459 | K:1 | 18505 | F:1 K:11 |
| 18460 | A:1 | 18506 | H:1 |
| 18461 | A:3 | 18507 | C:52 |
| 18508 | C:27 | 18555 | B:2 |
| 18509 | C:1 | 18556 | K:2 |
| 18510 | C:1 | 18557 | F:3 K:3 |
| 18511 | C:1 | 18558 | K:3 |
| 18512 | F:10 K:3 | 18559 | F:1 K:1 |
| 18513 | K:2 | 18560 | F:6 |
| 18514 | C:6 | 18561 | C:12 |
| 18515 | B:4 C:4 H:1 | 18562 | H:2 |
| 18516 | A:1 B:4 C:5 | 18563 | J:1 |
| 18517 | B:7 C:6 | 18564 | H:1 |
| 18518 | B:7 C:8 D:2 | 18565 | F:13 K:1 |
| ;8519 | B:18 C:17 K:1 | 18566 | B:3 |
| 18520 | C:1 | 18567 | B:3 C:1 |
| 18521 | B:1 | 18568 | H:2 |
| 18522 | J:1 | 18569 | K:1 |
| 18523 | B:1 | 18570 | K:1 |
| 18524 | B:1 | 18571 | F:1 |
| 18525 | C:1 | 18572 | K:1 |
| 18526 | B:1 | 18573 | K:1 |
| 18527 | C:1 | 18574 | H:2 |
| 18528 | A:1 | 18575 | F:5 K:3 |
| 18529 | H:1 | 18576 | C:6 |
| 18530 | B:1 | 18577 | A:2 C:1 |
| 18531 | B:1 | 18578 | B:3 |
| 18532 | A:1 | 18579 | A:1 K:1 |
| 18533 | K:1 | 18580 | K:1 |
| 18534 | B:1 | 18581 | F:4 K:2 |
| 18535 | H:1 | 18582 | H:1 |
| 18536 | B:1 | 18583 | A:1 |
| 18537 | K:1 | 18584 | C:45 |
| 18538 | B:1 | 18585 | H:1 |
| 18539 | C:1 | 18586 | K:1 |
| 18540 | C:1 | 18587 | K:1 |
| 18541 | C:1 | 18588 | K:1 |
| 18542 | C:1 | 18589 | D:1 |
| 18543 | B:1 | 18590 | A:6 |
| 18544 | C:1 | 18591 | F:2 |
| 18545 | C:1 | 18592 | A:4 B:1 |
| 18546 | C:1 | 18593 | F:8 K:1 |
| 18547 | B:3 | 18594 | B:5 |
| 18548 | B:7 F:4 K:7 | 18595 | B:1 |
| 18549 | A:2 B:6 C:34 D:4 H:8 | 18596 | A:1 B:1 H:2 |
| 18550 | C:1 | 18597 | K:3 |
| 18551 | C:1 | 18598 | C:102 |
| 18552 | K:3 | 18599 | F:4 K:16 |
| 18553 | K:1 | 18600 | F:10 K:1 |
| 18554 | D:1 | 18601 | F:10 |
| 18602 | F:1 K:1 | 18649 | F:5 |
| 18603 | B:2 | 18650 | B:3 |
| 18604 | A:1 K:1 | 18651 | F:2 |
| 18605 | F:1 | 18652 | A:4 |
| 18606 | A:1 | 18653 | K:4 |
| 18607 | A:1 | 18654 | A:1 C:1 |
| 18608 | F:1 K:2 | 18655 | H:3 |
| 18609 | A:1 | 18656 | B:2 |
| 18610 | I:1 K:1 | 18657 | A:1 F:1 K:2 |
| 18611 | A:1 | 18658 | C:5 |
| 18612 | B:2 | 18659 | K:1 |
| 18613 | F:2 K:1 | 18660 | C:1 |
| 18614 | K:1 | 18661 | H:3 |
| 18615 | K:1 | 18662 | K:4 |
| 18616 | F:14 K:5 | 18663 | B:3 |
| 18617 | F:1 | 18664 | K:3 |
| 18618 | A:1 | 18665 | K:1 |
| 18619 | K:2 | 18666 | A:3 |
| 18620 | H:1 | 18667 | A:1 |
| 18621 | F:2 K:21 | 18668 | C:3 |
| 18622 | A:1 | 18669 | B:2 C:1 |
| 18623 | F:1 | 18670 | A:2 |
| 18624 | A:1 B:1 C:1 D:2 F:1 K:26 | 18671 | C:1 |
| 18625 | D:2 K:3 | 18672 | F:6 K:5 |
| 18626 | K:1 | 18673 | F:1 |
| 18627 | F:1 | 18674 | D:1 K:1 |
| 18628 | K:2 | 18675 | H:2 |
| 18629 | K:1 | 18676 | H:11 |
| 18630 | H:5 | 18671 | C:27 |
| 18631 | H:2 | 18678 | I:1 |
| 18632 | C:1 | 18679 | K:1 |
| 18633 | C:1 | 18680 | K:2 |
| 18634 | C:1 | 18681 | F:2 |
| 18635 | B:1 | 18682 | I:3 |
| 18636 | B:2 | 18683 | C:38 |
| 18637 | F:1 K:4 | 18684 | C:1 |
| 18638 | H:1 K:1 | 18685 | F:1 H:2 K:8 |
| 18639 | H:1 | 18686 | C:1 |
| 18640 | A:3 | 18687 | B:4 C:1 |
| 18641 | F:1 K:2 | 18688 | B:2 |
| 18642 | F:3 K:11 | 18689 | K:1 |
| 18643 | F:1 K:2 | 18690 | F:1 |
| 18644 | C:2 | 18691 | A:29 B:47 C:41 D:1 F:1 J:3 K:5 |
| 18645 | A:13 | 18692 | K:1 |
| 18646 | C:1 | 18693 | C:1 |
| 18647 | A:1 | 18694 | K:1 |
| 18648 | D:1 | 18695 | H:1 |
| 18696 | F:1 | 18743 | A:1 |
| 18697 | K:1 | 18744 | H:1 |
| 18698 | D:1 | 18745 | H:1 |
| 18699 | B:1 | 18746 | C:1 |
| 18700 | A:1 | 18747 | D:1 |
| 18701 | H:1 | 18748 | C:1 |
| 18702 | A:1 | 18749 | K:1 |
| 18703 | B:1 | 18750 | C:1 |
| 18704 | C:1 | 18751 | C:1 |
| 18705 | B:1 | 18752 | A:2 |
| 18706 | K:3 | 18753 | B:1 |
| 18707 | C:1 | 18754 | H:1 |
| 18708 | C:1 | 18755 | C:1 |
| 18709 | C:1 | 18756 | C:4 |
| 18710 | A:1 | 18757 | H:1 |
| 18711 | K:1 | 18758 | F:1 |
| 18712 | C:1 | 18759 | B:1 C:5 F:6 H:9 K:4 |
| 18713 | A:1 | 18760 | A:1 |
| 18714 | B:1 | 18761 | A:1 |
| 18715 | B:1 | 18762 | B:1 |
| 18716 | H:1 | 18763 | H:1 |
| 18717 | C:1 | 18764 | C:1 |
| 18718 | A:1 | 18765 | H:1 |
| 18719 | C:1 | 18766 | H:1 |
| 18720 | H:1 | 18767 | A:1 |
| 18721 | D:1 H:1 | 18768 | A:1 |
| 18722 | J:1 | 18769 | C:1 |
| 18723 | C:1 | 18770 | B:1 |
| 18724 | C:1 | 18771 | H:1 |
| 18725 | B:1 | 18772 | H:1 |
| 18726 | B:1 | 18773 | H:1 |

TABLE V-continued (Spatial distribution)

| Seq Id No. | Tissue distribution | Seq Id No. | Tissue distribution |
|---|---|---|---|
| 18727 | B:1 | 18774 | H:1 |
| 18728 | C:1 | 18775 | C:1 |
| 18729 | B:1 | 18776 | D:1 |
| 18730 | C:1 | 18777 | H:1 |
| 18731 | C:1 | 18778 | I:1 |
| 18732 | C:1 | 18779 | A:1 H:1 |
| 18733 | B:1 | 18780 | C:1 |
| 18734 | C:1 | 18781 | C:1 |
| 18735 | C:50 | 18782 | E:1 |
| 18736 | H:1 | 18783 | B:1 |
| 18737 | B:1 | 18784 | A:1 |
| 18738 | I:1 | 18785 | H:1 |
| 18739 | C:1 | 18786 | C:1 |
| 18740 | C:8 | 18787 | C:1 |
| 18741 | I:1 | 18788 | C:1 |
| 18742 | C:1 | 18789 | F:1 |
| 18790 | C:1 | 18837 | C:1 |
| 18791 | A:7 | 18838 | B:8 C:1 |
| 18792 | B:3 | 18839 | K:2 |
| 18793 | F:8 | 18840 | A:8 K:1 |
| 18794 | I:2 | 18841 | A:7 K:1 |
| 18795 | C:5 | 18842 | H:3 |
| 18796 | C:10 | 18843 | F:1 K:1 |
| 18797 | A:1 | 18844 | A:1 C:1 |
| 18798 | A:2 | 18845 | F:1 K:2 |
| 18799 | K:2 | 18846 | B:2 |
| 18800 | B:2 | 18847 | F:1 K:1 |
| 18801 | K:3 | 18848 | A:2 |
| 18802 | A:1 C:1 | 18849 | K:3 |
| 18803 | B:9 C:3 K:1 | 18850 | C:1 |
| 18804 | H:2 | 18851 | C:2 |
| 18805 | B:2 | 18852 | F:19 K:8 |
| 18806 | B:2 | 18853 | K:1 |
| 18807 | F:8 K:2 | 18854 | K:1 |
| 18808 | B:3 | 18855 | K:1 |
| 18809 | B:1 | 18856 | F:1 |
| 18810 | A:2 | 18857 | K:1 |
| 18811 | B:2 | 18858 | K:1 |
| 18812 | B:3 | 18859 | K:3 |
| 18813 | A:2 | 18860 | H:1 |
| 18814 | D:1 F:1 K:12 | 18861 | F:3 |
| 18815 | B:2 | 18862 | K:2 |
| 18816 | K:2 | 18863 | K:2 |
| 18817 | K:2 | 18864 | F:1 |
| 18818 | K:3 | 18865 | K:1 |
| 18819 | K:2 | 18866 | F:17 K:2 |
| 18820 | F:2 | 18867 | F:3 K:1 |
| 18821 | F:4 K:1 | 18868 | H:3 |
| 18822 | K:1 | 18869 | A:1 B:1 |
| 18823 | K:1 | 18870 | C:2 J:1 |
| 18824 | K:1 | 18871 | C:6 J:1 |
| 18825 | A:2 | 18872 | C:1 J:4 |
| 18826 | K:3 | 18873 | C:4 J:1 |
| 18827 | K:1 | 18874 | A:4 C:1 J:1 |
| 18828 | A:1 H:1 | 18875 | F:1 K:4 |
| 18829 | I:2 | 18876 | H:2 |
| 18830 | K:2 | 18877 | K:4 |
| 18831 | K:2 | 18878 | K:4 |
| 18832 | K:4 | 18879 | K:1 |
| 18833 | B:1 | 18880 | F:1 K:2 |
| 18834 | K:2 | 18881 | K:1 |
| 18835 | F:1 K:1 | 18882 | F:1 K:1 |
| 18836 | K:1 | 18883 | F:2 |
| 18884 | F:2 K:2 | 18931 | F:1 |
| 18885 | H:3 K:2 | 18932 | K:1 |
| 18886 | A:4 | 18933 | K:5 |
| 18887 | C:1 | 18934 | F:1 K:2 |
| 18888 | K:1 | 18935 | B:2 |
| 18889 | H:2 | 18936 | F:3 K:1 |
| 18890 | A:3 | 18937 | A:3 C:1 |
| 18891 | F:5 K:1 | 18938 | K:1 |
| 18892 | K:3 | 18939 | K:1 |
| 18893 | K:1 | 18940 | K:2 |
| 18894 | D:1 | 18941 | F:1 K:1 |
| 18895 | F:1 K:2 | 18942 | K:1 |
| 18896 | A:2 | 18943 | C:18 |
| 18897 | C:2 H:1 | 18944 | A:1 C:10 |
| 18898 | K:2 | 18945 | F:2 K:1 |
| 18899 | C:1 H:3 | 18946 | A:8 |
| 18900 | F:1 K:1 | 18947 | H:1 |
| 18901 | A:3 | 18948 | A:1 |
| 18902 | K:4 | 18949 | A:1 |
| 18903 | F:1 K:1 | 18950 | F:3 K:8 |
| 18904 | B:2 | 18951 | F:11 K:13 |
| 18905 | F:1 | 18952 | F:1 |
| 18906 | F:1 | 18953 | B:2 |
| 18907 | F:1 | 18954 | K:2 |
| 18908 | K:3 | 18955 | K:1 |
| 18909 | F:1 | 18956 | C:1 H:8 |
| 18910 | K:1 | 18957 | D:2 |
| 18911 | A:9 B:7 C:11 D:1 H:4 K:1 | 18958 | F:7 K:2 |
| 18912 | F:1 | 18959 | D:1 |
| 18913 | H:1 | 18960 | I:1 |
| 18914 | F:1 | 18961 | K:1 |
| 18915 | C:1 | 18962 | K:1 |
| 18916 | K:3 | 18963 | K:1 |
| 18917 | B:5 | 18964 | C:10 |
| 18918 | B:1 | 18965 | C:1 |
| 18919 | B:3 | 18966 | H:2 |
| 18920 | F:1 | 18967 | C:42 |
| 18921 | A:1 C:1 H:1 | 18968 | F:2 K:2 |
| 18922 | F:1 | 18969 | F:2 K:2 |
| 18923 | F:1 | 18970 | B:3 |
| 18924 | H:1 | 18971 | C:1 F:5 H:4 K:7 |
| 18925 | F:1 | 18972 | K:1 |
| 18926 | F:1 | 18973 | F:1 |
| 18927 | B:1 | 18974 | F:2 K:1 |
| 18928 | F:1 | 18975 | K:3 |
| 18929 | F:1 | 18976 | D:2 |
| 18930 | I:3 | 18977 | C:1 D:1 |
| 18978 | K:2 | 19025 | B:2 |
| 18979 | K:2 | 19026 | A:2 |
| 18980 | H:5 | 19027 | K:1 |
| 18981 | D:2 | 19028 | I:2 |
| 18982 | F:1 K:3 | 19029 | F:1 K:1 |
| 18983 | B:1 | 19030 | K:2 |
| 18984 | A:2 C:5 J:2 K:1 | 19031 | F:2 K:3 |
| 18985 | B:5 C:1 | 19032 | F:1 |
| 18986 | A:6 F:1 | 19033 | K:1 |
| 18987 | F:4 K:1 | 19034 | K:1 |
| 18988 | F:1 K:9 | 19035 | B:4 |
| 18989 | K:3 | 19036 | H:1 |
| 18990 | F:1 | 19037 | H:1 K:4 |
| 18991 | F:1 K:1 | 19038 | A:3 |
| 18992 | F:67 K:329 | 19039 | K:5 |
| 18993 | K:1 | 19040 | K:1 |
| 18994 | K:1 | 19041 | K:1 |
| 18995 | K:1 | 19042 | K:1 |
| 18996 | F:1 | 19043 | A:3 |
| 18997 | K:1 | 19044 | E:2 |
| 18998 | F:21 K:9 | 19045 | F:21 K:3 |
| 18999 | F:3 K:1 | 19046 | K:3 |
| 19000 | K:1 | 19047 | K:1 |
| 19001 | K:1 | 19048 | H:3 |
| 19002 | A:28 B:11 C:32 D:5 F:11 H:6 K:8 | 19049 | K:2 |
| 19003 | A:1 | 19050 | K:2 |
| 19004 | B:1 | 19051 | C:2 J:1 |
| 19005 | A:3 | 19052 | I:4 |
| 19006 | H:1 K:3 | 19053 | K:2 |
| 19007 | F:1 K:2 | 19054 | F:1 K:2 |
| 19008 | F:8 K:1 | 19055 | A:3 |
| 19009 | A:4 | 19056 | B:2 |
| 19010 | H:2 | 19057 | C:1 D:1 |
| 19011 | F:3 K:1 | 19058 | A:1 D:1 |

TABLE V-continued (Spatial distribution)

| Seq Id No. | Tissue distribution | Seq Id No. | Tissue distribution | Seq Id No. | Tissue distribution | Seq Id No. | Tissue distribution |
|---|---|---|---|---|---|---|---|
| 19012 | A:1 | 19059 | A:2 | 19179 | H:2 | 19226 | H:1 |
| 19013 | A:1 | 19060 | B:3 | 19180 | A:4 | 19227 | H:1 |
| 19014 | A:1 | 19061 | A:1 | 19181 | F:1 K:1 | 19228 | H:1 |
| 19015 | A:1 | 19062 | C:6 | 19182 | F:2 K:1 | 19229 | H:1 |
| 19016 | F:1 | 19063 | K:3 | 19183 | K:1 | 19230 | H:1 |
| 19017 | F:3 K:3 | 19064 | K:4 | 19184 | H:1 | 19231 | H:1 |
| 19018 | A:1 | 19065 | B:1 | 19185 | I:2 | 19232 | H:1 |
| 19019 | K:3 | 19066 | H:1 | 19186 | B:3 | 19233 | H:1 |
| 19020 | A:3 | 19067 | B:1 | 19187 | A:3 | 19234 | H:1 |
| 19021 | A:135 | 19068 | A:27 B:5 C:4 D:2 H:3 I:5 | 19188 | K:2 | 19235 | H:1 |
| 19022 | H:6 | 19069 | A:1 | 19189 | K:2 | 19236 | H:1 |
| 19023 | F:5 K:15 | 19070 | K:1 | 19190 | F:9 K:2 | 19237 | F:1 K:4 |
| 19024 | F:5 K:15 | 19071 | A:1 | 19191 | F:11 K:3 | 19238 | H:1 |
| 19072 | H 1 | 19119 | K:1 | 19192 | F:1 K:1 | 19239 | H:1 |
| 19073 | F:2 | 19120 | D:1 H:1 | 19193 | C:1 J:1 | 19240 | H:1 |
| 19074 | A:1 H:1 | 19121 | C:92 | 19194 | F:14 K:1 | 19241 | H:1 |
| 19075 | A:1 | 19122 | B:1 D:1 H:7 J:1 | 19195 | H:1 | 19242 | H:1 |
| 19076 | A:1 | 19123 | H:1 | 19196 | H:1 | 19243 | H:1 |
| 19077 | F:1 | 19124 | H:1 | 19197 | H:1 | 19244 | H:1 |
| 19078 | K:2 | 19125 | H:2 | 19198 | H:1 | 19245 | H:1 |
| 19079 | C:2 | 19126 | H:1 | 19199 | H:1 | 19246 | H:1 |
| 19080 | F:2 K:10 | 19127 | K:3 | 19200 | H:1 | 19247 | H:1 |
| 19081 | F:5 | 19128 | F:6 K:1 | 19201 | H:1 | 19248 | H:1 |
| 19082 | F:2 K:1 | 19129 | K:3 | 19202 | H:1 | 19249 | H:1 |
| 19083 | F:2 I:1 | 19130 | C:3 | 19203 | H:1 | 19250 | H:1 |
| 19084 | H:1 | 19131 | K:2 | 19204 | H:1 | 19251 | H:1 |
| 19085 | H:2 | 19132 | F:17 K:9 | 19205 | K:2 | 19252 | H:1 |
| 19086 | H:2 | 19133 | F:8 K:2 | 19206 | H:1 | 19253 | H:1 |
| 19087 | A:1 B:1 I:1 | 19134 | C:1 | 19207 | H:1 | 19254 | H:1 |
| 19088 | C:2 | 19135 | H:1 I:1 | 19208 | H:1 | 19255 | H:1 |
| 19089 | K:4 | 19136 | B:2 | 19209 | H:1 | 19256 | H:1 |
| 19090 | B:2 | 19137 | K:2 | 19210 | H:1 | 19257 | H:1 |
| 19091 | B:2 | 19138 | C:6 H:2 | 19211 | H:1 | 19258 | H:1 |
| 19092 | F:3 H:1 K:1 | 19139 | B:1 | 19212 | H:1 | 19259 | H:1 |
| 19093 | C:1 H:2 | 19140 | A:1 | 19260 | H:1 | 19307 | H:1 |
| 19094 | F:1 K:1 | 19141 | C:16 | 19261 | H:1 | 19308 | H:1 |
| 19095 | A:4 | 19142 | H:2 | 19262 | H:1 | 19309 | H:1 |
| 19096 | F:23 K:4 | 19143 | K:1 | 19263 | H:1 | 19310 | H:1 |
| 19097 | F:1 | 19144 | K:1 | 19264 | H:1 | 19311 | H:1 |
| 19098 | F:1 | 19145 | A:1 | 19265 | H:1 | 19312 | H:1 |
| 19099 | F:1 | 19146 | C:1 | 19266 | H:1 | 19313 | H:1 |
| 19100 | F:1 | 19147 | A:5 | 19267 | H:1 | 19314 | K:2 |
| 19101 | F:1 K:2 | 19148 | A:9 F:1 H:2 I:4 | 19268 | H:1 | 19315 | H:1 |
| 19102 | K:2 | 19149 | A:2 | 19269 | H:1 | 19316 | H:1 |
| 19103 | B:4 | 19150 | B:2 | 19270 | H:1 | 19317 | H:1 |
| 19104 | A:5 | 19151 | A:2 K:1 | 19271 | H:1 | 19318 | H:1 |
| 19105 | B:2 | 19152 | A:1 | 19272 | H:1 | 19319 | H:1 |
| 19106 | H:12 | 19153 | K:1 | 19273 | H:1 | 19320 | H:1 |
| 19107 | F:1 K:2 | 19154 | A:1 | 19274 | H:1 | 19321 | H:1 |
| 19108 | H:14 | 19155 | K:1 | 19275 | H:1 | 19322 | H:1 |
| 19109 | C:5 | 19156 | A:1 | 19276 | H:1 | 19323 | H:1 |
| 19110 | K:2 | 19157 | A:1 | 19277 | H:1 | 19324 | H:1 |
| 19111 | K:4 | 19158 | A:1 | 19278 | H:1 | 19325 | C:39 D:1 |
| 19112 | C:2 | 19159 | C:31 | 19279 | H:1 | 19326 | H:1 |
| 19113 | K:2 | 19160 | K:1 | 19280 | H:1 | 19327 | H:1 |
| 19114 | A:1 H:1 | 19161 | K:5 | 19281 | H:1 | 19328 | H:1 |
| 19115 | A:1 C:18 F:1 K:3 | 19162 | K:1 | 19282 | K:2 | 19329 | H:1 |
| 19116 | C:1 | 19163 | F:5 K:1 | 19283 | H:1 | 19330 | H:1 |
| 19117 | C:10 | 19164 | B:3 | 19284 | H:1 | 19331 | H:1 |
| 19118 | F:1 | 19165 | H:2 | 19285 | H:1 | 19332 | H:1 |
| 19166 | F:3 | 19213 | H:1 | 19286 | H:1 | 19333 | H:1 |
| 19167 | B:2 | 19214 | H:1 | 19287 | H:1 | 19334 | H:1 |
| 19168 | C:57 | 19215 | H:1 | 19288 | H:1 | 19335 | H:1 |
| 19169 | F:8 K:2 | 19216 | H:1 | 19289 | H:1 | | |
| 19170 | K:3 | 19217 | H:1 | 19290 | H:1 | | |
| 19171 | F:1 | 19218 | H:1 | 19291 | H:1 | | |
| 19172 | F:1 | 19219 | H:1 | 19292 | C:3 | | |
| 19173 | F:1 | 19220 | H:1 | 19293 | H:1 | | |
| 19174 | K:3 | 19221 | H:1 | 19294 | H:1 | | |
| 19175 | F:2 | 19222 | H:1 | 19295 | H:1 | | |
| 19176 | F:2 | 19223 | H:1 | 19296 | H:1 | | |
| 19177 | C:35 | 19224 | H:1 | 19297 | H:1 | | |
| 19178 | C:2 | 19225 | H:1 | 19298 | H:1 | | |

TABLE V-continued (Spatial distribution)

| Seq Id No. | Tissue distribution | Seq Id No. | Tissue distribution |
|---|---|---|---|
| 19299 | H:1 | | |
| 19300 | H:1 | | |
| 19301 | H:1 | | |
| 19302 | H:1 | | |
| 19303 | K:2 | | |
| 19304 | H:1 | | |
| 19305 | H:1 | | |
| 19306 | H:1 | | |

TABLE VI (Tissue type)

| Letter Code | Tissue type |
|---|---|
| A | Brain |
| B | FoetalBrain |
| C | FoetalKidney |
| D | FoetalLiver |
| E | Hypophysis |
| F | Liver |
| G | Placenta |
| H | Prostate |
| I | Salivary Gland |
| J | Stomach/Intestine |
| K | Testis |

(Biais in spatial distribution)

| Seq Id No. | Low frequency | High frequency |
|---|---|---|
| 38 | Brain, Prostate, fetalBrain, fetalKidney | Liver, Testis |
| 43 | fetalKidney | |
| 91 | Testis, fetalKidney | |
| 135 | Liver, Testis, fetalKidney | Brain, Prostate, fetalBrain, fetalLiver |
| 159 | Testis | fetalKidney |
| 181 | Brain, Liver, Testis, fetalBrain, fetalLiver | fetalKidney |
| 304 | Testis, fetalKidney | Brain |
| 365 | fetalKidney | Testis |
| 566 | Brain, Prostate, fetalKidney | Liver, Testis |
| 579 | fetalKidney | |
| 582 | | fetalKidney |
| 686 | Brain, Testis | fetalKidney |
| 697 | Testis | |
| 715 | fetalKidney | |
| 769 | Testis, fetalKidney | |
| 778 | fetalKidney | Testis |
| 790 | Brain, Liver, Testis | Prostate |
| 818 | Testis | fetalKidney |
| 819 | Testis | fetalKidney |
| 873 | Liver, Testis | fetalBrain |
| 881 | Liver, Testis, fetalKidney | Brain, Prostate |
| 909 | Testis | Brain |
| 937 | Testis | |
| 994 | fetalKidney | |
| 1088 | Liver, Testis | fetalBrain |
| 1089 | Liver | |
| 1091 | fetalKidney | |
| 1144 | fetalKidney | Testis |
| 1172 | Brain, Liver, Prostate, Testis, fetalBrain, fetalKidney | |
| 1180 | Brain, Prostate, fetalKidney | Testis |
| 1185 | Brain | Testis |
| 1186 | Liver, Testis | Prostate, fetalBrain, fetalLiver |
| 1203 | fetalKidney | |
| 1210 | Brain, Prostate, fetalBrain, fetalKidney | Liver, Testis |
| 1245 | Testis | fetalKidney |
| 1250 | Brain, fetalKidney | Liver |
| 1251 | Brain, Stomach_Intestine Testis, fetalKidney, fetalLiver | Liver, Prostate |
| 1252 | Brain, fetalKidney | Liver, Prostate |
| 1261 | Brain, Prostate, fetalBrain, fetalKidney | Liver, Testis |
| 1312 | fetalKidney | |
| 1343 | Brain, Liver, Prostate, Testis, fetalBrain | fetalKidney |
| 1345 | Brain, Liver, Testis | fetalBrain, fetalKidney |
| 1346 | Brain, Liver, Testis | Prostate, fetalBrain, fetalKidney |
| 1362 | fetalKidney | |

-continued (Biais in spatial distribution)

| Seq Id No. | Low frequency | High frequency |
|---|---|---|
| 1377 | fetalKidney | |
| 1408 | | fetalKidney |
| 1409 | Testis | fetalKidney |
| 1415 | Liver, Stomach_Intestine, Testis, salivaryGland | Brain, fetalBrain, fetalLiver |
| 1416 | Brain, Liver, Prostate, Testis, fetalBrain | fetalKidney |
| 1419 | | fetalKidney |
| 1516 | Brain, Testis | fetalKidney |
| 1526 | fetalKidney | |
| 1530 | fetalKidney | |
| 1552 | Testis, fetalKidney | Brain |
| 1563 | Liver, Testis | fetalKidney |
| 1564 | Liver, Testis | fetalKidney |
| 1592 | | fetalKidney |
| 1596 | Brain, Testis, fetalKidney, fetalLiver | Liver, fetalBrain |
| 1606 | Brain, Liver, Prostate, Testis | fetalKidney |
| 1632 | fetalKidney | |
| 1635 | fetalKidney | |
| 1643 | fetalKidney | |
| 1649 | Brain, fetalBrain, fetalKidney | Testis |
| 1669 | Brain, Prostate, fetalBrain, fetalKidney | Testis |
| 1677 | Brain, fetalKidney | Liver, Testis |
| 1683 | | fetalKidney |
| 1750 | Liver, Prostate, Testis, fetalBrain, fetalKidney | Brain |
| 1775 | Brain, Liver, Prostate, Testis, fetalBrain, fetalKidney | |
| 1787 | fetalKidney | |
| 1803 | Liver, Testis, fetalKidney | Brain |
| 1806 | fetalKidney | |
| 1808 | Liver, Testis, fetalKidney | |
| 1819 | | fetalKidney |
| 1860 | Brain, fetalKidney | Testis |
| 1863 | fetalKidney | |
| 1867 | Liver, Prostate, Testis | fetalBrain |
| 1972 | fetalKidney | |
| 1973 | Brain, Liver, Prostate, Testis | fetalKidney |
| 2005 | Brain, Liver, Testis | fetalKidney |
| 2006 | fetalKidney | |
| 2009 | Brain, Liver, Testis | Prostate, fetalKidney |
| 2017 | Brain, Prostate, fetalKidney | Testis, fetalBrain |
| 2082 | Brain, Liver, Testis, fetalBrain | fetalKidney |
| 2100 | Brain, Prostate, fetalBrain, fetalKidney | Testis |
| 2367 | Brain, Prostate, Stomach_Intestine, fetalBrain, fetalKidney, fetalLiver | Testis |
| 2379 | Liver, Prostate, Testis, fetalBrain, fetalKidney | Brain |
| 2384 | Brain, Prostate, fetalBrain, fetalKidney | Liver |
| 2411 | Liver, Testis | Brain, fetalBrain |
| 2453 | Brain, Prostate, fetalBrain, fetalKidney | Testis |
| 2485 | Testis, fetalKidney | Brain |
| 2487 | Brain, Liver, Testis | Prostate, fetalBrain, fetalLiver |
| 2508 | Brain, Prostate, fetalBrain, fetalKidney | Testis |
| 2545 | Brain, Liver, Prostate, Testis, fetalBrain, fetalKidney | |
| 2587 | fetalKidney | |
| 2608 | Brain, Liver, Testis | Prostate, fetalBrain, fetalKidney |
| 2612 | fetalKidney | |
| 2614 | fetalKidney | |
| 2623 | Brain, Prostate, fetalKidney | Liver, Testis |
| 2652 | Prostate, fetalBrain | Brain, Testis |
| 2660 | fetalKidney | |
| 2671 | Brain, Liver, Testis | fetalKidney |
| 2673 | | fetalKidney |
| 2675 | Brain, Prostate, fetalBrain, fetalKidney | Testis |
| 2728 | Liver, Testis | fetalBrain, fetalLiver |
| 2743 | | fetalKidney |
| 2761 | | fetalKidney |
| 2766 | Brain | fetalKidney |
| 2768 | Brain | fetalKidney |
| 2769 | Liver, Prostate, Testis | fetalKidney |
| 2772 | | fetalKidney |
| 2815 | Liver, Testis | fetalBrain |
| 2828 | Brain, Testis | fetalKidney |
| 2845 | Brain, Liver, Prostate, Testis | fetalBrain, fetalKidney |
| 2863 | Prostate, fetalKidney | Liver, Testis |
| 2870 | Testis, fetalKidney | |
| 2874 | Brain, fetalKidney | Testis |

-continued (Biais in spatial distribution)

| Seq Id No. | Low frequency | High frequency |
|---|---|---|
| 2881 | fetalKidney | |
| 2931 | Brain, Liver, Testis | Prostate |
| 2933 | Liver, Prostate, Testis | fetalKidney |
| 2938 | Brain, Liver, Testis, salivaryGland | Prostate, fetalLiver |
| 2940 | Brain, Liver, Testis, fetalKidney | Prostate |
| 2945 | Testis, fetalKidney | Brain |
| 2968 | fetalKidney | |
| 2981 | Liver, Testis | fetalKidney |
| 3005 | Brain, Prostate | Testis |
| 3034 | fetalKidney | |
| 3047 | | fetalKidney |
| 3084 | fetalKidney | |
| 3099 | | fetalKidney |
| 3121 | fetalBrain, fetalKidney | Liver, Testis |
| 3122 | fetalBrain, fetalKidney | Liver, Testis |
| 3133 | Brain, Liver, Testis | fetalKidney |
| 3144 | Liver, Testis | fetalBrain, fetalKidney |
| 3145 | | Testis |
| 3149 | fetalKidney | |
| 3156 | Brain, Liver, Prostate, Testis, fetalBrain | |
| 3172 | Testis | fetalKidney |
| 3178 | | fetalKidney |
| 3182 | | fetalKidney |
| 3204 | Liver, Testis | |
| 3250 | Liver | |
| 3251 | fetalKidney | Testis |
| 3252 | Liver, fetalKidney | |
| 3253 | Liver, fetalKidney | |
| 3254 | Brain, Liver, Stomach_Intestine, fetalBrain, fetalKidney, salivaryGland | Prostate |
| 3290 | | fetalKidney |
| 3343 | Brain, Liver, Stomach_Intestine, Testis, salivaryGland | fetalBrain, fetalKidney, fetalLiver |
| 3344 | Testis | fetalKidney |
| 3362 | Brain, Prostate, fetalBrain, fetalLiver | Testis |
| 3363 | Brain, Prostate, fetalBrain | Testis |
| 3364 | Brain, Prostate, fetalBrain, fetalLiver | Testis |
| 3369 | Liver, Testis, fetalKidney | Brain |
| 3384 | | fetalKidney |
| 3422 | Brain, Prostate, Stomach_Intestine, fetalBrain, fetalKidney, fetalLiver | Testis |
| 3430 | Brain, fetalKidney | Testis |
| 3457 | fetalKidney | |
| 3466 | Liver, Prostate, Testis, fetalKidney | Brain, fetalBrain, fetalLiver, salivaryGland |
| 3482 | fetalKidney | |
| 3509 | Brain, Liver, Testis | fetalKidney |
| 3555 | | fetalKidney |
| 3556 | Brain | fetalKidney |
| 3564 | Testis, fetalKidney | Brain |
| 3568 | Brain, Liver, Prostate, Testis | fetalBrain |
| 3569 | Liver, Testis | fetalBrain, fetalKidney |
| 3582 | Testis, fetalKidney | |
| 3584 | Testis, fetalKidney | Brain |
| 3593 | Brain, fetalKidney | Testis |
| 3601 | | fetalKidney |
| 3612 | Testis | |
| 3618 | Liver, Testis, fetalKidney | Prostate |
| 3664 | Brain Stomach_Intestine, Testis, fetalBrain, fetalLiver, salivaryGland | Liver, Prostate |
| 3666 | Brain, fetalBrain, fetalKidney | Liver, Prostate |
| 3701 | fetalKidney | |
| 3738 | Brain, Liver, Prostate, Testis, fetalBrain | fetalKidney |
| 3744 | Liver, Testis | fetalKidney |
| 3753 | Testis | |
| 3756 | | fetalKidney |
| 3775 | Testis | fetalKidney |
| 3778 | fetalKidney | |
| 3779 | Liver, Prostate, Testis | fetalBrain, fetalKidney |
| 3780 | Brain, Liver, Prostate, Testis | fetalBrain, fetalKidney |
| 3793 | Liver, Prostate, Testis, fetalBrain, fetalKidney | Brain |
| 3794 | Liver, Prostate, Testis, fetalBrain, fetalKidney, fetalLiver | Brain |
| 3826 | Liver, Prostate, Testis | fetalBrain, fetalKidney |
| 3827 | Brain, Prostate, fetalBrain, fetalKidney | Testis |
| 3839 | fetalKidney | |

-continued (Biais in spatial distribution)

| Seq Id No. | Low frequency | High frequency |
|---|---|---|
| 3840 | fetalKidney | |
| 3848 | Liver, Prostate, Testis, fetalBrain, fetalKidney | Brain |
| 7872 | Brain, Prostate, fetalBrain, fetalKidney, fetalLiver | Testis |
| 8884 | Brain, Liver, Prostate, Testis, fetalBrain | fetalKidney |
| 9093 | fetalKidney | |
| 9177 | Liver, Prostate, Testis, fetalBrain, fetalKidney, fetalLiver | Brain |
| 9185 | Liver, Prostate, Stomach_Intestine, Testis, fetalBrain, fetalKidney, fetalLiver | Brain |
| 9217 | Testis | fetalKidney |
| 9396 | Brain, Prostate, fetalBrain, fetalKidney | Testis |
| 9411 | Brain, Prostate, Stomach_Intestine, fetalBrain, fetalKidney, fetalLiver, salivaryGland | Testis |
| 9731 | fetalKidney | |
| 9800 | Brain, Liver, Testis | fetalKidney |
| 9880 | Brain, fetalKidney | Testis |
| 9918 | | fetalKidney |
| 10295 | Brain, Liver, Testis | Prostate, fetalKidney |
| 11067 | Brain, Liver, Testis | Prostate, fetalKidney |
| 11747 | fetalKidney | |
| 12327 | Brain, Liver, Prostate, Testis, fetalBrain | fetalKidney |
| 13449 | Brain, Liver, Prostate, Testis, fetalBrain | fetalKidney |
| 13627 | Brain, Liver, Testis, fetalBrain, fetalKidney | Prostate |
| 13767 | fetalKidney | |
| 14546 | Liver, Testis | |
| 14654 | Brain, Liver, Prostate, Testis, fetalBrain | fetalKidney |
| 15013 | Liver, Prostate | |
| 15129 | Brain, Liver, Prostate, Testis, fetalBrain | fetalKidney |
| 15141 | Testis | fetalKidney |
| 15196 | Brain, Testis | fetalKidney |
| 15200 | Brain, Liver, Testis | fetalBrain, fetalKidney, fetalLiver |
| 15202 | Brain, Liver, Testis | fetalBrain, fetalKidney, fetalLiver |
| 15244 | Brain, Liver, Testis, fetalKidney | |
| 15294 | Brain, Prostate, Stomach_Intestine, fetalBrain, fetalKidney, fetalLiver, salivaryGland | Liver |
| 15297 | fetalKidney | Testis |
| 15301 | | fetalKidney |
| 15341 | Brain, Liver, Prostate, Testis | fetalKidney |
| 15405 | Liver | |
| 15419 | Brain, Prostate, fetalBrain, fetalKidney | Testis |
| 15453 | Brain, Prostate, fetalBrain, fetalKidney | Testis |
| 15490 | Brain, Liver, Prostate, Testis, fetalBrain, salivaryGland | fetalKidney |
| 15512 | fetalKidney | |
| 15520 | Brain, Liver, Testis | Prostate, fetalBrain, fetalKidney |
| 15542 | Liver, Prostate, Stomach_Intestine, Testis, fetalBrain, fetalKidney, fetalLiver, salivaryGland | Brain |
| 15553 | Brain, Liver, Testis, fetalKidney | Prostate |
| 15557 | | fetalKidney |
| 15558 | | fetalKidney |
| 15568 | Liver, Testis, fetalKidney | Brain |
| 15573 | Liver, Testis | fetalBrain, fetalKidney |
| 15594 | Testis, fetalKidney | |
| 15613 | Brain, fetalKidney | Liver |
| 15640 | Brain, Liver, Prostate, Testis, fetalBrain | fetalKidney |
| 15651 | Testis | fetalKidney |
| 15658 | Testis | |
| 15659 | fetalKidney | Testis |
| 15678 | fetalKidney | |
| 15685 | fetalKidney | |
| 15711 | Brain, Liver, Testis | Prostate, fetalBrain, fetalKidney |
| 15747 | Brain, Liver, Stomach_Intestine, Testis, fetalBrain, fetalLiver | Prostate |
| 15748 | Liver, Testis | Prostate, fetalBrain, fetalKidney |
| 16065 | | fetalKidney |
| 16072 | fetalKidney | |
| 16091 | Brain, Liver, Prostate, Testis | fetalKidney |
| 16127 | Brain, Liver, Testis, fetalBrain, fetalKidney | Prostate |
| 16151 | Brain, Liver, Prostate, Testis | fetalKidney |
| 16153 | Brain, Prostate, fetalBrain, fetalKidney | Testis |
| 16182 | fetalKidney | |
| 16185 | Brain, Liver, Prostate, Testis | fetalKidney |
| 16191 | fetalKidney | |
| 16192 | fetalKidney | |

-continued (Biais in spatial distribution)

| Seq Id No. | Low frequency | High frequency |
|---|---|---|
| 16237 | Liver, Prostate, Testis, fetalBrain, fetalKidney | Brain |
| 16238 | Liver, Prostate, Stomach_Intestine, Testis, fetalBrain, fetalKidney, fetalLiver, salivaryGland | Brain |
| 16243 | fetalKidney | |
| 16248 | Brain, Prostate, Stomach_Intestine, fetalBrain, fetalKidney, fetalLiver | Liver |
| 16277 | fetalKidney | |
| 16302 | Brain, Prostate, fetalKidney | Testis |
| 16312 | | fetal Kidney |
| 16332 | Brain, Liver, Prostate, Testis | fetalKidney |
| 16351 | Brain, Testis | fetalKidney |
| 16352 | Brain, Liver, Prostate, Testis | fetalKidney |
| 16393 | Liver, Prostate, Testis | fetalKidney |
| 16396 | Liver, Testis | fetalBrain |
| 16411 | Brain, Liver, Prostate, Testis, fetalBrain, fetalKidney, fetalLiver, salivaryGland | Stomach_Intestine |
| 16477 | Brain, Liver, Prostate, Testis, fetalBrain | fetalKidney |
| 16497 | fetalKidney | Testis |
| 16597 | fetalKidney | |
| 16657 | Liver, Prostate, Testis | fetalBrain |
| 16684 | fetalKidney | |
| 16738 | Brain, fetalKidney | |
| 16776 | Brain, Liver, Testis | fetalKidney |
| 16790 | Brain, Liver, Testis, salivaryGland | Prostate, fetalLiver |
| 16865 | Brain, Testis | fetalKidney |
| 16867 | Brain, fetalKidney | Liver |
| 16878 | Brain, Prostate, fetalBrain, fetalKidney | Testis |
| 16905 | Brain, Liver, Prostate, Testis, fetalBrain, fetalKidney | |
| 16959 | fetalKidney | |
| 17143 | Brain, Liver, Prostate, Testis, fetalBrain | fetalKidney |
| 17166 | fetalKidney | |
| 17167 | Brain, fetalKidney | Testis |
| 17178 | Brain, Prostate, fetalBrain, fetalKidney | Liver |
| 17197 | fetalKidney | |
| 17198 | Brain, fetalKidney | |
| 17224 | fetalKidney | |
| 17266 | Testis, fetalKidney | |
| 17268 | Brain, Prostate, fetalBrain, fetal Kidney | Testis |
| 17269 | Brain, Prostate, fetalBrain, fetalKidney | Testis |
| 17330 | Brain, Liver, Testis, fetalKidney | |
| 17350 | Brain, Testis | fetalKidney |
| 17351 | Brain, Liver, Prostate, Testis, fetalBrain | fetalKidney |
| 17383 | Brain, Testis | fetalKidney |
| 17391 | Brain, Liver, Testis | fetalKidney |
| 17412 | Brain, Liver, Prostate, Testis, fetalBrain | fetalKidney |
| 17477 | fetalKidney | |
| 17488 | Brain, fetalKidney | Testis |
| 17530 | Brain, Liver, Prostate, Testis | fetalKidney |
| 17541 | Brain, Prostate, fetalBrain, fetalKidney | Testis |
| 17565 | Liver, Prostate, Testis, fetalKidney | Brain |
| 17572 | Brain, Liver, Testis | fetalBrain, fetalKidney |
| 17580 | Liver, Testis | fetalBrain, fetalKidney |
| 17638 | fetalKidney | Testis |
| 17640 | fetalKidney | |
| 17644 | Brain, Liver, Prostate, Stomach_Intestine, Testis, fetalBrain, fetalLiver, salivaryGland | fetalKidney |
| 17652 | Brain, Prostate, fetalKidney | Testis |
| 17706 | fetalKidney | |
| 17710 | Brain, Liver, Prostate, Testis, fetalBrain | fetalKidney |
| 17712 | fetalKidney | |
| 17717 | Brain, Liver, Prostate | fetalBrain, fetalKidney |
| 17748 | Testis | fetalKidney |
| 17774 | | fetalKidney |
| 17796 | Brain, Liver, Prostate, Testis, fetalBrain | fetalKidney |
| 17820 | | fetalKidney |
| 17850 | Brain, Liver, Prostate, Testis | fetalKidney |
| 17881 | Brain, Prostate, fetalBrain, fetalKidney, fetalLiver | Liver, Testis |
| 17883 | Brain, Prostate, fetalBrain, fetalKidney | Liver, Testis |
| 17913 | Brain, Liver, Prostate, Testis, fetalBrain, fetalLiver | fetalKidney |

-continued

(Biais in spatial distribution)

| Seq Id No. | Low frequency | High frequency |
|---|---|---|
| 17970 | Liver, Prostate, Stomach_Intestine, Testis, fetalBrain, fetalKidney, fetalLiver | Brain |
| 17989 | | fetalKidney |
| 18074 | Brain, Testis, fetalKidney | |
| 18085 | Brain, Prostate, fetalBrain, fetalKidney | Liver, Testis |
| 18126 | Brain, Prostate, fetalBrain, fetalKidney | Liver, Testis |
| 18130 | Brain, Liver, Prostate, Testis, fetalBrain, fetalKidney | |
| 18174 | Prostate, Testis, fetalKidney | fetalBrain |
| 18182 | | fetalKidney |
| 18289 | Brain, Testis | fetalBrain, fetalKidney |
| 18301 | fetalKidney | |
| 18322 | | fetalKidney |
| 18325 | Testis | fetalKidney |
| 18331 | Brain, Testis | fetalKidney |
| 18364 | | fetalKidney |
| 18373 | | fetalKidney |
| 18392 | | fetalKidney |
| 18446 | Testis | fetalKidney |
| 18447 | Testis | fetalKidney |
| 18449 | | fetalKidney |
| 18478 | Brain, Liver, Stomach_Intestine, Testis, fetalLiver | Prostate, fetalBrain, fetalKidney |
| 18507 | Brain, Liver, Prostate, Testis, fetalBrain | fetalKidney |
| 18508 | | fetalKidney |
| 18519 | Brain, Testis | fetalKidney |
| 18549 | Brain, Liver, Testis | fetalKidney |
| 18584 | Brain, Liver, Prostate, Testis | fetalKidney |
| 18598 | Brain, Liver, Prostate, Testis, fetalBrain | fetalKidney |
| 18621 | fetalKidney | |
| 18624 | fetalKidney | Testis |
| 18677 | | fetalKidney |
| 18683 | Brain, Testis | fetalKidney |
| 18691 | Liver, Prostate, Testis | Brain, fetalBrain, fetalKidney |
| 18735 | Brain, Liver, Prostate, Testis, fetalBrain | fetalKidney |
| 18852 | fetalKidney | |
| 18911 | Testis | |
| 18951 | fetalKidney | |
| 18967 | Brain, Liver, Testis | fetalKidney |
| 18992 | Brain, Prostate, Stomach_Intestine, fetalBrain, fetalKidney, fetalLiver, salivaryGland | Liver, Testis |
| 18998 | fetalKidney | |
| 19002 | Testis | Brain, fetalKidney |
| 19021 | Liver, Prostate, Testis, fetalBrain, fetalKidney | Brain |
| 19045 | fetalKidney | |
| 19068 | Liver, Testis, fetalKidney | Brain |
| 19096 | fetalKidney | |
| 19115 | | fetalKidney |
| 19121 | Brain, Liver, Prostate, Testis, fetalBrain | fetalKidney |
| 19132 | fetalKidney | |
| 19159 | Testis | fetalKidney |
| 19168 | Brain, Liver, Prostate, Testis, fetalBrain | fetalKidney |
| 19177 | Brain, Testis | fetalKidney |
| 19325 | Brain, Liver, Testis | fetalKidney |

SEQUENCE LISTING (19335 sequences)

SEQ ID NO: 1 - DNA, 822 bp, Homo Sapiens
  CDS 346..552
  sig_peptide 346..408: Von Heijne matrix
  misc_feature 115: n=a, g, c or t
actccttttagcataggggcttcggcgccagcggccagcgctagtcggtctggtaagtgcctgatgccgagttccgtctctcgcgtcttttcctggtcccaggcaaagcggasgnagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccaraaaaatgcttatttggggcaatgctaaatattgcggcagttttatgtcaaaaatagaaatcaggaarataattcaacttaaagaakttcatttcatgaccaaactcttcaraaacatgtctttacaagcatatctcttgtattgctttctacactgttgaattgtctggcaatatttctgcagtggaaaatttgatttarmtagttcttgactgataaatatggtaaggtgggcttttccccctgtgtaattggctactatgtcttactgagccaagttgtawtttgaaataaaatgatatgagagtgacacaaaaaaaaaaa

SEQ ID NO: 2 - protein, 21 aa, Homo Sapiens
  SIGNAL -21..-1
MWWFQQGLSFLPSALVIWTSA

SEQ ID NO: 3 - DNA, 526 bp, Homo Sapiens
  CDS 90..344
  sig_peptide 90..140: Von Heijne matrix
  misc_feature 290: n=a, g, c or t
aatatraracagctacaatattccagggccartcacttgccatttctcataacagcgtcagagagaaagaactgactgaracgtttgagatgaagaaagttctcctcctgatcacagccatcttggcagtggctgtwggtttcccagtctctcaagaccaggaacgagaaaaaagaagtatcagtgacagcgatgaattagcttcaggrwtttttgtgttcccttacccatatccatttcgcccacttccaccaattccatttccaagatttccatggtttagacgtaantttcctattccaatacctgaatctgcccctacaactccccttcctagcgaaaagtaaacaaraaggaaaagtcacrataaacctggtcacctgaaattgaaattgagccacttccttgaaraatcaaaattcctgttaataaaaraaaaacaaatgtaattgaaatagcacacagcattctctagtcaatatctttagtgatcttctttaataaacatgaaagcaaaaaaaaaaaa

SEQ ID NO: 4 - protein, 17 aa, Homo Sapiens
  SIGNAL -17..-1
MKKVLLLITAILAVAVG

SEQ ID NO: 5 - DNA, 848 bp, Homo Sapiens
  CDS 32..697
  sig_peptide 32..73: Von Heijne matrix
aactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtadaaraaagaacaaagaaccatctgaagtggatgacgctgaarataaktgtgaaaacatgatcacaattgaaaatggcatcccctctgatcccctggacatgaagggagggcatattaatgatgccttcatgacagaggatgagaggctcacccctctctgaagggctgttgttctgcttcctcaaraaattaaacatttgtttctgtgtgactgctgagcatcctgaaataccaagagcagatcatatwttttgtttcaccattcttcttttgtaataaattttgaatgtgcttgaaaaaaaaaaaaac

SEQ ID NO: 6 - protein, 14 aa, Homo Sapiens
  SIGNAL -14..-1
MLWLLFFLVTAIHA

SEQ ID NO: 7 - DNA, 826 bp, Homo sapiens
  CDS 15..695
  sig_peptide 15..80: Von Heijne matrix score 8.5 seq AALLLGLMMVVTG/DE
aaccagaggtgcccatgggttggacaatgaggctggtcacagcagcactgttactgggtctcatgatggtggtcactggagacgaggatgagaacagcccgtgtgcccatgaggccctcctggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaggtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaatcatccaaaaaaaaaaaaa

SEQ ID NO: 8 - protein, 227 aa, Homo sapiens
  SIGNAL -22..-1
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 9 - DNA, 982 bp, Homo sapiens
  CDS 72..944
  sig_peptide 72..197: Von Heijne matrix score 7.19999980926514 seq ILFSLSFLLVIIT/FP
gctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattagggagtatgaacgtgctgttgtattccgtctgggacgcatccaagctgacaaagccaaggggccaggtttgatcctggtcctgccatgcatagatgtgtttgtcaaggttgacctccgaacagttacttgcaacattcctccacaagagatcctcaccagagactccgtaactactcaggtagatggagttgtctattacagaatctatagtgctgtctcagcagtggctaatgtcaacgatgtccatcaagcaacatttctgctggctcaaaccactctgagaaatgtcttagggacacagaccttgtcccagatcttagctggacgagaagagatcgcccatagcatccagactttacttgatgatgccaccgaactgtgggggatccgggtggcccgagtggaaatcaaagatgttcggattcccgtgcagttgcagagatccatggcagccgaggctgaggccacccgggaagcgagagccaaggtccttgcagctgaaggagaaatgagtgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctaaaaaaaaaaaaa

SEQ ID NO: 10 - protein, 291 aa, Homo sapiens
  SIGNAL -42..-1
MDSRVSSPEKQDKENFVGVNNKRLGVCGWILFSLSFLLVIITFPISIWMCLKIIREYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMSASKSLKSASMVLAESPIALQLRYLQTLSTVATEKNSTIVFPLPMNILEGIGGVSYDNHKKLPNKA

SEQ ID NO: 11 - DNA, 571 bp, Homo sapiens
  CDS 74..295
  sig_peptide 74..196: Von Heijne matrix score 5.40000009536743 seq RLLYIGFLGYCSG/LI
cgggtagtggtcgtcgtggttttccttgtagttcgtggtctgagaccaggcctcaagtggaaacggcgtcaccatgatcgcacggcggaacccagtacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggccttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgttcctgaatttgatggaacatgtttcttatgacagttgaagcttatgctaatctgtatgttgacaccttgtaattaaaatacgtaccaaaaaaaaaaa

SEQ ID NO: 12 - protein, 74 aa, Homo sapiens
  SIGNAL -41..-1
MIARRNPVPLRFLPDEARSLPPPKLTDPRLLYIGFLGYCSGLIDNLIRRRPIATAGLHRQLLYITAFFLLDIIL

SEQ ID NO: 13 - DNA, 1198 bp, Homo sapiens
  CDS 26..397
  sig_peptide 26..316: Von Heijne matrix score 4 seq RLPLVVSFIASSS/AN
atcctgcgaaagaagggggttcatcatggcggatgacctaaagcgattcttgtataaaaagttaccaagtgttgaagggctccatgccattgttgtgtcagatagagatggagtacctgttgttaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggagcttgctccattgtttgaagaactgagacaagttgtggaagtttcttaatctgacagtggtttcagtgtgtaccttatcttcattataacaacacaatatcaatccagcaatctttagactacaataatgcttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggattagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggtacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaagtaaaaaaaaaaaa

SEQ ID NO: 14 - protein, 124 aa, Homo sapiens
  SIGNAL -97..-1
MADDLKRFLYKKLPSVEGLHAIVVSDRDGVPVVKVANDNAPEHALRPGFLSTFALATDQGSKLGLSKNKSIICYYNTYQVVQFNRLPLVVSFIASSSANTGLIVSLEKELAPLFEELRQVVEVS

SEQ ID NO: 15 - DNA, 25 bp, Artificial Sequence
  oligonucleotide
gggaagatggagatagtattgcctg

SEQ ID NO: 16 - DNA, 26 bp, Artificial Sequence
  oligonucleotide
ctgccatgtacatgatagagagattc

SEQ ID NO: 17 - DNA, 546 bp, Homo Sapiens
  promoter 1..517
  misc_feature 518: codon transcription start
  protein_bind 17..25: matinspector prediction name CMYB_01 score 0.983 sequence tgtcagttg
  protein_bind complement(18..27): matinspector prediction name MYOD_Q6 score 0.961 sequence cccaactgac
  protein_bind complement(75..85): matinspector prediction name S8_01 score 0.960 sequence aatagaattag
  protein_bind 94..104: matinspector prediction name S8_01 score 0.966 sequence aactaaattag
  protein_bind complement(129..139): matinspector prediction name DELTAEF1_01 score 0.960 sequence gcacacctcag
  protein_bind complement(155..165): matinspector prediction name GATA_C score 0.964 sequence agataaatcca
  protein_bind 170..178: matinspector prediction name CMYB_01 score 0.958 sequence cttcagttg
  protein_bind 176..189: matinspector prediction name GATA1_02 score 0.959 sequence ttgtagataggaca
  protein_bind 180..190: matinspector prediction name GATA_C score 0.953 sequence agataggacat
  protein_bind 284..299: matinspector prediction name TAL1ALPHAE47_01 score 0.973 sequence cataacagatggtaag
  protein_bind 284..299: matinspector prediction name TAL1BETAE47_01 score 0.983 sequence cataacagatggtaag
  protein_bind 284..299: matinspector prediction name TAL1BETAITF2_01 score 0.978 sequence cataacagatggtaag
  protein_bind complement(287..296): matinspector prediction name MYOD_Q6 score 0.954 sequence accatctgtt
  protein_bind complement(302..314): matinspector prediction name GATA1_04 score 0.953 sequence tcaagataaagta
  protein_bind 393..405: matinspector prediction name IK1_01 score 0.963 sequence agttgggaattcc
  protein_bind 393..404: matinspector prediction name IK2_01 score 0.985 sequence agttgggaattc
  protein_bind 396..405: matinspector prediction name CREL_01 score 0.962 sequence tgggaattcc
  protein_bind 423..436: matinspector prediction name GATA1_02 score 0.950 sequence tcagtgatatggca
  protein_bind complement(478..489): matinspector prediction name SRY_02 score 0.951 sequence taaaacaaaaca
  protein_bind 486..493: matinspector prediction name E2F_02 score 0.957 sequence tttagcgc
  protein_bind complement(514..521): matinspector prediction name MZF1_01 score 0.975 sequence tgagggga
tgagtgcagtgttacatgtcagttgggttaagtttgttaatgtcattcaaatcttctatgtcttgatttgcctgctaattctattatttctggaactaaattagtttgatggttctattagttattgactgaggtgtgctaatctcccattatgtggatttatctatttcttcagttgtagataggacattgatagatacataagtaccaggacaaaagcagggagatcttttttccaaaatcaggagaaaaaaatgacatctggaaaacctatagggaaaggcataacagatggtaaggatactttatcttgagtaggagagccttcctgtggcaacgtggagaagggaagaggtcgtagaattgaggagtcagctcagttagaagcagggagttgggaattccgttcatgtgatttagcatcagtgatatggcaaatgtgggactaagggtagtgatcagagggttaaaattgtgtgttttgttttagcgctgctggggcatcgccttgggtcccctcaaacagattcccatgaatctcttcat

SEQ ID NO: 18 - DNA, 23 bp, Artificial Sequence
  oligonucleotide
gtaccagggactgtgaccattgc

SEQ ID NO: 19 - DNA, 24 bp, Artificial Sequence
  oligonucleotide
ctgtgaccattgctcccaagagag

SEQ ID NO: 20 - DNA, 861 bp, Homo Sapiens
  promoter 1..806
  misc_feature 807: codon transcription start
  protein_bind complement(60..70): matinspector prediction name NFY_Q6 score 0.956 sequence ggaccaatcat
  protein_bind 70..77: matinspector prediction name MZF1_01 score 0.962 sequence cctgggga
  protein_bind 124..132: matinspector prediction name CMYB_01 score 0.994 sequence tgaccgttg
  protein_bind complement(126..134): matinspector prediction name VMYB_02 score 0.985 sequence tccaacggt
  protein_bind 135..143: matinspector prediction name STAT_01 score 0.968 sequence ttcctggaa
  protein_bind complement(135..143): matinspector prediction name STAT_01 score 0.951 sequence ttccaggaa
  protein_bind complement(252..259): matinspector prediction name MZF1_01 score 0.956 sequence ttggggga
  protein_bind 357..368: matinspector prediction name IK2_01 score 0.965 sequence gaatgggatttc
  protein_bind 384..391: matinspector prediction name MZF1_01 score 0.986 sequence agagggga
  protein_bind complement(410..421): matinspector prediction name SRY_02 score 0.955 sequence gaaaacaaaaca
  protein_bind 592..599: matinspector prediction name MZF1_01 score 0.960 sequence gaagggga
  protein_bind 618..627: matinspector prediction name MYOD_Q6 score 0.981 sequence agcatctgcc
  protein_bind 632..642: matinspector prediction name DELTAEF1_01 score 0.958 sequence tcccaccttcc
  protein_bind complement(813..823): matinspector prediction name S8_01 score 0.992 sequence gaggcaattat
  protein_bind complement(824..831): matinspector prediction name MZF1_01 score 0.986 sequence agagggga
  misc_feature 335,376: n=a, g, c or t
tactatagggcacgcgtggtcgacggccgggctgttctggagcagagggcatgtcagtaatgattggtccctggggaaggtctggctggctccagcacagtgaggcatttaggtatctctcggtgaccgttggattcctggaagcagtagctgttctgtttggatctggtagggacagggctcagagggctaggcacgagggaaggtcagaggagaaggsaggsarggcccagtgagargggagcatgccttcccccaaccctggcttscycttggymamagggcgkttytgggmacttraaytcagggcccaascagaascacaggcccaktcntggctsmaagcacaatagcctgaatgggatttcaggttagncagggtgagaggggaggctctctggcttagttttgttttgttttccaaatcaaggtaacttgctcccttctgctacgggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcac

SEQ ID NO: 21 - DNA, 20 bp, Artificial Sequence
  oligonucleotide
ctgggatggaaggcacggta

SEQ ID NO: 22 - DNA, 20 bp, Artificial Sequence
  oligonucleotide
gagaccacacagctagacaa

SEQ ID NO: 23 - DNA, 555 bp, Homo Sapiens
  promoter 1..500
  misc_feature 501: codon transcription start
  protein_bind 191..206: matinspector prediction name ARNT_01 score 0.964 sequence ggactcacgtgctgct
  protein_bind 193..204: matinspector prediction name NMYC_01 score 0.965 sequence actcacgtgctg
  protein_bind 193..204: matinspector prediction name USF_01 score 0.985 sequence actcacgtgctg
  protein_bind complement(193..204): matinspector prediction name USF_01 score 0.985 sequence cagcacgtgagt
  protein_bind complement(193..204): matinspector prediction name NMYC_01 score 0.956 sequence cagcacgtgagt
  protein_bind complement(193..204): matinspector prediction name MYCMAX_02 score 0.972 sequence cagcacgtgagt
  protein_bind 195..202: matinspector prediction name USF_C score 0.997 sequence tcacgtgc
  protein_bind complement(195..202): matinspector prediction name USF_C score 0.991 sequence gcacgtga
  protein_bind complement(210..217): matinspector prediction name MZF1_01 score 0.968 sequence catgggga
  protein_bind 397..410: matinspector prediction name ELK1_02 score 0.963 sequence ctctccggaagcct
  protein_bind 400..409: matinspector prediction name CETS1P54_01 score 0.974 sequence tccggaagcc
  protein_bind complement(460..470): matinspector prediction name AP1_Q4 score 0.963 sequence agtgactgaac
  protein_bind complement(460..470): matinspector prediction name AP1FJ_Q2 score 0.961 sequence agtgactgaac
  protein_bind 547..555: matinspector prediction name PADS_C score 1.000 sequence tgtggtctc
ctatagggcacgcktggtcgacggcccgggctggtctggtctgtkgtggagtcgggttgaaggacagcatttgtkacatctggtctactgcaccttccctctgccgtgcacttggcctttkawaagctcagcaccggtgcccatcacagggccggcagcacacacatcccattactcagaaggaactgacggactcacgtgctgctccgtccccatgagctcagtggacctgtctatgtagagcagtcagacagtgcctgggatagagtgagagttcagccagtaaatccaagtgattgtcattcctgtctgcattagtaactcccaacctagatgtgaaaacttagttctttctcataggttgctctgcccatggtcccactgcagacccaggcactctccggaagcctggaaatcacccgtgtcttctgcctgctcccgctcacatcccacacttgtgttcagtcactgagttacagattttgcctcctcaatttctcttgtcttagtcccatcctctgttcccctggccagtttgtctagctgtgtggtctc

SEQ ID NO: 24 - DNA, 342 bp, Homo sapiens
  CDS 109..342
  sig_peptide 109..186: Von Heijne matrix score 15.6000003814697 seq LLLLLLSPWPVWA/HV
aatatttgtgcaggcgccgcaggaacgggctccgcggacgacgggctccagggacgcwcaggcagcgggcctcccaccgcgggtgccgggggcgggggggctgcccccatgcggggcccttcctggtcgcggcctcggccgctgctgctgctgttgctgctgctgtcgccttggcctgtctgggcccatgtgtcggccacgghctcgccctcggggtccctgggcgccccggactgcccccgaggtgtgcacgtgcgtgccgggaggcctggccagctgctcggcactctcgctgcccgmcgtgcccccgggcctgagcctgcgcctgcgcggcgctgctgy

SEQ ID NO: 25 - DNA, 365 bp, Homo sapiens
  CDS 63..365
  sig_peptide 63..131: Von Heijne matrix score 14.3999996185303 seq LGLLLFLLPGSLG/AE
  misc_feature 25: n=a, g, c or t
aggagccggccagggccgcacrggnaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctsgcstgccccggggactcctgccttctgggtgtccggctggctgggcccgcagcagtacctgagctacaatagcctgcggggcgaggcggacctgtggagcttgggtctgggaaaaccaggtgtcctggtattgggagaaagagaccacagatctgaggatcaaggagaagctctttctggaagcttt

SEQ ID NO: 26 - DNA, 557 bp, Homo sapiens
  CDS 73..555
  sig_peptide 73..147: Von Heijne matrix score 14.1000003814697 seq LTLLLLLTLLAFA/GY
actgcgcggatcggcgtccgcagcgggcggctgctgagctgccttgaggtgcagtgttggggatccagagccatgtcggacctgctactactgggcctgattgggggcctgactctcttactgctgctgacgctgctagcctttgccgggtactcagggctactggctggggtggaagtgagtgctgggtcaccccccatccgcaacgtcactgtggcctacaagttccacatggggctctatggtgagactgggcggcttttcactgagagctgcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacmcgccgtgtccatcctgccttggacacctacatcaaggagcggaa

SEQ ID NO: 27 - DNA, 514 bp, Homo sapiens
  CDS 363..512
  sig_peptide 363..422: Von Heijne matrix score 13.8000001907349 seq LLLXLLSMGGTWA/SK
agcacctttctcgggtcacggcctcctcctggctcccaggaccccaccataggcagaggcaggccttcctacaccctactccctgtgcctccaggctcgactagtccctagcactcgacgactgagtctctgaggtcacttcaccgtggtctccgcctcacccttggcgctggaccagtgagargagagggctggggcgctccgctgagccactcctgcgcccccctggccttgtctacctcttgccccccgaggggttagtgtcgagctcactccagcatcctacaacctcctggtggccttgccgcccccacaaccccgaggtttaaagccaggtacacgaggcaggggacacaccaaggatggagatgttccaggggctgctgctgttgcwgctgctgagcatgggcgggacatgggcatccaaggagccgcttcggccacggtgccgccccatcaatgccaccctggctgtggagaaggagggctgccccgtgtgcatcaccgtcaacac

SEQ ID NO: 28 - DNA, 487 bp, Homo sapiens
  CDS 21..485
  sig_peptide 21..89: Von Heijne matrix score 13.8000001907349 seq VLLLLLLSGDVQS/SE
ctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtgggg

SEQ ID NO: 29 - DNA, 334 bp, Homo sapiens
  CDS 105..332
  sig_peptide 105..161: Von Heijne matrix score 12.3000001907349 seq LLILALLAWVALA/DQ
ctcctkscctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggt

SEQ ID NO: 30 - DNA, 368 bp, Homo sapiens
  CDS 166..366
  sig_peptide 166..243: Von Heijne matrix score 12.3000001907349 seq LLSCLILLCQVQG/EE
aaaaaaaacccagtctttgctgacsagacaaagcataccagwtctcaccagagagtcctaggggactacagaaggaaaaagacaagaggcagcaggatatctgtgtgtcctcccgctgaccacacttcctttagtgacccgattgcstcctcaagtcgcagaactatgctgcstcccatggccctgcccagtgtgtcctggatgctgctttcctgcctcattctcctgtgtcaggttcaaggtgaagaaacccagaaggaastgccstctccacggatcrgctgtcccaaaggctccaaggtgaggagcattagtaacagctactcatacatctggattgggctccatgaccccacacagtgctctga

SEQ ID NO: 31 - DNA, 506 bp, Homo sapiens
  CDS 52..504
  sig_peptide 52..117: Von Heijne matrix score 12.1999998092651 seq LALALGLAQPASA/RR
ctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttbgctcagactacatcagtgatgaggcgctggagtcattgcctggtttcaaagagattgtgagcaggggagtaaaagtggattacttgactccagacttccctagtctctcgtatcccaattattataccctaatgactggmcgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggtgagtgtgtgaacatccattccaaatctcaaaa

SEQ ID NO: 32 - DNA, 519 bp, Homo sapiens
  CDS 107..517
  sig_peptide 107..190: Von Heijne matrix score 11.6000003814697 seq LLLLVQLLRFLRA/DG
agtgcggctctgggctggccgaagggtggcgctgcgatcccgcagcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaa

SEQ ID NO: 33 - DNA, 479 bp, Homo sapiens
  CDS 157..477
  sig_peptide 157..219: Von Heijne matrix score 11.6000003814697 seq LLLCLALSGAAET/KP
aaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtkgcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccga

SEQ ID NO: 34 - DNA, 397 bp, Homo sapiens
  CDS 233..397
  sig_peptide 233..292: Von Heijne matrix score 11.6000003814697 seq LLLLFLASXCCLG/SA
attctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgsccttccccggctccgctccctctgcmccctcggggtcgcgcgcccacgatgctgcagggccctggctcgctgctgctgctcttcctcgcvtcgmactgctgcctgggctcggcgcgcgggctcttcctctttrgccagcmcgamttctcctacaagcgcasaarttgcaagcccatcccggccaamctgcagctgtgccacggcatcgaatac

SEQ ID NO: 35 - DNA, 484 bp, Homo sapiens
  CDS 60..482
  sig_peptide 60..119: Von Heijne matrix score 11.5 seq LVLEFLLLXPVEA/QQ
  misc_feature 9: n=a, g, c or t
aawrcctgngacgccgacccgggaccgccgctggctggctgctggctcactcgaccgtcatggagaccctgggggcccttctggtgctggagtttctgctcctctscccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaaagacagcaaaggaaggagagagcaaacttgggactggatctggaggaaaaagagcccggagaccatgagagagcaaagagcacagtcatgtgaagattcctggctgcctcttccaggcagtcc

SEQ ID NO: 36 - DNA, 454 bp, Homo sapiens
  CDS 284..454
  sig_peptide 284..337: Von Heijne matrix score 11.1999998092651 seq LLLLGGLWSAVGA/SX
atttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatsagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccakcctgggtgtcgttacttgcggctccgtggtgaagctactcaatacgcgccacaacgtccgactgcactcacacgacgtgcgctatgggtcaggtaatgctggggacgggctc

SEQ ID NO: 37 - DNA, 482 bp, Homo sapiens
  CDS 35..481
  sig_peptide 35..85: Von Heijne matrix score 11.1999998092651 seq SWLLLSLVAVTAA/QS
attmagtggatgtgatcttrrctcacaggrgacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatg

SEQ ID NO: 38 - DNA, 491 bp, Homo sapiens
  CDS 77..490
  sig_peptide 77..133: Von Heijne matrix score 11 seq SLVLLLCLTCSYA/FM
accaggtgcccagtcttccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgcmrtryggagagcactttcggattcggcagaayctaccagagcacacccaaggctggcttgggagcaaatggctctggcttytktttgytgttgtgccgtttgtgatactgmagtgtcaaagagacagtgagaagaataaggagcagagtcctcctggccttcgaggcttcccatttcgcactccactaaagaaaaatcaaaatgcttctctttacaaagactgtgtattcaataccttaaacgaacttgaagtggagcttttgaaatttgtgtccgaagtgcaaaatcttaaaggtgccatggcaa

SEQ ID NO: 39 - DNA, 678 bp, Homo sapiens
  CDS 107..676
  sig_peptide 107..154: Von Heijne matrix score 11 seq FPLLLLSLGLVLA/EA
agtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaawcagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctggaatg

SEQ ID NO: 40 - DNA, 249 bp, Homo sapiens
  CDS 31..249
  sig_peptide 31..90: Von Heijne matrix score 10.8999996185303 seq AVLALLSLSGLEA/IQ
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagac

SEQ ID NO: 41 - DNA, 442 bp, Homo sapiens
  CDS 81..440
  sig_peptide 81..143: Von Heijne matrix score 10.8000001907349 seq SLICLCALQLVSA/LE
actactccggagtcaggaggcagcagcggcggaggacgaggatctctggcagtcagcgcggctcggacgccgccggcaccatgggctgctgcaccggasgctgctcgctcatctgcctctgcgcgctgcagttggtctcagcattagagaggcagatctttgasttccttggtttccartgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctcc

SEQ ID NO: 42 - DNA, 425 bp, Homo sapiens
  CDS 23..424
  sig_peptide 23..88: Von Heijne matrix score 10.8000001907349 seq LLLPLLLLLVATT/GP
gaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgmcggcctcagacatgctgcacatgagatgggacgaggagctggccgccttcgccaaggcctacgcacggcagtgsgtkwggggccacaacaaggagcgcgggcgccgcggcgagaatctgttcgccatcacagacgagggcatggacgtgccgctggccatggaggagtggcaccacgagcgtgagcactacaacctcagcgccgscacctgcagcccargccagatgtgcsgscactacacgcaagtggtatggg

SEQ ID NO: 43 - DNA, 512 bp, Homo sapiens
  CDS 53..511
  sig_peptide 53..103: Von Heijne matrix score 10.6999998092651 seq VLMLLAVLIWTGA/EN
acttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattaatcttct

SEQ ID NO: 44 - DNA, 339 bp, Homo sapiens
  CDS 118..339
  sig_peptide 118..189: Von Heijne matrix score 10.6000003814697 seq LLLLLLCPAHVGG/LW
tccccggccgccgccgttgcgctcgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctggctcggggcgcccggctcggggtgcga

SEQ ID NO: 45 - DNA, 544 bp, Homo sapiens
  CDS 185..544
  sig_peptide 185..229: Von Heijne matrix score 10.5 seq LLLWACIVCVAFA/RK
taggtatacagacagtagttaaatagcagggccaactattctgttaagggtcttcctagacagactaaaaaagccatgtattctttcgtttctctctaaaagaagaaaaatataatttaaaaatacattgcgtattttctaaaacaataaatttatagtgttaatattcatagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttccgtttgtccctccttcaaggttttttttcagca

SEQ ID NO: 46 - DNA, 484 bp, Homo sapiens
  CDS 9..482
  sig_peptide 9..113: Von Heijne matrix score 10.1999998092651 seq LLPLVLLPPLAAA/AA
  misc_feature 8: n=a, g, c or t
tgccaggnatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaattacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgstctggctctggctac

SEQ ID NO: 47 - DNA, 495 bp, Homo sapiens
  CDS 69..494
  sig_peptide 69..146: Von Heijne matrix score 9.89999961853027 seq LLFFSVATSGCSA/AA
aggatcctctgcaggggagctccgagtgtccacaggaagggaactatcagctcctggcatctgtaaggatgctgtccatgctgaggacaatgaccagactctgcttcctgttattcttctctgtggccaccagtgggtgcagtgcagcagcctcttctcttgagatgctctcgagggaattcgaaacctgtgccttctccttttcttccctgcctagaagctgcaaagaaatcaaggaacgctgccatagtgcaggtgatggcctgtattttctccgcaccaagaatggtgttgtctaccagaccttctgtgacatgacttctgggggtggcggctggaccctggtggccagcgtgcacgagaatgacatgcgtgggaagtgcacggtgggtgatcgctggtccagtcagcagggcaacaaagcagactacccagagggggatggcaactgggccaactacaacacctttggatctgcagaggcggccacgagcg

SEQ ID NO: 48 - DNA, 535 bp, Homo sapiens
  CDS 316..534
  sig_peptide 316..378: Von Heijne matrix score 9.69999980926514 seq WILVLVLPIQAFP/KP
tcacttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctacccgccccacacccaccctcctggctcttcctgtttttactcctccttttcattcataacaaaagctacagctccaggagcccagcgccgggctgtgacccaagccgagcgtggaagaatggggttcmtcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgata

SEQ ID NO: 49 - DNA, 432 bp, Homo sapiens
  CDS 27..431
  sig_peptide 27..116: Von Heijne matrix score 9.5 seq LLFLSQFCILSGG/ES
cccggaagtgcgcaggcgctggcaagatggcgggaggggtgcgcccgctgcggggcctccgcgccttgtgtcgcgtgctgctcttcctttcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcggg

SEQ ID NO: 50 - DNA, 410 bp, Homo sapiens
  CDS 54..410
  sig_peptide 54..284: Von Heijne matrix score 9.19999980926514 seq AAAGCWLLPGCEA/AP
  misc_feature 236..237: n=a, g, c or t
acacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttycaggramaaargytggccggbtgcccggaacctggktccgtgtagnnacagccctgctgctgctggctgttggctgctccctggctgtgaggcagctccagaatcarggcargtcgacarggaaactttggcctctgtgsccctccacccggcggacactcccacggccctggcgtataccaccacggtgccatcatcagccctgcagactgctgtgagc

SEQ ID NO: 51 - DNA, 465 bp, Homo sapiens
  CDS 164..463
  sig_peptide 164..211: Von Heijne matrix score 9.10000038146973 seq ISLLLKCSHGCWA/RW
taaatttaaaaaatttaatgttaataaagcgaggtgtaattgtatatgtagggttttatatacctggtctccctctttctgtttttgtaactgagtttttaagttaacaatgagctctttcaactatctcttgtccctgtgagttatatggaatacttgtagtatgagtaatatttcactgctgttaaaatgcagccatggctgytgggcgcggtggctcacgcctgtaatcccagcactttgggaggccaaggcgggcggatcacgaggtcaggagatcaagaccacggtgaaacccgtctctactaaaaatacaaaaaaaattagccgggcgcacggcggtgtgcctgtagtcccagctactcgggaggctgaggcaggagaatggcgtgaacccgggaggcggacttgcagtgaaccgagattggtcactgcactccagcctgggcgacagagcaagactcc

SEQ ID NO: 52 - DNA, 547 bp, Homo sapiens
  CDS 94..546
  sig_peptide 94..162: Von Heijne matrix score 9.10000038146973 seq VLLLLLLLRRAEQ/PC
tacatcctcctaggacccggtcggtagtcgtcgccccagcccgccgggggcgcasgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttrcttcagtaatgagttttccaccttctctcacaagaccgtctactttgactttcaagtgggcgatgagcctcccattctcccagacatggggaacagggtcacagctctcacccagatggagtcmgcctgcgtgaccatccatgaggctctga

SEQ ID NO: 53 - DNA, 482 bp, Homo sapiens
  CDS 74..481
  sig_peptide 74..139: Von Heijne matrix score 9 seq FILAALSLSTTFS/LQ
gctccaaactaatacggactgaacggatcgctgcgaggattatcttacactgaactgatcaagtactttgaaaatgacttcgaaatttatcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcag

SEQ ID NO: 54 - DNA, 505 bp, Homo sapiens
  CDS 27..503
  sig_peptide 27..80: Von Heijne matrix score 8.89999961853027 seq LFCLAVLAASSFS/KA
agcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgcygggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacag

SEQ ID NO: 55 - DNA, 546 bp, Homo sapiens
  CDS 260..544
  sig_peptide 260..313: Von Heijne matrix score 8.80000019073486 seq RLVLIILCSVVFS/AV
cagcccagtcggcccggcccgggggccatggagctccgagcggcgatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagcmctgcmgcagctgtrccgtggtgtccagctccggccaaatgctgggctcaggcctgggtgctgagatcgacag

SEQ ID NO: 56 - DNA, 507 bp, Homo sapiens
  CDS 297..506
  sig_peptide 297..416: Von Heijne matrix score 8.80000019073486 seq CLHLLLLLQIALS/HK
aaggtctctctgcatgcatacaccaaggaaaagccacatgaggacataaccaggaagagagccatcaccaagaacccgaacatgcggacaccctgatctcggacttctagccttcagaaccgttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctactatgcggcattcttctgattcatttttctccatttgtgctgtttttctctgtgatgtgaatccatccctatccattatgtcatgcctccatcttttgctgcttcttcagattgcactgagccataagaggaagcccctgtggtggccagagcagccttgttcctggaatgtgctcgttttgttcaccgctgcaaccgtggcaactggccaga

SEQ ID NO: 57 - DNA, 480 bp, Homo sapiens
  CDS 27..479
  sig_peptide 27..83: Von Heijne matrix score 8.80000019073486 seq SAVLSGFVLGALA/FQ
ctcttgtgtagcctgaggcgcggtasatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacatt

SEQ ID NO: 58 - DNA, 392 bp, Homo sapiens
  CDS 163..390
  sig_peptide 163..219: Von Heijne matrix score 8.80000019073486 seq SALLLATCSPSNS/FT
ctaccctctgcgtccaagacaggaagaggaactgtgatgccggawcctgggcagttttaaaactaccatttctttttttacctgtaactctagacattatataakkbkbagwraaaaaatcctgttagcatgagthacgggctctgttcctagcctcccttcatgccacattcattakcaagtgctctcctgctcgccacttgcagtccttccaacagcttcacacacacccagtcccgcccgsctccatcccagccagccctagagttgagcttagtgtggatctgckttgtagccagctctcctcacttaacaggtactttctycaaaaacctaagaaccaaagtcttccgcttgcaacttgggatggtgatatggctgtgtccccatcc

SEQ ID NO: 59 - DNA, 273 bp, Homo sapiens
  CDS 85..273
  sig_peptide 85..177: Von Heijne matrix score 8.80000019073486 seq FFTLLGFLFCCCC/CC
attgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatgaaaaaaagcaaaaaaaaaacaaaaaaaaaaaaaaaaaa

SEQ ID NO: 60 - DNA, 273 bp, Homo sapiens
  CDS 85..273
  sig_peptide 85..177: Von Heijne matrix score 8.80000019073486 seq FFTLLGFLFCCCC/CC
attgtatatactgttttattataaatcgtggattgtatattgcattctgtaaacctgctgtggtcccgtggtgtgcaaattcgcatggtgggggggagggagaagaacctcttgcgggasctttttttttctttcttatttttcactcttttgggttttctcttctgttgttgttgttgttgttttctgttggcaggacacacccaaagatccaagtttgtattaaaaagaaatgaaaaaaagcaaaaaaaaaacaaaaaaaaaaaaaaaaag

SEQ ID NO: 61 - DNA, 273 bp, Homo sapiens
  CDS 31..273
  sig_peptide 31..87: Von Heijne matrix score 8.60000038146973 seq LGFLLVSLESTLS/IP
aataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgbcacttycccttycagtaccaccggcagctgtaccacaaatgtacccacaagggccggscaggccctcagccctggtgtgctaccacccccaactttgatcar

SEQ ID NO: 62 - DNA, 256 bp, Homo sapiens
  CDS 46..255
  sig_peptide 46..129: Von Heijne matrix score 8.39999961853027 seq FLLLVSMWRQVHS/SW
aaaaggattgtccycccgggcyggcagcagggccccagcggcaccatgtctgcccycggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgt

SEQ ID NO: 63 - DNA, 343 bp, Homo sapiens
  CDS 154..342
  sig_peptide 154..231: Von Heijne matrix score 8.39999961853027 seq RLLRLLLSGLVLG/AA
ctttcctcttcctcctcctcctccttggcatccgcctcttcttcctcctgcgtcctcccccgctgcctccgctgctcccgacgcggagcccggtagyycgcgccgagcccctggcctcgcggtgccatgctgccccggcggcggcgctgaaggatggcgacgccgctgcctccgccctccccgcggmacctgcggctgctgcggctgctgctctccggcctcgtcctcggcgccgccctgcgtggagccgycgmcggccacccggatgtagccgcctgtcccgggagcctggactgtgccctgaaraggckggcaaggtgtcctcctggtgcacatgcctgtg

SEQ ID NO: 64 - DNA, 277 bp, Homo sapiens
  CDS 34..276
  sig_peptide 34..117: Von Heijne matrix score 8.39999961853027 seq FLLLVSMWRQVHS/SW
ctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacg

SEQ ID NO: 65 - DNA, 174 bp, Homo sapiens
  CDS 5..172
  sig_peptide 5..127: Von Heijne matrix score 8.39999961853027 seq FVLLLCCWQETEL/RP
aaggatgggaaactgtcaaccttcagaacgtccttctccctcagctggagggagcatggcagtgagccaaggagacgggaccctctgctttgtcctcctgctgtgctgttggcaagaaactgagctccggccgagaaccgtgattccaggttcacctactgaaataccattcag

SEQ ID NO: 66 - DNA, 481 bp, Homo sapiens
  CDS 144..479
  sig_peptide 144..209: Von Heijne matrix score 8.30000019073486 seq LLLPLMLMSMVSS/SL
aaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaag

SEQ ID NO: 67 - DNA, 478 bp, Homo sapiens
  CDS 233..478
  sig_peptide 233..328: Von Heijne matrix score 8.19999980926514 seq LVAAMVLLSVVFC/LY
atgaatgtcagaataggcccattctaccagctctggctgagcctgagcttccaaaagtgagctgagctgttcaaccttggatcttaattactcctagcagggataattaggtccctctttctcagattacaggtttgagaagttccaaatatccgatgccctagaggtttttttcccttaattttattgttacaattggccttcatctagctctggatggttgaactgtagcatggcaaagatgtttgatctcaggacgaagatcatgatcggcatcggaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccakgccaaagccaccaccatggagtcttgtccatctctccagtgctgt

SEQ ID NO: 68 - DNA, 323 bp, Homo sapiens
  CDS 115..321
  sig_peptide 115..210: Von Heijne matrix score 8.19999980926514 seq LVAAMVLLSVVFC/LY
attctaccagctctggctgagcctgagcttccaaaagtgagctgagctgttcaaccttggatcttaattactcctagcagggataattaggtccctctttctcagattacaggcatggcaaagatgtttgatctcaggacgaagatcatgatcggcatcgaaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccaggccaaagc

SEQ ID NO: 69 - DNA, 443 bp, Homo sapiens
  CDS 72..443
  sig_peptide 72..119: Von Heijne matrix score 8.19999980926514 seq AFALCLLWQALWP/GP
agacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtrcgggcgccgagctgcgcgctgtgctcgcgctcctgcgggcaggcccagggcccggaggggctccaaagacctgctgttctgggtcgcactggagcgcaggcgttcccactgcaccctggagaacgagcctttgcggggtttctcctggctgtmctccgaccccggcggtctcgaaa

SEQ ID NO: 70 - DNA, 473 bp, Homo sapiens
  CDS 317..472
  sig_peptide 317..463: Von Heijne matrix score 8.19999980926514 seq SLRFCLLVSLITA/AT
aggggaagggttttgcagaagtacccagaactgtgtccaaggtttcctcagatttgggctgttccgcagcggcaggtcccgggaaccaaggcaacagacatcttcctaggctcgcgagagcccccttgtcccacggctgctggggccccccagtagccatggctccggtgtccggctcacgcaacccggatagggaggcctcgggctcggggggaagacgtcgcagttcgtcgaagagtccgaagcccagcaaatctgcccgctccccgcgggccgccgctctcgctcgcactcttgctctcggtccggggacgaaatggactcacccatcagctgggtggcctcagccaaggctcccgaaaccagtcctaccgctcacgctcgcggtcgcgttctagagagcggccctctgcgccccggggcatcccttcgcttctgcctcctcgtcagtctaattacggcagctactcgcg

SEQ ID NO: 71 - DNA, 329 bp, Homo sapiens
  CDS 143..328
  sig_peptide 143..217: Von Heijne matrix score 8.10000038146973 seq PLLLLCCASFLLG/LA
atctactttctacagtctgtggagamagttgtgtccctgtggctttggtgcgcctgtgtgcaytttctccctccacctggagcatgggctaacaccggagaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggawtgggggc

SEQ ID NO: 72 - DNA, 488 bp, Homo sapiens
  CDS 65..487
  sig_peptide 65..121: Von Heijne matrix score 8.10000038146973 seq IFVLLPHLGPSWS/GC
atatatgtcatcaggccccccgcctgggaggtgtgctgccagagattttgcctcttcaaggtgaatgcggcttcaaggggctatctttgtgctcctgccccacctgggcccatcctggtctggctgttcactcgtgatcacatgtctggttggtgtgagggcccgaggatgctgtcctggtgcccattctacaaagtcttattgcttgtacagacagccatctactctgtcgtgggctatgctcctacctggtgtggaaggacctgggagggggcttggggtggcccctggcctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctca

SEQ ID NO: 73 - DNA, 268 bp, Homo sapiens
  CDS 38..268
  sig_peptide 38..112: Von Heijne matrix score 8.10000038146973 seq ATLLLVLCLQLGA/NK
acttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagaactatcaaaaaaaaaaaaaaaarraaaaaaaaaaraaaaaaaaaaaaaaaaaaaaaaaaaaawwawwaaaaaaaaaaaaaaaaaaaaaaaaaaaaaaa

SEQ ID NO: 74 - DNA, 417 bp, Homo sapiens
  CDS 85..417
  sig_peptide 85..234: Von Heijne matrix score 8 seq AFLQLCLLRQIHQ/IP
acactggtacagtcacctagcccatcagttccttcgtcgacagcgccggggacatccagactacaatttacagttcctctatccatgtgctgggttataaatcatgccatcctccctagaatgagaatgcacagcaagcggcagacaatcacccggcattcggcatctctttcttttcacgcgctccctcgctccgcctttctccagctctgccttctcaggcagatacatcagataccttgtttatccatcttcagctccactctgagggcgcagacgcacgattccgggatcgggtgcaccacggcgaascaggcgggagacggcaggagcagctcaggtaaccaggggaagcttgcgtgcccacggagatgcagccgtggagctgtgaggaaagacggtctggcttcaaaaaaa

SEQ ID NO: 75 - DNA, 420 bp, Homo sapiens
  CDS 85..420
  sig_peptide 85..234: Von Heijne matrix score 8 seq AFLQLCLLRQIHQ/IP
acattggtacagtcacctagcccatcagttccttcgtcgacagcgccggggacatccagactacaatttacagttcctctatccatgtgctgggttataaatcatgccatcctccctagaatgagaatgcacagcaagcggcagacaatcacccggcattcggcatctctttcttttcacgcgctccctcgctccgcctttctccagctctgccttctcaggcagatacatcagataccttgtttatccatcttcagctccactctgagggcgcagacgcacgattccgggatcgggtgcaccacggcgaascaggcgggagacggcaggagcagctcaggtaaccaggggaagcttgcgtgcccacggagatgcagccgtggagctgtgaggaaagacggtctggcttcaaaaaaaaaa

SEQ ID NO: 76 - DNA, 486 bp, Homo sapiens
  CDS 248..484
  sig_peptide 248..301: Von Heijne matrix score 7.90000009536743 seq LALLAGLLVGVAS/KS
gaaacccggaggcgccgggtggttcctctggagattaaatgtacttcacagaacctcagcgagcggactccagttatattccgtgctcttgtcggcacgcatttcacttctaggactgggccggggtctgcagggctcagctgagccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtag

SEQ ID NO: 77 - DNA, 436 bp, Homo sapiens
  CDS 171..434
  sig_peptide 171..293: Von Heijne matrix score 7.90000009536743 seq LGSVLALFGVVLG/LM
  misc_feature 12: n=a, g, c or t
gccagcggcggnagtctccaactgggagagctgcagctgccgagaggaggagaacgctgaggtcggtcggaccaacggacgcgctgaccgctgccaactgcagctcgcgctgcctcctgctcgcgccgtgccactaaggtcactcccgcctccgagagcccagagccgagatggaaacggtccaggagctgatccccctggccaaggagatgatggcccagaagcgcaaggggaagatggtgaagctgtacgtrctgggcagcgtgctggccctcttcggcgtggtgctcggcctgatggagactgtgtgcagccccttcacggccgccagacgtctgcgggaccaggaggcagccgtggcggrstgcaggccgccctggagcgacaggctctccagaagcaagccctgcaggagaaaggcaagcagcaggacacg

SEQ ID NO: 78 - DNA, 793 bp, Homo sapiens
  CDS 263..793
  sig_peptide 263..358: Von Heijne matrix score 7.90000009536743 seq LLGAVSLSPLARP/FP
agagtaaatacaacaggagcgcaaaatggcggaaccgcgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaakggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcgtaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagagagagaaaaaaagaaacataaagtaatgaatgagatcaagaaagagaatggagaagtaaagattttgctgaaaagtgggaaggagaaaccaaaaacaaatatagaagacttacaaattaaaaaggcaaaaaaaaaaaaaaaa

SEQ ID NO: 79 - DNA, 443 bp, Homo sapiens
  CDS 168..443
  sig_peptide 168..290: Von Heijne matrix score 7.90000009536743 seq LGSVLALFGVVLG/LM
  misc_feature 10,360: n=a, g, c or t
gccagcgsgnagtctccaactgggagagctgcagctgccgagaggaggagaacgctgaggtcggtcggaccaacggacgcgctgaccgctgccaactgcagctcgcgctgctcctgctcgcgccgtgccactaaggtcactcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcgnastgcaggccgccctggagcgacaggctctccagaagcaagccctgcaggagaaaggcaagcagcaggacacggtcctcggcg

SEQ ID NO: 80 - DNA, 308 bp, Homo sapiens
  CDS 112..306
  sig_peptide 112..231: Von Heijne matrix score 7.80000019073486 seq LAALLYLLDPAVS/XP
  misc_feature 233: n=a, g, c or t
agttttgaactttataaaagggtcctgtcacccaaagagctgggggactctaagtttctgagctggtccttagcagttctttctgctcctctccccaacaacttgaggcccatgggcttcttggtccccctccagggcagggtgtctggcagatgcagtctttcatgtctaggtggggctggagctgggacgctagcagctctcctgtaccttctggaccctgctgtctccangccgacatccagccactgggcctccttccctgcagaaatacacgctttgagaagagtaaaaaaaaaaaaaaaaaa

SEQ ID NO: 81 - DNA, 323 bp, Homo sapiens
  CDS 147..323
  sig_peptide 147..200: Von Heijne matrix score 7.69999980926514 seq AFLFLLGVLGALT/EM
gccgtgcattgcaggcatggaggattaatcagtgacaggaagctgcgtctctcggagcggtgaccagctgtggtcaggagagcctcagcagggcccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctamgc

SEQ ID NO: 82 - DNA, 570 bp, Homo sapiens
  CDS 21..569
  sig_peptide 21..116: Von Heijne matrix score 7.59999990463257 seq VTLGIGFFALASA/LW
attggttagaactcagtcatatggcttcacctaaaggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaatyttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaa

SEQ ID NO: 83 - DNA, 468 bp, Homo sapiens
  CDS 289..468
  sig_peptide 289..345: Von Heijne matrix score 7.5 seq LAVFFLVSTQLFA/EE
agatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaagcactgagcaggcgaaagagcgcgctcggacctccttcccggcggcagctaccgagagtgcggasgaccagcgtgcgctcggaggaaccagagaaactcagcaccccgcggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaag

SEQ ID NO: 84 - DNA, 461 bp, Homo sapiens
  CDS 295..459
  sig_peptide 295..369: Von Heijne matrix score 7.40000009536743 seq WCLILCATCGSHG/TH
tccatctgccttgtggscaagaaaggggttgcctttcacaattttttggagagtacaaatcatkybtgtgacaaacatcgcccaacacagaacatccaacatgggcatgtgggggaggaaagctgcatcttatgttgtgaagacttatcccaacagagtgttgmgaasatccagagcccgtgttgtagtcaagccatctaccaccgcaagtgcatacagawatatgcccwyacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcamctgctgcagccacagactacatacctga

SEQ ID NO: 85 - DNA, 468 bp, Homo sapiens
  CDS 289..468
  sig_peptide 289..417: Von Heijne matrix score 7.40000009536743 seq IWMLVLAAMEILA/FE
aaatgacaccagaggaagactgcccttgatagggactataccaagttcttctttgcagcaaaacctcagggttttgagtctcgtattcacatctttttactaagaagggctcctccagactcctggtgtatatttgttggaggccttaagctgttcgtggcagtacattgcggasatagaacgaaacagggtgtggaacactgagtcccaaggatagccatcttcagagatacggctcatgacccagattttctatgatgccacaatgcgctaccaaccaactagttaatgaggattggagccgcgattatatggctggggttctccagtatggcatccccacttcctcccctccaggatgcgttttccctcaaatccatctggatgcttgtattggcggctatggaaatattggcctttgaacctctccataccttcagggggaagaagagagaagtctgtgagctc

SEQ ID NO: 86 - DNA, 516 bp, Homo sapiens
  CDS 300..515
  sig_peptide 300..446: Von Heijne matrix score 7.40000009536743 seq LPLLSFLLSKVQS/PR
gcaacttttcttggcgtgtttaaatcctcatgtctttgagggatcccaccacaggtgaaggaagtaaagaccacttctcccccggtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgccagccccacaa

SEQ ID NO: 87 - DNA, 674 bp, Homo sapiens
  CDS 221..673
  sig_peptide 221..268: Von Heijne matrix score 7.30000019073486 seq FLLLTCLFITGTS/VS
aaaaagcagtgcttctctctggggccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatggcatcctgc

SEQ ID NO: 88 - DNA, 402 bp, Homo sapiens
  CDS 153..401
  sig_peptide 153..371: Von Heijne matrix score 7.30000019073486 seq GIHLLXLLLLIHS/FP
  misc_feature 89..90,95,255: n=a, g, c or t
atcatcggcgctgggaggcggcggcgctgctgagaggcagggacccgagcgcgaagtgtgtgggagtctacgaactcammccctctcwnnmcchnccctcacagccammmccctccctccccgccagcmccccccaacaagcgggagaaataatgarcgagaccgggcggcagcagcagcagcgccgagcagcccaggcaacggcagaaccgctccggcagcggcggcggcggcagcaccagcagcgggagcgangcgcaacgctagcgcggcgcggggaccgccgcsctccttcccggctcctgcmctcctctgcmgctcgctcctctctcggcatccacctccttcmcctcctcctgctcattcactctttccctcactctcccctcctcctcggcttct

SEQ ID NO: 89 - DNA, 473 bp, Homo sapiens
  CDS 209..472
  sig_peptide 209..319: Von Heijne matrix score 7.30000019073486 seq LELLGSSSPPTLA/SQ
tttgaattatagttttaggtatttggacaattttcttcctttgctttcctctccagggattcctacttttttttctttcttcttttagttttgagctttgtcacccaggctggagtacagtagcatgatcttggctcgctgcaacctgtgcctcccaggttcaaacgattctcatgcctcagcctcctgagtagctgggactacaggcatgtgccaccacgcctggctaatttttgtctttttagtagagacagaatttcgccatgttgaccaggctggtcttgaactcctgggctcaagcagtcctcccaccttggcctcccaaaatgttgggattacaggcgtgasaccgcacccggccaatattttcgaaagacacattttaaaggactgttatcagttggaatggtggctggtgtctgtaatcccagcactttgggaggccaagatgagaggatcactgagctcaggag

SEQ ID NO: 90 - DNA, 474 bp, Homo sapiens
  CDS 278..472
  sig_peptide 278..376: Von Heijne matrix score 7.30000019073486 seq LKLLTSGVPPASA/SQ
ttttcttaacagtgaggcaaactatgtatatttacattttgtagaatatttcctccaaaattggtttctgcatactttttgtttttgctatcactgtttgggcttagagtagtatccttgaggctcgtctcatcttttttatttgttttgttttttggttttgttctttgagactgctgcagtacaatggagcgatcccggctcactgcaacctctgcctcgtaggttccagggattctcctgcctcagcctctggagcagctgggattacaggcacatgccaccatgcctggctaatttttgtgtttttagtaaagaccatgttggtcaggctggtctcaaactcctgacctcaggtgttccacctgcstcggcctcccaaagtgctgggattacaggcatgagccactgcgcccggccaaggcttcccttatctaagaatagaatctttaaasvattctgtggttatatcat

SEQ ID NO: 91 - DNA, 570 bp, Homo sapiens
  CDS 355..570
  sig_peptide 355..564: Von Heijne matrix score 7.30000019073486 seq YFLLSLLPLFTFA/GA
agattgttggaagacaatggaagtctagtagctgaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgctttggtcttcttagttttgtactttttgcctcaccgtaaagtactcactagtaaatatttccttctctctttactcccactttttacgtttgcaggtgcc

SEQ ID NO: 92 - DNA, 586 bp, Homo sapiens
  CDS 164..586
  sig_peptide 164..244: Von Heijne matrix score 7.19999980926514 seq VLWLSGLSEPGAA/RQ
ctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagct

SEQ ID NO: 93 - DNA, 311 bp, Homo sapiens
  CDS 54..311
  sig_peptide 54..113: Von Heijne matrix score 7.19999980926514 seq CSLLSCASCLCGS/AP
gaggtccgcgccccgcgcccggcgccgggcgcccgaagccgggagccgccgmcatgggggcctgcctgggagcctgctccctgctcagctgcgcgtcctgcctctgcggctctgccccctgcatcctgtgcagctgctgccccgccagccgcaactccaccgtgagccgsctcatcttcacgttcttcctmttcctgggggtgctggtgtccatcattatgctgagcccgggcgtggagagtcagctmtacaagctgccctgggtgtgtgaggagggggccgggatccccaccgtcctgcarggccacaty

SEQ ID NO: 94 - DNA, 452 bp, Homo sapiens
  CDS 127..450
  sig_peptide 127..276: Von Heijne matrix score 7.19999980926514 seq AWSVVLWSPRTQA/AC
gttcgagggtttgatcgccagcgcasctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggcccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcag

SEQ ID NO: 95 - DNA, 326 bp, Homo sapiens
  CDS 40..324
  sig_peptide 40..300: Von Heijne matrix score 7.09999990463257 seq RVLDCGAAPGAWS/QV
aggcacttccggcggcgcgctgcaggcgggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtgaagagttaccggtgtcgaagcgcyttcaagcycctggaggtgaacgagaggcaccagattctgcggcccggccttcgggtgttagactgtggggcagctcctggggcctggagtcaggtggcggtgcagaaggtcaacgc

SEQ ID NO: 96 - DNA, 383 bp, Homo sapiens
  CDS 1..381
  sig_peptide 1..168: Von Heijne matrix score 7.09999990463257 seq GLPLAGLLLPTLA/AA
  misc_feature 230,298: n=a, g, c or t
atgcgccgccgcctctccgcacgatgttcccctcgcggaggaaagcggcgcastgccctgggaggacggcaggtccgggttgctctccggcggcctccctcggaagtgttccgtcttccacctgttcgtggcctgcctctcgctgggcttcttctccctactctggctgcagctcagctgtctggggacgtggcccgggcagtcaggggacaagggcaggagacctcggnccctccccgtgcctgccccccagagccgccccctgagcactgggaagaagacgcatcctggggccccnaccgcctggcagtgctggtgcccttccgcgaacgcttcgaggagctcctggtcttcgtgccccacatgcgccgcttcctgagcag

SEQ ID NO: 97 - DNA, 672 bp, Homo sapiens
  CDS 227..670
  sig_peptide 227..307: Von Heijne matrix score 7.09999990463257 seq VLLLLLLERGMFS/SP
  misc_feature 586,602..603: n=a, g, c or t
attgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactgkdnagcgatcccacgavhnncaccgtgtsttctacggccacttggacgtgcagcctgctgaccggggcgatgggtggctcacggacccc

SEQ ID NO: 98 - DNA, 451 bp, Homo sapiens
  CDS 76..450
  sig_peptide 76..351: Von Heijne matrix score 7.09999990463257 seq ASLMLLAVLLLLG/CC
cttttcaccctccccgctttgagggaggtgttggaagttcttgcagctgactgcttgtggctcagactctggcccatgctctttaagcaggcagagctatggatgccccatcagggcaaaggcaacaaaggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggaggtgtgcgcccaggggctgctccccaacctctcagctgtgctgtccatcctgccgcggcacctgggacagaccag

SEQ ID NO: 99 - DNA, 482 bp, Homo sapiens
  CDS 117..482
  sig_peptide 117..185: Von Heijne matrix score 7 seq CLLGFSFLLLVIS/SD
aaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggc

SEQ ID NO: 100 - DNA, 498 bp, Homo sapiens
  CDS 34..498
  sig_peptide 34..183: Von Heijne matrix score 6.90000009536743 seq VAALILFLVALLA/RV
  misc_feature 25: n=a, g, c or t
atgcggtgaagggcgagcggcgcgncggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtg

SEQ ID NO: 101 - DNA, 504 bp, Homo sapiens
  CDS 76..504
  sig_peptide 76..192: Von Heijne matrix score 6.90000009536743 seq SALAKLLLXCCSA/LR
acttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcayctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctkaggactctgctagcgctggcagctttctccacagccatcgctgccctcaaactttggaatgaagattttccgaaatgg

SEQ ID NO: 102 - DNA, 248 bp, Homo sapiens
  CDS 72..248
  sig_peptide 72..128: Von Heijne matrix score 6.90000009536743 seq LTPVILALREARA/DG
tcaagaaaaaaaatttttttttttttggaagaatttgaaagctgctgatccagagtcatycctttaagaaaatgggccgggcatggtggctcacacctgtaatcctggcacttcgggaagccagggcagatggatcagttgagctcaggaatgtgagaccagcctgggcaatgtggcaaaaccccgcctctacaaaaawtacaaaaactaggtgggcatggtggcatgcgcctgtagtcccagctact

SEQ ID NO: 103 - DNA, 351 bp, Homo sapiens
  CDS 113..349
  sig_peptide 113..184: Von Heijne matrix score 6.90000009536743 seq GGVALLFLLQVRG/VV
atatttttacactgtgtgattaacattagggagtactgagtgcatcactttatcagtgtgacgggtgatgtccacgtcatggctgttctgactctgaaagccacttctgctgatgtctaaaccgcactcaccgcggacgtccgcgggtggggtggccctgctgttcctcctgcaggtgagaggtgtggtgttgcctgttggacttgctgttgagcctggcttgcaaacctgtagtgaaacagctcgtgtctgtgtgcacactgctcctgtgtctgctgtcgttaacattgtgtgtcaagttggtaaagtgacaaataaaggtgttaaaacatggaaaaaaaaaaaaccaaa

SEQ ID NO: 104 - DNA, 356 bp, Homo sapiens
  CDS 72..356
  sig_peptide 72..128: Von Heijne matrix score 6.90000009536743 seq LTPVILALREARA/DG
tcaagaaaaaaaatttttttttttttggaagaatttgaaagctgctgatccagagtcattcctttaagaaaatgggccgggcatggtggctcacacctgtaatcctggcacttcgggaagccagggcagatggatcagttgagctcaggaatgtgagaccagcctgggcaatgtggcaaaaccccgcctctacaaaaaatacaaaaactaggtgggcatggtggcatgcgcctgtagtcccagctactggggaggccgaggtgggaggatggcttgagccggaaggcagaggttgtagtgagctgagattgcagcactgcactccagcctgggcaacagattcaaaccctgtccca

SEQ ID NO: 105 - DNA, 278 bp, Homo sapiens
  CDS 73..276
  sig_peptide 73..129: Von Heijne matrix score 6.90000009536743 seq LTPVILALREARA/DG
tcaagaaaaaaaatttttttttttttggaagaatttgaaagctggctgatccagagtcattcctttaagaaaatgggccgggcatggtggctcacacctgtaatcctggcacttcgggaagccagggcagatggatcagttgagctcaggaatgtgagaccagcctgggcaatgtggcaaaaccccgcctctacaaaaaatacaaaaactaggtgggcatggtggcatgcgcctgtagtcccagctactggggaggccgaggtgggaggatggcttra

SEQ ID NO: 106 - DNA, 487 bp, Homo sapiens
  CDS 167..487
  sig_peptide 167..262: Von Heijne matrix score 6.80000019073486 seq LLSSCGLPPSTAS/AV
  misc_feature 85: n=a, g, c or t
gtacttccgagagagattaaagattcaatggaactctgcgtctctcatctggaacccaggacacagaacaagggagggaagaaangctcagccttaaacatagcaaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgttt

SEQ ID NO: 107 - DNA, 492 bp, Homo sapiens
  CDS 257..490
  sig_peptide 257..325: Von Heijne matrix score 6.69999980926514 seq LCPSICMCSVSLA/CV
gatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggtgatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattgggggaatgg

SEQ ID NO: 108 - DNA, 453 bp, Homo sapiens
  CDS 274..453
  sig_peptide 274..345: Von Heijne matrix score 6.59999990463257 seq KMVHLLVLSGAWG/MQ
attattggttgggggaaaccacgaggggacgcggccgaggagggtcgctgtccacccgggggcgtgggagtgaggtaccagattcagcccatttggccccgacgcctctgttctcggaatccgggtgctgcggattgaggtcccggttcctaacgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatc

SEQ ID NO: 109 - DNA, 500 bp, Homo sapiens
  CDS 144..500
  sig_peptide 144..287: Von Heijne matrix score 6.59999990463257 seq DLSVICFTSGTTG/DP
agagaaaggcttcaccccgagcctgaaggtgatcatccttatggacccctttgatgatgacctgaagcaaagaggggagaagagtggaattgagatcttatccctatatgatgctgaggtagatgattttctaaagaaatcttatgctcttccctggggcttccattgttcctgaatgttggcttctggtcctgatccagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggct

SEQ ID NO: 110 - DNA, 570 bp, Homo sapiens
  CDS 195..569
  sig_peptide 195..254: Von Heijne matrix score 6.5 seq LAVILTLLGLAIL/AI
atttgcttaggtctgatcaatctgctccacrcaatttctcagtgatcctctgcatctctgcctacaagggcctccctgacacccaagttcatattgctcagaaacagtgaacttgagtttttcrttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacttccttccagaactgcaggagccatgagtaagttctttttctgccctttaattctcatgtgct

SEQ ID NO: 111 - DNA, 584 bp, Homo sapiens
  CDS 116..583
  sig_peptide 116..577: Von Heijne matrix score 6.5 seq LTLLNQLLQGLRQ/DL
aaacacgttcaccacgctccgagctaaggcgcatgcgttccctgaaattgccgccaccggctctaccttccagtttccagttccggcctccaaggggckggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctca

SEQ ID NO: 112 - DNA, 417 bp, Homo sapiens
  CDS 153..416
  sig_peptide 153..260: Von Heijne matrix score 6.5 seq VLILALVLAWLST/YV
agaagccggaagagaacgggaccctgaacagaatcgcagattgccagcccttttcccgacccctacggaaagacgagtycaaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtasaaccagctcctgggcgctattgtgtcagcaggcgacacatccgtcctccamctggggcatgtggaccasctggtggcaggccaaggcaaccccgagccaactgaactcccccatccatcagagggtaatgatgagaa

SEQ ID NO: 113 - DNA, 402 bp, Homo sapiens
  CDS 14..400
  sig_peptide 14..355: Von Heijne matrix score 6.40000009536743 seq LFFTVGFTGCAFG/SA
agaggttgggaagatggcgtggcgaggctgggcgcagagaggctsggsctgcggccaggcgtggggtgcgtcggtgggcggccgcagctgcgaggagctcactgcggtcctaaccccgccgcagctcctcggasgcaggtttaacttstttattcaacaaaaatgcggattcagaaaagcacccaggaaggttgaacctcgaagatcagacccagggacaagtggtgaagcatacaagagaagtgctttgattcctcstgtggaagaaacagtcttttatccttctccctatcctataaggwgtctcataaaacctttattttttactgttgggtttacaggctgtgcatttggatcagctgctatttggcaatatgaatcactgaaatccagggtccagag

SEQ ID NO: 114 - DNA, 525 bp, Homo sapiens
  CDS 9..524
  sig_peptide 9..56: Von Heijne matrix score 6.40000009536743 seq LGTTVLLWSLLRS/SP
agataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccggggagcgttttatt

SEQ ID NO: 115 - DNA, 480 bp, Homo sapiens
  CDS 258..479
  sig_peptide 258..389: Von Heijne matrix score 6.40000009536743 seq LLVLASQSSGITS/VS
tacatatctataaaagcattcctatgatgttctattctcttaaaaactcttccagagactcttctaaaggaatttaaaatacaagtttctgaacagatatagaataccattagttcactggccaagtaataatccacaggctggtatattttaaattcataacagtgtactctgtgcctactaaggtagagaggacacctcccggattcaaatgatcctcctgcctcagcctcctgagtacccgggattacaggcgcatgtcattatgctggccaatttttgtatttttagtagagatggggtttcgccatgttggccaggctggtcccgaactcctggcctcaggtgatctgctcgtcttggcctcccaaagttctgggattacaagtgtgagccaccacacccggcctggagggattaaagtttttagtataaagaacactgtagtatggaaagaccctgtctcaaaaaaatwaaata

SEQ ID NO: 116 - DNA, 496 bp, Homo sapiens
  CDS 223..495
  sig_peptide 223..357: Von Heijne matrix score 6.30000019073486 seq LLALGLFFSLLTL/VP
gttttttcgagactgggtctcattctggtttgcccaagctggagcacagtggcgtgtgtacacacctgacacacctgacagcaacagcttgactgaagcataccctgagaatgaccctgtatggcagaagcgcctggcagcaataacaacctaagaaattagggttgctatgtggaggttgctggggtggagggtgctaagcgaaggtgctatataaactgcatgctttttacaagcagtagcaattctcctgtccagcccactgccgctgcactgtccctgtatgaaagttccccctggttaaaccctatgtctcccttgctggctctaggtctctttttcagcctcttgacccttgtgccatccctactggagtcaataggggtccagcaggacagcatgatcatagctcaccgcactatgggctcaagcagtcatcccgcctcagcctcctacgtagctgggactatagactcataccaccatgcccagctca

SEQ ID NO: 117 - DNA, 623 bp, Homo sapiens
  CDS 206..622
  sig_peptide 206..352: Von Heijne matrix score 6.30000019073486 seq AGAFFWLVSLLLA/SV
  misc_feature 52: n=a, g, c or t
tcttcggcttccgtagaggaagtggcgcggaccttcatttggggtttcggtnmscccccttccccttccccggggtctgggggtgacattgcaccgcgcccctcgtggggtcgcgttgccaccccacgcggactccccagctggcgcgcccttcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggmtccartacggcctcctgatttttggtgctgctgtctctgtccttctacaggaggtgttccgctttgcctactacaagctgcttaagaaggcagatgaggggttagcatcgctgagtgaggacggaagatcacccatctycatccgscagatggcctatgtttctggtctctccttcggtawmatcagwggtgtcttctctgttatcaatatttggctga

SEQ ID NO: 118 - DNA, 497 bp, Homo sapiens
  CDS 344..496
  sig_peptide 344..433: Von Heijne matrix score 6.30000019073486 seq SCLSLSSSLDCRC/AP
taatatatacacatgtgtatgtatgtgtgtaacatcataatatgatttgttaagagcatggattcttgcttcttaccagctgtatgatcttgggcaggaggcttaacttcttttaacctcagttttctcatctgcacaatggggataataatataatagagttttatgaggattaaaagagatagtgaatggcaagtgcctggcagagagtaagcccttaatgaaattagctaattgtattgcatctattttagctatacaaggcatatgtcattactaaattatatttatttatttacttactttagagacggtgccttctgtcgcccaggcttggagtgcgatggtgcattcttggctcgctgtagcctcacctcctgggctcgggcaatcctcctgccttagcctctcaagtagcttggactgcaggtgtgcgccaccacaacaggctaatgtttttaaaaagagttgttatagagacggggtctcacttgttg

SEQ ID NO: 119 - DNA, 542 bp, Homo sapiens
  CDS 290..541
  sig_peptide 290..355: Von Heijne matrix score 6.30000019073486 seq ILSFSFLFFLGHG/VS
agattaacgcaaacccggaagcggatcgggtggagtgtaggtcatatcgccgcgatatctcttccaaatgcttgatgaaaaaggtgggaggatcacttgagccagggagttgaaggctgcagtgagccctgtttttgccaccacactccagcttgggtgagtgagctacaccctatctcaaacagacaaggaagtaaatgagaggtttaattcctcctttgaaaataaagaaagagattttctttcctttcatttcttttcttaggagatttatttagaaaatttgcaaatgcattttctgttttctgagggtagtattctttctttctcttttcttttctttctcggacatggagtttcactcttgttgcccaggctggagttaaatggtgcgatctcggctcactgcaatttctgtctctcgggtacatgtgattctcctgcctcagcctcccagctactcaggaggctgaggcagaattgcttgaacctgggaggcagaggttgcagtgagctgagattgcaccactgcactgcagcct

SEQ ID NO: 120 - DNA, 453 bp, Homo sapiens
  CDS 86..451
  sig_peptide 86..139: Von Heijne matrix score 6.19999980926514 seq IFAVTFLLALVGA/VL
acacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgag

SEQ ID NO: 121 - DNA, 466 bp, Homo sapiens
  CDS 100..465
  sig_peptide 100..303: Von Heijne matrix score 6.19999980926514 seq VLMFSQVISICXA/AM
  misc_feature 300: n=a, g, c or t
ataccaggcactttagaaccagagactctgctgcttttcctgggcagggcctgcttgctccagctctcaagtctgacttgcatctacactgcgggcaagatgcggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgngctgccatggggtcactctatgctgagatgacagaaaacaagtacgtctgcttctccgccctgaccatcctgagtgagtggcaggagtgggagggtgcaagagggagcggggagctttggaaccctgagatgtggcaaggagtagccagggaagggtactggggcc

SEQ ID NO: 122 - DNA, 213 bp, Homo sapiens
  CDS 13..213
  sig_peptide 13..57: Von Heijne matrix score 6.19999980926514 seq LILPVGLIATTLA/IA
aaaagaagaaccatgaggctcatcctgcctgtgggtttgattgctaccactcttgcaattgctcctgtccgctttgacagggagaargtgttccgcgtgaagccccaggatgaaaaacaagcagrcatcataaaggrcttggccaaaaccaatgagcttgacttctggtatccaggtgccacccaccacgtakctgctaatatgatggtggat

SEQ ID NO: 123 - DNA, 465 bp, Homo sapiens
  CDS 202..465
  sig_peptide 202..273: Von Heijne matrix score 6.19999980926514 seq LLLMHSPLPAAPG/FP
ttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagcccccttccaacagccttggaactccagctgccaccaccctctggtcggacactgggacccactggcccagtcttggctgctgcttacccctagccttgatgcctgcccagggacccccagccccctcccgttgccctgcagctttaacagagtkaaccatgtgtattgtacaggcgcggttgtc

SEQ ID NO: 124 - DNA, 488 bp, Homo sapiens
  CDS 195..488
  sig_peptide 195..347: Von Heijne matrix score 6.19999980926514 seq LNLLLSMVPVIYQ/KN
aragaagttacgaacagttcataaaagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataat

SEQ ID NO: 125 - DNA, 493 bp, Homo sapiens
  CDS 201..491
  sig_peptide 201..323: Von Heijne matrix score 6.09999990463257 seq CMLGCVSWFTCFA/CS
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggagattgcccagcgaggccggaacaccagcaggatggcagakgacacctccccaaacatgaatgacaacatcctgttgcctgtccgcaacaatgaccaagccctaggcctgactcagtgcatgctgggatgtgtgtcctggttcacctgttttgcctgctccctgagaactcrggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcat

SEQ ID NO: 126 - DNA, 489 bp, Homo sapiens
  CDS 144..488
  sig_peptide 144..449: Von Heijne matrix score 6.09999990463257 seq VFLLGHSMGGAIA/SS
gagcttttagcgtgaaggaactgagccgaaagatggtttaacgcttgcactctaagagagccaggattctaactgaaggtgcagaccagctgccccatctctttgcagagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccagttggccacggacagagcgaaggggagaggatggtagtgtctgacttccactttttcgtcagggatgtgttgcagcatgtggattccatgcagaaagactaccctgggcttcctgtcttccttctgggccactccatgggaggcgccatcgcatcctcacggccgcagagaggcggggccacttcgccggcat

SEQ ID NO: 127 - DNA, 463 bp, Homo sapiens
  CDS 44..463
  sig_peptide 44..172: Von Heijne matrix score 6.09999990463257 seq LLHCLSVSCPADA/YT
atgtgagcggccgcgagcgctgggaggacggacccagcggtcgatgacagggcctggcgcggttcgcttttccwrggtgactgwrttcgwrgggctgaggccctcgaggtgcccacttmcagctttccaccaattactgcactgtctttccgtttcctgccccgctgacgcgtacacctatttcagactcagcgcagctccgcggggagaaaagtgcgggcctccctctmggctccacaccagactccggagtagttcgaactgcgctggggtcgccaagacgcgcgctgmccttctmccagcactgmcctycccagcgtctttgaccactcttaatacccacaaacttggtcggacaatttctggtgtgtccagccatgtgtcacgtactgggaatacaaaatwgaatgargcaagcthcctgacctcaaagatttcagagttcmgttggagaaatcgacag

SEQ ID NO: 128 - DNA, 554 bp, Homo sapiens
  CDS 131..553
  sig_peptide 131..442: Von Heijne matrix score 6.09999990463257 seq FFLLLLVLAVLFF/HQ
ctttttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgaga

SEQ ID NO: 129 - DNA, 467 bp, Homo sapiens
  CDS 88..465
  sig_peptide 88..219: Von Heijne matrix score 6.09999990463257 seq ACCLVMVISCVFC/MG
tcttacaccaacctgctccaaaccacaagaggagttacttgttccagcctcctgtgtggactgctttcctatcaaagcaccttagacatgcacgaggaagaaatatacacctctcttcagtgggatagcccagcaccagacacttaccagaaatgtctgtcttccaacaaatgttcaggagcatgctgtcttgtgatggtgatttcatgtgttttctgcatgggattattaacggcatccattttcttgggcgtcaagttgttgcaggtgtccaccattgcgatgcagcagcaagaaaaactcatccaacaagagagggcactgctaaactttacagaatggaagagaagctgtgcccttcagatgaaatattgccaagccttcatgcaaaactcattaagttcagcccataacagcagtccttgtccaaacaattggattcagaacagagaaagttgttactatgt

SEQ ID NO: 130 - DNA, 457 bp, Homo sapiens
  CDS 61..456
  sig_peptide 61..216: Von Heijne matrix score 6.09999990463257 seq LTPVILTLWGATA/GG
ttagacacagtctagggtgtctgttacagaaaggacaaattagccacagggtgataggaaatggctaggactgagaccaagggacgcaaaaagcaaaggttacttagcgcmkacaaaatcaatacccctaatttttttgtttccttaagaaacattaacagaggccgggcgcggtggctcacgcctgtaatcctaacactttggggggccacagcgggaggatcatctgaggtcaggagtttgagaccggcctgtccaacatggcggaagccatctctactaaaaatacaaaaattaggtcgggcgcggtggctcacgcctgtgatcccggcgctttggggggccgaggcgggcggatcacctgaggtcgggggttcgagaccagtcttaccgacgtggggaagcctcgtctctactaaaaatacaaaattagccgggcgtggtggtgggtgcctgt

SEQ ID NO: 131 - DNA, 392 bp, Homo sapiens
  CDS 194..391
  sig_peptide 194..337: Von Heijne matrix score 6 seq FLYFSVLLGYTHT/LT
tgaaaaacgtacctgaacgtccataactttagaagaacagtcagatgctatcaaaggctgtgaaaaactttaaccatgaaacaacatggagttagtttagtaggtaatgatgaggaaataatactcagaaaatagacattaaaatcactgacatgactttaccacagaagtcatacggttacactctctgaaaatgtgtttttccacttatttatatgagaaaattagtggggaaaatagtactttctgttatctgtgtgtcatgatagttttaccagggacttttggtttatattacttcttatatttcagtgtccttttaggatacacacacacacttacacaatggaadymcaatatatatggtgaactcatttacaatacgcgattac

SEQ ID NO: 132 - DNA, 477 bp, Homo sapiens
  CDS 124..477
  sig_peptide 124..273: Von Heijne matrix score 6 seq LFTLLSLWMELFP/AE
  misc_feature 394: n=a, g, c or t
ggctgcgcctagtgggccgttgccttacagttgctgagaggaggcgagaggcgggggcgctagggccgagatcatgtctgactgggagaggtttccttggcagcagaggacgctaggtttgggatgaaagaagctgggcagatgsaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttntggtggtgaaaaacatgaaaattgttggtctccactgttctagtgaagatttacatgccgggcarattgctcttattaaacat

SEQ ID NO: 133 - DNA, 308 bp, Homo sapiens
  CDS 7..306
  sig_peptide 7..66: Von Heijne matrix score 6 seq FLHLLLLFKLVAP/VT
  misc_feature 133: n=a, g, c or t
agcaagatgtcagacctgctctcagtcttcctccacctcctccttctcttcaagttggttgccccggtgacctttcgccaccaccgctatgatgatcttgtgcggacgctgtacaaggtgcaaaacgaatgcnccggcatcacgcgggtctacagcattgggcgcasgtggaggggagacacctctacgtgctggagttcagcgaccaccctggaatccacgagcccttggdaccagaggtcaagtatgtgggggaacatgcacggcaacgaagcgttgggccgcgagctgatgctgcagctgtcgga

SEQ ID NO: 134 - DNA, 422 bp, Homo sapiens
  CDS 222..422
  sig_peptide 222..299: Von Heijne matrix score 6 seq LGMVVCACSPSYS/GG
cctttattctttcactcagccaaacaccttggagttggccttaacccttttctttctctctgcacctaacataaaatttatcagcaaatcttgttggctctgctctttagaatatatccagaatctgccgggcgcggtggcttacgcctgtgatcccagcactttgggaggctgaggcgggtggataatgaggttaggagatcgagaccatcctggccggcatggtgaaacttgtctctactgaaaatacaaaaaattggctgggcatggtggtgtgcgcctgtagtcccagctactcaggaggcagaggcaggagaatcgcttggacccgggaggtggaggttgcagtgagccgagatcaagccactgcactccaacctgggcaacagagagagactctgtctcaaaaaaaaaaaaaaaaa

SEQ ID NO: 135 - DNA, 570 bp, Homo sapiens
  CDS 142..570
  sig_peptide 142..477: Von Heijne matrix score 6 seq LLMSGRLIFPVLC/SP
aaaaactttacggcaggcgtccgcgtcgctagctagtcgttctgaagcggcggccagagaagagtcaatgggcacgagcatcggggtagccatgccttttcttggacatyccagaaaaggkttcggccttaacatagatcgatggttgacaatccagagtkggtgaacagccctaacaagatggctggkcmratggcadkgcttttgaaaaagaataggatagaatgtgcacatggaatcggttatactcgggcagagaaagagtgcaagatagaatatgatgatttksgtagagtgtttgcttcggcagaaaacgatgagacgtgcshggtaccatcagggaagcagcgggataagctgataaaggaaggaaagtwacacccctccacctcaccgacattggcaagggrhgagcctcgggccctgaaacagagcaggctgctgatgtctgggaggctgatttttcctgttctctgttctccactggaaaggttgttttacgacaaaacctccttggtcaaagtgtgtaaaaataaagggattgctccatccttaaaaaaaaaaaaaaaa

SEQ ID NO: 136 - DNA, 416 bp, Homo sapiens
  CDS 59..415
  sig_peptide 59..160: Von Heijne matrix score 5.90000009536743 seq LGAAALALLLANT/DV
attcaaaaccaggctgaagattggaaggaagttggccagcctcggctgcaggacagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactg

SEQ ID NO: 137 - DNA, 502 bp, Homo sapiens
  CDS 39..500
  sig_peptide 39..83: Von Heijne matrix score 5.90000009536743 seq ILMLTFIICGLLT/RV
attcctcaggacacagagcttcctctctcccaggagccatgaatatcctgatgctgaccttcattatctgtgggttgctaactcgggtgaccaaaggtagctttgaaccccaaaaatgttggaagaataatgtaggacattgcagaagacgatgtttagatactgaaaggtacatacttctttgtaggaacaagctatcatgctgcatttctataatatcacatgaatatactcgacgaccagcatttcctgtgattcacctagaggatataacattggattatagtgatgtggactcttttactggttccccagtatctatgttgaatgatctgataacatttgacacaactaaatttggagaaaccatgacacctgagaccaatactcctgagactactatgccaccatccgaggccactactcccgagactactatgccaccatctgagactgctacttccgagactatgccaccaccttctcagacagctcttactca

SEQ ID NO: 138 - DNA, 495 bp, Homo sapiens
  CDS 143..493
  sig_peptide 143..277: Von Heijne matrix score 5.90000009536743 seq VLVDLAILGQAYA/FA
atttttttgtgcctaagatgcccagtgcgttgctgggtttttctgctgtcctcgggctctggacatgaggccagaccttgtgaccttgttggcagtgggcagtggcttgatgtgaggtcccagagacggcaggttcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgccccacccccagaagccggcgccccacgccgtgcaccccactggcaccaaggccctctgacagtggggaggacgaggatgtgggaccgccagccgcgggcactggtgggccctgacctccccgcggggarggtgggtgccgtggcccctgcaggtgtggcagagatggggcacgggcattggggtctcccatcagcctctgtdgggtgtctcag

SEQ ID NO: 139 - DNA, 646 bp, Homo sapiens
  CDS 259..645
  sig_peptide 259..375: Von Heijne matrix score 5.80000019073486 seq FCVCVIAIGVVQA/LI
aagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcawcgtcctccaaggcccggcsctgtgctttgcagcggccatcttctctstcttctttgtmcccttgtcttacctgctgatggtgactgtcatcctsctsccstatgtcagcaaggtcaccggctggtgcagagacaggstcctgggccacagggagccctcggstcacccagtgg

SEQ ID NO: 140 - DNA, 497 bp, Homo sapiens
  CDS 236..496
  sig_peptide 236..427: Von Heijne matrix score 5.80000019073486 seq SSLGMTFLHVCQA/LD
attttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggggatgacatttctccatgtttgtcaggccttggactctctacgtcaggtgatccayccacccacctcggcctcccaaagtgctgggattacaggtgtga

SEQ ID NO: 141 - DNA, 456 bp, Homo sapiens
  CDS 292..456
  sig_peptide 292..396: Von Heijne matrix score 5.80000019073486 seq LLLGKCGLRQSLC/CI
actttgtccaagctctggcaacctgggttagataaactatgagaaagttctcatagagcaagcaatattggcttctgctggtttgagtcatgtttaccttggctttaagggagtccccagaatgctgaagaccagactgagtttctttacgtgatggcagaagtgttgaaagagaacgagagcggaastgcaacacctcttgaagttgaggcctagaagtcacacagcatctcttctgctctactggattggtcaaaggcctgggagtctgaggactcagctctgtgcaggatggagaactctgcgtgtgttgtctctaagaacaggcctgccatttctcaaacactccgggcaagactattgcttggcaagtgtggactcaggcaaagcctctgttgcattttaaacacaataaatatccagggtaacctggcattactccttaaaaaaaaaaam

SEQ ID NO: 142 - DNA, 488 bp, Homo sapiens
  CDS 54..488
  sig_peptide 54..119: Von Heijne matrix score 5.80000019073486 seq PVTLTSLLPMVTX/GP
  misc_feature 181,256,369: n=a, g, c or t
gtctttttaatctctgcagtcccctgagtgtcacccaacctgcaggcagtgtcatgggccgttggagtctgactgcatctcctgttaccctcacatctctcttaccaatggtaactkcaggaccagctgcagggaagagcagttcctcaacctcgtgggatactgtgctgactgccatcwnctgtgccagcactgtgcagctgatctccacaacactgggagcatctgcctcaggtgccagaatgcccactacctnctgctcggggaccactgtgttcctgactgcccttcaggatactatgcagagagaggagcttgtaaaaaatgccactcctcctgcagaacctgccagggcagaggacctttctnctgctcctcatgtgacaccaacctcgtgctgtcccacactggcacctgcagcaccacctgcttccctgggcactatcttgatgacaatcatgtttgccagcgtaggtttttccaatgaa

SEQ ID NO: 143 - DNA, 219 bp, Homo sapiens
  CDS 62..217
  sig_peptide 62..109: Von Heijne matrix score 5.69999980926514 seq SLSVFCSWFRSRS/WP
gacttaggagtatcctctccacttctgacccttagtttcgtctgtgcacaactcgctcaaaatgggcaactcattaagcgtattttgttcctggttccgcagcaggtcctggccacgccatcggcaacctgctcgtcttgtccgtgaggccttcccagctggccgggctcaccccgcggctcctgcacccgtgcctgcccggggcatctggggccattc

SEQ ID NO: 144 - DNA, 524 bp, Homo sapiens
  CDS 265..522
  sig_peptide 265..483: Von Heijne matrix score 5.69999980926514 seq SVTGVLYSPCTLA/HP
gattcatgaaggcctcgggtcctgacctctctgatggactccactgccccagtctaattagacatttaagaaccttctctgcagctgctgccttagccccaagatacccaaccagacttcccagttcactgcttctatggcacctctgccagtgcctccatctcctctatgcagtttctacctcatgcaacagccatgggaagagatcggctgcctgggcaatgaccagaacagaagacacagatgcgctaacagattccttcgatgacagtttcatcagttctgcagattaaagactttcaccagaaaaaaaaattacctgattttgccctgaggcagccagggagggctttgtccttgacaatcccactgacttatttaacaggtagctcaaaacccaacaaraactggaggaggctgctccactgcagggatggtttcaattcggtaactggagtattgtactctccttgcaccctggctcatccccacaaaagacctttcaaagaaacacttaattacct

SEQ ID NO: 145 - DNA, 514 bp, Homo sapiens
  CDS 112..513
  sig_peptide 112..399: Von Heijne matrix score 5.69999980926514 seq ILMGPASSPWTLA/VE
attttgcctctcagtgttcaagcttgagcccacgcatccaactcctgagatcttactgggaagctgctgatcatcagtttcaggaagtcagcatggatcagccttacgttcatggcctccaggcctattctcctgcctcacagggaccggccaggatctctatccttacagcacgttggaatgtatatgctcctctccccacatcgccttagggagcaggcaggtgtcaggggcagcataaggacggccaacaggacagaagacgggttgaagatccgagaggctgagtcacttccacaaagtaacacagctgattttaaatgcctgcattcagcatccctgcagcaggctccaggtggaattctaatgggaccagcctccagtccctggaccttagccgtggaaggagagaagaggacatctgcacctcctctcagagaaagcctgatgcctactaaaggacttgggtggtggacgcakgaccctcagtctgggagcttgttcactgaacatt

SEQ ID NO: 146 - DNA, 525 bp, Homo sapiens
  CDS 152..523
  sig_peptide 152..217: Von Heijne matrix score 5.59999990463257 seq LVSMAGRVCLCQG/SA
atttcccagcgtgcctcaggaagggcgccaggactgcattttgctccggagcgtccagagtcctggccctgagcgggaatcgcagtggccgaggctgagcggcaggcgatcgcccgaccctcactcctggcgtctgagtctctggcgtaccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgccwggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagcccccc

SEQ ID NO: 147 - DNA, 438 bp, Homo sapiens
  CDS 276..437
  sig_peptide 276..428: Von Heijne matrix score 5.59999990463257 seq CLFLKLRVSHVWG/CT
ccaccccctccaggcccggggctgaaacagcgtaggacagccccaggggctggctttcaccagctgcagggtctgcttttacttggggtgggggggcggggctgaccctgaaccctcccccccgccagtcggggaggggtcccaccactcaaagtgcctctaaagaaaccagctttttgcactaaagccaaaccacaccgctgtccccttagccccaagggccctgggggcagcsaccctcccgcctgtcggcccgtagatttatcaagggtgttatgggcccagctttggggggccagtcccgatgcactttgaggggtgttggagaggggactcccccactcgcacttaactcaacggctctcggggccctggggctgtttttaccatgtttgtttttgaagctcagggtgtctcacgtctggggctgcaccaggc

SEQ ID NO: 148 - DNA, 265 bp, Homo sapiens
  CDS 72..263
  sig_peptide 72..128: Von Heijne matrix score 5.59999990463257 seq LTPVILAXREARA/DG
tcaagaaaaaaaatttttttttttttggaagaatttgaaagctgctgatccagagtcattcctttaagaaaatgggccgggmatggtggctcacacctgtaatcctggcacwycgggaagccagggcagatggaycagttgagctcaggaatgtgagaccascctgggcaatgtggcaaaaccccgcctctrsaaaaaatacaaaaactaggtgggcatggtggcatgcgcctgtagtcccagctactggggaggccgaggtggg

SEQ ID NO: 149 - DNA, 501 bp, Homo sapiens
  CDS 221..499
  sig_peptide 221..394: Von Heijne matrix score 5.59999990463257 seq ENLALMSSLGCWC/GV
atttttatttgtcggagaggctcctgagcgctaggtcggcactgcggtgactgaacccagaaggcggagaacagttgtcctctgctgcacagaggcgactctggagctctgtgacggcgccaagcgtgacccacccctgggccaggatagggaccgtcatgcccatatctcctggctggtcaccctctcctcccaaccctgctttaaaccacgtggttcgatggcggtggtggccacgctgaggctctctgctcagggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctatgacaggtgtgtctcccaagaaggcccacccctg

SEQ ID NO: 150 - DNA, 320 bp, Homo sapiens
  CDS 88..318
  sig_peptide 88..159: Von Heijne matrix score 5.59999990463257 seq LPLLLLLPPAPEA/AK
tgggagcgggtgggcggccgggaggccggagcagcacggccgcaggacctgaagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccaaagaagaactttggcggcgggaacacggcttgggaggaaaagacgctgttccaagtacgagtccagcgagattcgcctgctggagatc

SEQ ID NO: 151 - DNA, 512 bp, Homo sapiens
  CDS 293..511
  sig_peptide 293..388: Von Heijne matrix score 5.59999990463257 seq WMGLACFRSLAAS/SP
aaaagattgaagaggaactctttcaaacctttcaagtgccccctcctttccttaaagtcttttataggggtccccttcttggccatctccatcctgtgagtcaggactgaaagggcacagacaggtcactgccagcattgttggggcaagcctgcaagcacgcatcactggggatctgacatgacaatggccgcctgccccctctgagggctacaggacttaccccagtgggaagcagctaagcaggtctgaccagccgacctggacctggccaagggtcctgtcatccctcatggccaccccgccattccggctgataaggaagatgttttccttcaaggtgagcagatggatggggcttgcctgcttccggtccctggcggcatcctctcccagtattcgccagaagaaactaatgcacaagctgcaggaggaaaasgcttttcgcgaagagatgaaaatttttcgtgaaaaaatagaggacttcagggaagagatgtggactttccgag

SEQ ID NO: 152 - DNA, 497 bp, Homo sapiens
  CDS 71..496
  sig_peptide 71..121: Von Heijne matrix score 5.59999990463257 seq ALKLASWTSMALA/AS
aattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccagcctccacagagcagcatgcaagagatccgccaggtcatccgagaagatctgggcaaggagatcc

SEQ ID NO: 153 - DNA, 501 bp, Homo sapiens
  CDS 112..501
  sig_peptide 112..219: Von Heijne matrix score 5.59999990463257 seq ILRLLGSLSNAYS/PR
aagttggacgcatgcgccgtttctctgcatggtgtgcgttctcgttctagctgcggccgcagagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcgtttcccctaattcacagggtgaagccagatttggtgttgtgtaacggaccaggaacatgtgttcctatctgtgtatctgcccttctc

SEQ ID NO: 154 - DNA, 225 bp, Homo sapiens
  CDS 19..225
  sig_peptide 19..126: Von Heijne matrix score 5.59999990463257 seq AVFLSFWRMLSEG/QV
aacatcctgctcctgctcatggacgacgaatcactcccgccacctcgggccgccgggtccccccgctggctcaagtcttacctgacggctgtcttcttgtccttctggagaatgctgagcgaaggtcaggtgtccctaagtgactgctttccagagcacgctctccagcgcccaggggtccgtgtcctgacagcagtagccgggcctttctctgcactgagtggc

SEQ ID NO: 155 - DNA, 542 bp, Homo sapiens
  CDS 354..542
  sig_peptide 354..509: Von Heijne matrix score 5.59999990463257 seq FVLGACCGHPALS/AG
actccataaccacaacatgtgcctgtttgtacagggctcttggcctacaatgtccttcctgctacctctataattcaagcttggggtggctgctgtcaccttgcttctcctataaaagccatgaaacttctcaatcagaaaatagatgaaaaaatcacccaatccagtgatttttaaaactttttagaccacaaaaccttttcttcaagcaatatcttccacagaggcccaatatgtaaaacagaaaaaatgggttgagtagggtacaagacaccactctcaaatgcagcagggcctccacaatagtccctgaggcccccagagctccagggagctcagtgtaaaaaccactgatgcagtccaagggcctcatttacagaggagggaacagggggaaagtaaaatggccacagtacacaggaagcacaggcaaggttaggttaggatttgggtgccctgactctgtggcctttgtccttggggcttgctgtgggcatcctgctctctctgcaggttgtcggttcaatggggacatgggcagg

SEQ ID NO: 156 - DNA, 211 bp, Homo sapiens
  CDS 21..209
  sig_peptide 21..65: Von Heijne matrix score 5.59999990463257 seq VTLSLLLGGRVXX/LH
  misc_feature 62,123,181: n=a, g, c or t
gaaggctggtttgcgtcgacatggcggttaccctgagtctcttgctgggcgggcgcgtttgnrcgttacactcgctgtgggttcgcgacccggggggtggcgggcccaggcctattggccggngagccggaccccgattccgactgggagccggagaacgggagctgcaggaggtggagancaccctgaaacgacagaaacaagcaatccg

SEQ ID NO: 157 - DNA, 475 bp, Homo sapiens
  CDS 303..473
  sig_peptide 303..371: Von Heijne matrix score 5.5 seq LELLSSGXPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgwtccaactgtctcggcctcccaaggtgctgggattacaggcgtgacaactgtgcctagcctgagccaccacgccggcctaatttttaaattttttgtagagacagggtctcattatgttgc

SEQ ID NO: 158 - DNA, 587 bp, Homo sapiens
  CDS 198..587
  sig_peptide 198..422: Von Heijne matrix score 5.5 seq VIFIVGLVGNIIA/LY
cttttacttcaggcgaacctgaactcagttaatgcaattttgaagcatgccctgaatagattcagtcattatcaagtcaaactaaaaacggtgaaaggttgcgactattaccaaataggaaaaacctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccctctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattytgtgcaaggttgtg

SEQ ID NO: 159 - DNA, 533 bp, Homo sapiens
  CDS 55..531
  sig_peptide 55..378: Von Heijne matrix score 5.5 seq RFELCSLSPGVRG/LK
ttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaaaaaaaaaaaaaaa

SEQ ID NO: 160 - DNA, 509 bp, Homo sapiens
  CDS 4..507
  sig_peptide 4..120: Von Heijne matrix score 5.5 seq LLLRAAFQSLLDA/QA
tcaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacaggacactgttccccatcctatccagagattagttttagt

SEQ ID NO: 161 - DNA, 307 bp, Homo sapiens
  CDS 8..307
  sig_peptide 8..211: Von Heijne matrix score 5.5 seq ALLLPQLLRRLRQ/EN
  misc_feature 84: n=a, g, c or t
ctgttttatgtgtgkcttcccagtcctgtggtgctgstataccggggacgttgagtcccacagacctggaaattgcggcccctntttstcaacccagagcaaattgagacgtccgggctggagtgtgatggcacgatctcggctcactgcaacctccgtcttttgggttcaagctcttctcctgcctcagctactcaggaggctgaggcaggagaatggcatgaaccgaggaggtggagcttgccatgagcagagatcatgctactgcactccagcctgggtgacagagcgagabtccatcccaaaa

SEQ ID NO: 162 - DNA, 721 bp, Homo sapiens
  CDS 32..721
  sig_peptide 32..511: Von Heijne matrix score 5.5 seq LAYCTFLLAVGLS/RI
aagccggggcctggtcggcagctgggccgccatggagtccacgctgggcgcgggcatcgtgatagccgaggcgctacagarccagctagcctggctggagaacgtgtggctctggatcasctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacagccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagccta

SEQ ID NO: 163 - DNA, 495 bp, Homo sapiens
  CDS 298..495
  sig_peptide 298..474: Von Heijne matrix score 5.40000009536743 seq SFLGAALGGRVLA/EV
gtccaggagtgcctagtgaggcctcggcagggagtgggacccccagagccacagccasctctaccactgccagccctcttcgggacggttttggcgggcaggatggtggtgagctgcggccgctgcagagtgaaggckctgcagcstggtcaccaaggggtgccagcgattggcagcccarggcgcacggcctgaggccccaaacggaaatgggccgaggatggtggggatgccccttcacccagcaaacggccctgggccaggcaagagaaccabgaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacgg

SEQ ID NO: 164 - DNA, 493 bp, Homo sapiens
  CDS 306..491
  sig_peptide 306..449: Von Heijne matrix score 5.40000009536743 seq LGFVITIFSPCCS/HH
tactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggt

SEQ ID NO: 165 - DNA, 594 bp, Homo sapiens
  CDS 45..593
  sig_peptide 45..101: Von Heijne matrix score 5.40000009536743 seq FGCAFIAFGPALA/LY
atctcgcgtccccaacggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaaga

SEQ ID NO: 166 - DNA, 501 bp, Homo sapiens
  CDS 161..499
  sig_peptide 161..379: Von Heijne matrix score 5.40000009536743 seq ITLDLFCHALIFC/RQ
acctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtgggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggtgagagggggcagctaccaggtttgagccccagggagaagaggaa

SEQ ID NO: 167 - DNA, 481 bp, Homo sapiens
  CDS 297..479
  sig_peptide 297..353: Von Heijne matrix score 5.40000009536743 seq LCCSGCVPSLCCS/SY
acttccgccgccgstccgccgcctccggaactaaacgcggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtwctctgggtcagacctctgaagacttctcagatggatcctagtctctgggcttgcctgaaattactcgctgctcagggagagagttgaaatggttggcatcctcccactctgttgctccggctgtgtcccctcgctctgttgttccagctatgtsccctctgttgctccaactgcagctcattctgttagagttcctcattcagctggtcactgtggccagagggtgttggcctgctcctcttcaagtaaacgccaagtcacaaaaaaaaaaaa

SEQ ID NO: 168 - DNA, 562 bp, Homo sapiens
  CDS 233..562
  sig_peptide 233..538: Von Heijne matrix score 5.30000019073486 seq NLLLLVTDPTCDC/SI
gccgcttgatcaccagggatcctcagcagtgcagcaccaggatgagggcttgactcgtctcctggaggggcatgtccaaccccacccgagatgtctgacctgcaataggcatttcccagctagctcagctctgcagggcagccaatttctgccttcttgacggcgaccaggtggctgctgcaggagctggtgctgctctgtgtgtgacatcatcttgggacaccgccactccatgtgccatcgtcaccaccccatgacatcctgccctcatgtgccaccatgttttcctgtgccgtgtccaccctgtgctgggcttatgttccggccagccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcag

SEQ ID NO: 169 - DNA, 490 bp, Homo sapiens
  CDS 164..490
  sig_peptide 164..415: Von Heijne matrix score 5.30000019073486 seq LLHLRPLLPLLQS/PN
aaaactgaggcctgggagcaggaacctgtaggcagcgcttgagggtagcgggatagcagctgcaasgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcascacggtccagccgccaagcccaccctgccggttgcaaccactactgcccagccc

SEQ ID NO: 170 - DNA, 542 bp, Homo sapiens
  CDS 250..540
  sig_peptide 250..495: Von Heijne matrix score 5.30000019073486 seq LAACSDFFRGSLA/LS
agactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggggagtctcgctctgtcgcccaggctggagtgcagtgggtgcgatctcggctcactgca

SEQ ID NO: 171 - DNA, 528 bp, Homo sapiens
  CDS 127..528
  sig_peptide 127..198: Von Heijne matrix score 5.30000019073486 seq ALCSVCSMSVLRA/YP
agtctaggatcctcacaccagctacttgcaagggagaaggaaaaggccagtaaggcctgggccaggagagtcccgacaggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttc

SEQ ID NO: 172 - DNA, 450 bp, Homo sapiens
  CDS 242..448
  sig_peptide 242..364: Von Heijne matrix score 5.30000019073486 seq IILKLWMSLGAVA/HT
agatttaactgattatacactaaaacttgacaaagtagtttttcttttattttccattttttaatatgttccgcctcagggttatatatttactactcctgtgcttttacaaaagcaacttcaaattcttaggcacaggattctgaaaattagatgaactaaccaggtacagttactttaattttcagattttagggatattagagtgcatttatttgtatttctatttgtaatatttaaaatggaccaatttgtgtgtgcattagtttccaatggggctgtaacatattaccacaagtttagtggcttaaaatcacacaagtttattattctaaagttatggatgtcgctgggtgcagtggctcacacctgtgatcccagcaccttgggaggccgaggcgggcagatcacgaggtcaggagatcaagaccatcttggccaacatggtga

SEQ ID NO: 173 - DNA, 599 bp, Homo sapiens
  CDS 96..599
  sig_peptide 96..137: Von Heijne matrix score 5.19999980926514 seq NFILFIFIPGVFS/LK
ataatgtcctagttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaragatcaaccccaaacgtgcctgcattttggacaatgttagctaaagctataaatggaacagcagtggtcatggatgataaagatcaattatttcacccaattccagagtctgatgtgaatgctacacag

SEQ ID NO: 174 - DNA, 514 bp, Homo sapiens
  CDS 239..514
  sig_peptide 239..448: Von Heijne matrix score 5.19999980926514 seq TWLALAPLPTARA/GA
tagtgccggagccccgccagagcccgacttcagccccagccagatcccgcgtcaacggacggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagc

SEQ ID NO: 175 - DNA, 458 bp, Homo sapiens
  CDS 96..458
  sig_peptide 96..191: Von Heijne matrix score 5.19999980926514 seq VPMLSLTLSPGWS/TM
aaggacgtactcgtcttggtgagagcgtgaskgctgagatttgggagtctgcgctaggcccgcttggagttctgagccgatggaagagttcactcatgtttgcacccgcggtgatgcgtgcttttcgcaagaacaagactctcggctatggagtccccatgttgagtctcactctgtcaccaggctggagtacaatggcgcagtcttggctcactgcaacctccacctcccagattcaagcgattctcctgcctcagcctcccgaacagctgggactacagttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcga

SEQ ID NO: 176 - DNA, 501 bp, Homo sapiens
  CDS 140..499
  sig_peptide 140..220: Von Heijne matrix score 5.19999980926514 seq LLHFQGSCSYVLA/KD
gttttctgggagggtctgcgagaggcatggcggggagggcggtgtgtctgacagtgtctggggctgagtgcaggacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgcggctccagggcgagtctgrggttgggctgcctgctgg

SEQ ID NO: 177 - DNA, 510 bp, Homo sapiens
  CDS 74..508
  sig_peptide 74..127: Von Heijne matrix score 5.19999980926514 seq VILGFLLFRGHNS/QP
cactatggacagagcctccactgagctgctgcctgcccgccacatacccagctgacatgggcaccgcagagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcg

SEQ ID NO: 178 - DNA, 542 bp, Homo sapiens
  CDS 90..542
  sig_peptide 90..140: Von Heijne matrix score 5.09999990463257 seq QLLVLFGSQTGTA/QD
aggcggaaggcggasggtccctgcaacccggccggcgggaactgccttctagtttttagtctcagaccagaccaccgggsgcgcgcccgatgccgagcccgcagcttctggtgctcttcggcagccagacaggcacggctcaggatgtgtcggagagactgggtcgcgaggcccggggccggcggcttggctgccggrtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgcctcctgcccgtgtgcctgggcgatgaccagcatgagctrgggcccgacgctgctgtggacccctggctgcgagacttgtgggacc

SEQ ID NO: 179 - DNA, 303 bp, Homo sapiens
  CDS 110..301
  sig_peptide 110..271: Von Heijne matrix score 5.09999990463257 seq RLLFCTAPRSLNS/LP
acgtacggcagggcggggtcggcccgcagtggccagctgggagctacgagcgcggasttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgctcttgccttttcccactgagagaaggctgctcttttgtactgccccccgctcattaaacagcctccccctaaaaaaaaaaaaaattgcraaaag

SEQ ID NO: 180 - DNA, 504 bp, Homo sapiens
  CDS 44..502
  sig_peptide 44..178: Von Heijne matrix score 5.09999990463257 seq HILVLAGFGNLRG/QM
ttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacc

SEQ ID NO: 181 - DNA, 542 bp, Homo sapiens
  CDS 309..542
  sig_peptide 309..455: Von Heijne matrix score 5.09999990463257 seq LLYMAFLMLGGPS/DP
aatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccmagctgaagccaacaaggtgagggagagttctgaagatatccggtgcaaatgcatctgtccaaccttatagaaacatcagtgggcacatttacaaccagaatgtatcccagggaaggactgcaactgcctgcacgtggtggagcccatgccaktgcctggccatgacgtggagggcctactgcctgctgtgcgagtgcaggtacgaggagcgcagcaccaccaccatcaaggtcatcattgtcatctacctgtccgtggtgggtgccctgttgctctacatggccttcctgatgctgggtggaccctctgatccgaaagcccggatgcatacactgagcaactgcacaatgaggaggagaatgaggatgctcgctctatggcagcagctgctgcat

SEQ ID NO: 182 - DNA, 509 bp, Homo sapiens
  CDS 150..509
  sig_peptide 150..446: Von Heijne matrix score 5 seq LLILFVVGGVTVS/EV
attttcaaatttacccctctgtgacttgtaagccatgcaattcgtagggctaaatatgcagttgttcgatttcacggtttggaatctcttgtcaagggactgggactcttcaattaatctgacatttcacaaatccaaaattgccgtggatgaactctttacttcacttcgggatattgctggagctgagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctg

SEQ ID NO: 183 - DNA, 501 bp, Homo sapiens
  CDS 198..500
  sig_peptide 198..377: Von Heijne matrix score 5 seq SLVLGIRPSLAWS/ST
ttcaatactagtaattgctggttgggtccttctcatattgcatcacctcaacctcctcttctgcatccctcctgcacatttaaggacccttgtgattacaacagacccatgtggataatccaggataatctctttattttaaggtcagccaatagtcaaccttaattccattttaccatgtaacgtaacatattcatatgttttggaagttaagacttggacatctttggggtaattattattctgcctaccacaatctccaggtttgcttctgcataggctatttaagcagcaggctactttacctgccatccagtgaggaaagaggccagcaacattcattagtgcttggcatcagacccagcctagcctggtcatccaccactgactttgcctcaatggcaggtggggttgtaaagcttaagacctgtacctggttcaagtcacggggcctggtactgtgcttgtgcatggtagacctcaagaaagagggagcaggtc

SEQ ID NO: 184 - DNA, 466 bp, Homo sapiens
  CDS 202..465
  sig_peptide 202..447: Von Heijne matrix score 5 seq IILFLYFSGQLLQ/LS
attctaaggctacaggtcctttggcaactgctccccctcttccttctccttttttttcaatctaatatgtgggacataccaagtgatgagatcctttctggcatcctaagaaaatgccaactatagaacaacagatgtagtctccttattaagtctgaagaccaaacttcttagtgcaaagcagtcaagtcttttctcaacatgaccccaatcaagcttttgaacttaacatcaagatataacttcagaagaacgtttggaatagagctcagttcaaactcttcctattgcaaacgaggaaatggctacagaagcagagtgcccaaagaatgcgaatgcaactggcttcatcttgaaagcgacactctgaagaaattacccataatttctccctcttggacatgcagaattatcctgttcttgtatttttctggccagcttctccaactttccctttcttgtttgc

SEQ ID NO: 185 - DNA, 562 bp, Homo sapiens
  CDS 274..561
  sig_peptide 274..342: Von Heijne matrix score 5 seq AICILMITELILA/SK
agaagccaatggggaagcgtttcgtgtaggtcttctgaggtggtggcgccacggctacctcctgcckgtgaggagctggctgagaggggactgggcgccggcggggaaggaggagcgctaggtcggtgtacgacgagattagggtgcgtgccagctccgggaggccgcggtgaggggccgggccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccagatgctgaagcaaaattcagagagattgcagaagcatatgaaacactctcagatgctaatagacgaaagagtatgatacacttggacacagtgcttttactagtgg

SEQ ID NO: 186 - DNA, 485 bp, Homo sapiens
  CDS 229..483
  sig_peptide 229..444: Von Heijne matrix score 5 seq LLLRLAAVELGLT/AS
cacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatc

SEQ ID NO: 187 - DNA, 521 bp, Homo sapiens
  CDS 202..519
  sig_peptide 202..306: Von Heijne matrix score 5 seq WYSTVGLLPPVRA/MS
  misc_feature 502: n=a, g, c or t
agtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatycatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgatcctgtgcgtctatnagggatcgggtgaccacca

SEQ ID NO: 188 - DNA, 332 bp, Homo sapiens
  CDS 148..330
  sig_peptide 148..306: Von Heijne matrix score 4.90000009536743 seq IGWAWWWVPVVSA/TR
atcttcccgaccgcgagccgtccagggtcttgctctgtctcccaggctggagtgcagtggctcagtcttggctcattgaaaccttcacctcctgggttcaakckattctcctgcctcagcctcctgagtagctgggattacaaccgtatgccacaacgtccggctaattttgtaattttagtagagacagggtttcaccatgttggccaggctggtctcaaactcctgacctcaggtgaagccccgtctctactaaaaatgcagaagattggctgggcgtggtggtgggtgcctgtggtttcagctactcgggaggctgaggcaggagaatc

SEQ ID NO: 189 - DNA, 262 bp, Homo sapiens
  CDS 86..262
  sig_peptide 86..142: Von Heijne matrix score 4.90000009536743 seq LLMCALSSYSLNS/AL
atttctttttctagtttttctttttttgttactgagttttgaagagttctttatgkattctaggaggaagtaccttatcagatagatgactcacaaatattttctcctaatgtgtgccttgtcttcttattctcttaatagtgcccttcagagagctcaagtgttaaatttttctattcattcttttatggatcatacttttggtatcatathtaaaaatctgtctaaaacgccttgtcatggaggtgttattttatggttt

SEQ ID NO: 190 - DNA, 552 bp, Homo sapiens
  CDS 110..550
  sig_peptide 110..232: Von Heijne matrix score 4.90000009536743 seq LSLVSHAPGEALA/RA
agtgacggggattgctgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagag

SEQ ID NO: 191 - DNA, 406 bp, Homo sapiens
  CDS 223..405
  sig_peptide 223..348: Von Heijne matrix score 4.90000009536743 seq LVGGLIAPGPTTA/VS
acaatcacagctccgggcattgggggaaccgagcsggctgcgsgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaat

SEQ ID NO: 192 - DNA, 249 bp, Homo sapiens
  CDS 35..247
  sig_peptide 35..211: Von Heijne matrix score 4.90000009536743 seq LASLLPFPPDIIS/KL
aattttacgaacgaggacatcaaggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcag

SEQ ID NO: 193 - DNA, 324 bp, Homo sapiens
  CDS 148..324
  sig_peptide 148..306: Von Heijne matrix score 4.90000009536743 seq IGWAWWWVPVVSA/TR
atcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgaagccccgtctctactaaaaatgcagaagattggctgggcgtggtggtgggtgcctgtggtttcagctactcgggaggctgaggca

SEQ ID NO: 194 - DNA, 334 bp, Homo sapiens
  CDS 154..333
  sig_peptide 154..312: Von Heijne matrix score 4.90000009536743 seq IGWAWWWVPVVSA/TR
atcttcccgaccgckgagcygtccagggtcttgctctgtctcccaggctggagtkgcagtggctcagtcttggctcattgataaccttcacctcctgggttcaagctgattctycctgcctcatgcctcctgagtagctgggattacaaccgtatgcsacaacgtccggctaattttgtaattttagtagagacagggtttcaccatgttggccaggctggtctcaaactcctgacctcaggtgaagccccgtctctactaaaaatgcagaagattggctgggcgtggtggtgggtgcctgtggtttcagctactcgggaggctgaggcaggag

SEQ ID NO: 195 - DNA, 337 bp, Homo sapiens
  CDS 148..336
  sig_peptide 148..306: Von Heijne matrix score 4.90000009536743 seq IGWAWWWVPVVSA/TR
atcttcccgaccgcgagccgtccagggtcttgctctgtctcccaggctggagtgcagtggctcagtcttggctcattgaaaccttcacctcctgggttcaagcgattctcctgcctcagcctcctgagtagctgggattacaaccgtatgccacaacgtccggctaattttgtaattttagtagagacagggtttcaccatgttggccaggctggtctcaaactcctgacctcaggtgaagccccgtctctactaaaaatgcagaagattggctgggcgtggtggtgggtgcctgtggtttcagctactcgggaggctgaggcaggagaatcgcttg

SEQ ID NO: 196 - DNA, 491 bp, Homo sapiens
  CDS 182..490
  sig_peptide 182..484: Von Heijne matrix score 4.90000009536743 seq LVLSILERPASRA/XT
attccttttaggagccattccgtagtgccatcccgagcaacgcastgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgascatgctagtttgatacctgagacggggaagaaaaaagtcgccgagattcagggccacgcgggaggacgccgctcagggcagagccatgagctcctgcgggacttcgaggcgacacttctgcagatgtttgggctgcgcgccgcccgcagcctagcaagagtgccgtcattccggactacatgcgggatctttaccggcttcagtctggggaggaggaggaagagcagatccacagcactggtcttgagtatccttgagcgcccggccagccgggcsaasaccg

SEQ ID NO: 197 - DNA, 483 bp, Homo sapiens
  CDS 177..482
  sig_peptide 177..323: Von Heijne matrix score 4.90000009536743 seq PSLAAGLLFGSLA/GL
acgacgtcccgcctttctccccgccctgccgcggccccggggcgcasgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccg

SEQ ID NO: 198 - DNA, 471 bp, Homo sapiens
  CDS 304..471
  sig_peptide 304..456: Von Heijne matrix score 4.90000009536743 seq TVMSALSVAPSKA/RE
agttcgcggtgtcagcctccgcctccgagcctcagttgtcttctctgtgaggtgggaatgccggtgaatcctgccgctggcgtggatgagaagtgaatgcgtgctcggagctgcgagtgacagcggcaggaggcgcccagggacacttggtttctccagggctggaaggcttctagaaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaag

SEQ ID NO: 199 - DNA, 523 bp, Homo sapiens
  CDS 72..521
  sig_peptide 72..188: Von Heijne matrix score 4.90000009536743 seq IILVGLLHMVLLS/IP
aacttcctggagacttcaggtgtggtagccggcgccgcgcccatagccggacggggatctgagctggcaggatgaatgtgggggtggcacacagcgaagkaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacrtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaa

SEQ ID NO: 200 - DNA, 829 bp, Homo sapiens
  CDS 362..829
  sig_peptide 362..598: Von Heijne matrix score 4.90000009536743 seq VGAVFGLTTCISA/HV
  misc_feature 803: n=a, g, c or t
agtctgagcctggcccctcccctagtagatagtccccgcctctagtagtccctaacctaggactccctgagctgggactagcgaaatctgtctgcactgatcgcagtcgtcctcagtttcaccctctaggaatcggcctgggggtgcacgtgctactctctttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactcgggatatccccgatggcaccgattgccaccgcaaagcctacagcaccaccagtattgccagcgtcgctgscytggaccgccgctgcctacagagtcacactcaatcctccgggcaccttccttgaaggagtgggctaaggttggacaatacacgttcactgcagctgctgtcggggccgtgtttggcctcaccacctgcatcagcgcccatgtccgcgagaagcccgacgaccccctgaactacttcctcggtggctgcgccggagscttgactctgggagcacgcacgcacaactacgggattgggcgccgccgcctgcgtgtactttggcatagcggcctccctggtcaagatgggccggctggagggctgggaggtgtttgcaaaacccaaggtgtgagccctgtgcctnccgggacctccagcctgcagaatgcg

SEQ ID NO: 201 - DNA, 477 bp, Homo sapiens
  CDS 290..475
  sig_peptide 290..397: Von Heijne matrix score 4.90000009536743 seq WTFLSALNQVTPA/EV
atctgagtaacatggcggcggcggcggtagcaggctgtggtggcgcgggatcttgggggcctcggcgctgaccagggggactgggcgaccctccgttctgttgctgccggtgaggcgggagagcgccggggccgacacgcgccgtgaccactgtcagaccacggaawgatgtggcccacaagcagctctcagcttttggagagtatgtggctgaaatcttgcccaagtatgtccaacaagttcaggtaatacttactaatgttatttgggtctgggtcaagaaagaaccatgttcgcagggcatgtgggagtgggcagacttgtttcaaagaaactacagattcctccatcccaagcttggacttttctctcagcattaaaccaggtgactccagctgaagttagctgttcctcagtagctctttgttccctctcccctcactttcatgtgtgcaggtgtcctgctttcaatgagtt

SEQ ID NO: 202 - DNA, 523 bp, Homo sapiens
  CDS 346..522
  sig_peptide 346..498: Von Heijne matrix score 4.80000019073486 seq VMGLLQLPEFTAT/QP
  misc_feature 438,440,514: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtasacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattgaaaaagaatagcaggctgctkctgaaaaggcantnaccaaggaggaatytcagggtgatgggactgctccagctccctgagttcactgctactcagcctkaggttacanactggtctg

SEQ ID NO: 203 - DNA, 451 bp, Homo sapiens
  CDS 272..451
  sig_peptide 272..337: Von Heijne matrix score 4.80000019073486 seq ASLFLRLIHVATS/IN
cttgtatcggttaatttttaaaaggtttatttacatgcaataaactgcacatacttcaattgtacattttggtaattcttggcatttgtagctctataaaaccagcaacatattaaaatagcaaacatatccattacctttaccaccaaagttttcttgtgttttttctactcactttttcctgcctatccccccatctcttccacaggtaaccactgatccacttccagtcactatccatgagtttttatttccaaatacatgaaatcatatggtatgtatactttctgatcactcagcatcactatttttgagattaattcatgttgctacatctatcaattgttctgttcttactagggagtgttatttcattatatacgtataccatagtaagtttataagtcacaaattcacctgccatggacattttggaatgttttcaggtttt

SEQ ID NO: 204 - DNA, 505 bp, Homo sapiens
  CDS 6..503
  sig_peptide 6..179: Von Heijne matrix score 4.80000019073486 seq RIYLVSLPFVCLC/LY
ccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggc

SEQ ID NO: 205 - DNA, 277 bp, Homo sapiens
  CDS 73..276
  sig_peptide 73..165: Von Heijne matrix score 4.80000019073486 seq LLGLQPAPRFAHS/GP
actggagcttgcgttacttggcctcacctcacctgtgctgtccacgcctggctttgtctcacctgacgcgatatgcctctcctgcgtgggcgctgtcctgcccgccgccactaccgccgcttggccctgctcggcctgcagcccgctccccgcttcgcccactcggggcccccgcgccagcggcccctgtctgccgcggaaatggctgttggacttgtggtgttttttacgaccttcttaacaccagctgcatatgtgctaggcaacctgaagcagt

SEQ ID NO: 206 - DNA, 701 bp, Homo sapiens
  CDS 298..699
  sig_peptide 298..675: Von Heijne matrix score 4.80000019073486 seq LLLVIQLGRFTAQ/DT
aatcagtttccagccaacaccagggtgtcctagtccgcagaggtgtgggggacamwctccataatctctacttttctttttgtgcagctgagtcatggagctttcagcccmrscacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggamcgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaa

SEQ ID NO: 207 - DNA, 499 bp, Homo sapiens
  CDS 213..497
  sig_peptide 213..266: Von Heijne matrix score 4.80000019073486 seq MAMAFSFPPVASG/QL
gcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggcaaggtgaccccatggcaaggcgcaacmagaagggtccagcttcaacatgacccacctgtccatggctatggccttttcctttcccccagttgccagtgggcaactccaccctcagctgggcaacacccagcaccagacagagttaggaaaggaacttgctactaccagcaccatgccctaccaatatccagcactgaccccggagcagaagaaggagctgtctgacatsctcaccgcatcgtggcacctggcaagggcatcctggctgcagatgagtccactgggagcrttgccaagcggctgcagtccattggcaatgcaaccacggcatct

SEQ ID NO: 208 - DNA, 485 bp, Homo sapiens
  CDS 211..483
  sig_peptide 211..417: Von Heijne matrix score 4.80000019073486 seq LCHLLSVCPQGLT/LS
agattacagaaaactccaaagagattgaagagatggaataaaggatcccagcccccgaaaagagaaagctttgtgtctgtagccatagcccttggcaatcagacatcctcctcactaatgtgagtcaggaggggactagaagtgctcagaggatggactgcctctggccagtgcaggagagaggcaggggtgttgaggcacaggagccagatgagaggaacgtcagcagcaaagcaggtggacagcacggaagaggcagtacatcttaacaaaatcagggttctggatgaagggaggggtggtgaatggttgctgcaatcaacagttcatacttcaatggaaagaaggtgggatttgattcctggctgcaaatcttcactctgtcacctgctatctgtgtgccctcagggtctcactttgtctcccaggctggagtgcagtggcgcaatcaccactcactgcagcctcacctaccggggctcaag

SEQ ID NO: 209 - DNA, 458 bp, Homo sapiens
  CDS 69..458
  sig_peptide 69..176: Von Heijne matrix score 4.80000019073486 seq LLLLRLNDAALRA/LQ
aacagaggaggtggcggtggtggccctcgcctgtggcccccgtgctgcttgcactcgaactcgtcgccatggaggagctccaggagcctctgagaggasagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttkggcagccatggattctatcccagccccatcatcagttcagggacacaatctg

SEQ ID NO: 210 - DNA, 559 bp, Homo sapiens
  CDS 8..559
  sig_peptide 8..55: Von Heijne matrix score 4.80000019073486 seq HLHLCLCVPDLRS/LR
gagaaggatggggccgcatctacacctgtgcctgtgtgtgcctgacctgcggtcactccgtgtctgtgtgtccctctggtctgtccaccacaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacgcagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtrgcgctggggcctggccatggsctgcagggccccacgctgcactcctggctgcaatgcttcgggggctggcag

SEQ ID NO: 211 - DNA, 481 bp, Homo sapiens
  CDS 167..481
  sig_peptide 167..301: Von Heijne matrix score 4.80000019073486 seq VFALAGLTDLLDG/FI
gtacagcatgggttgaggtggccagatcctggcaggggtctcaactccactgatagctaaagcatgttggggtttgaatgctggatactttgaagttgccatatcctgactgaagtccttcccagaacggcagtagttggtcgagtatgccacagtatgaaaacccatggacaatcccgaatatgttgtcaatgacgagaattggcttggcccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttat

SEQ ID NO: 212 - DNA, 452 bp, Homo sapiens
  CDS 21..452
  sig_peptide 21..338: Von Heijne matrix score 4.69999980926514 seq VSLLSLWSNRINT/AN
aaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatgga

SEQ ID NO: 213 - DNA, 472 bp, Homo sapiens
  CDS 286..471
  sig_peptide 286..327: Von Heijne matrix score 4.69999980926514 seq SCCAQLWLSFSTG/WW
attctcctgcctcagcctcccaagtagctggaattaccggcacctgccaccatgctcaatgttttcttgtattggttgaacatttgtattagttctcctggaaataccttttttttaataatctttgactagttttcaattgaattttttggatttcccttaaggatttgtacttcttacataatcacttagagacgaggtttcactatgttggccaggctggtctcgaactcctgactctgtgatctgactgcctccgcctcccaaagtgctaggattacaggcatgagctgctgcgcccagctatggctctcattctctacaggatggtggataatacaagcatgttggaattactatggaggcacaatgcttacaagaaacccaacttgcaaaactaagattacagacggakytcgcgctatcgcccagtctggagtccaacggcacaatcctggctcactgcaacctc

SEQ ID NO: 214 - DNA, 444 bp, Homo sapiens
  CDS 214..444
  sig_peptide 214..336: Von Heijne matrix score 4.69999980926514 seq ALLKDSIVQLCTA/RP
attttcctgaaggacaacggctctattttactggggtccgccatcgtctcgtccgccggtcctggctcttcttttgacttttgtgccctggtaattctgtatcctgtttaccgtttacctacttcccacgtcatcatgatttctttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagrttcagaatctgcagaaagcaggcactcgtacagacttc

SEQ ID NO: 215 - DNA, 453 bp, Homo sapiens
  CDS 236..451
  sig_peptide 236..415: Von Heijne matrix score 4.69999980926514 seq EVLSLDLVSVSQT/LP
gaacacgccgcggtcctcgtcgtggtgagcgcmscactcaggctggtcctgggggtggggctgtaggggaaagtgctaaagccgctgaggtgcagtggctcacgcctgtaatcccagcactttgggaggccaaggcaggtggatcacctgaggtcgggagttcaagaccggcctgaccaacatggagaaaccccatctctactagaaatacaaaattagccaggcatggtggtgcatgcctgtaatcccagctactcgggaggctgaagcgggagaatcgcttgaatccgggaggcagaggttgcttgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaa

SEQ ID NO: 216 - DNA, 472 bp, Homo sapiens
  CDS 183..470
  sig_peptide 183..308: Von Heijne matrix score 4.69999980926514 seq LLXSALHTPPARL/IP
  misc_feature 62..63,84,233: n=a, g, c or t
cacaaaaactatccttgctagggaaacacagscctggaacaaaccccctggaccccttgtsnnaccaccagcccatsctgtarnaaaatgatggttgaagctgsagtgacagaattggagagatgctctgttagacaagtctgtcagctgaaaggggcagaaacsattgttgaactgcwtatatgagaggaagacctgggtggcacaggcctggctggacgcagggctcacwnwgcgtcatyagcacttcatctcttcccctgcgggacctgctgtmctctgcgttgcacacaccccccgccaggctcatccctgtatcctccttggaggaaaagtgccaggctggtgctacttggccctgcctgggtcacacgcctgcctcgggatgtggaggatggtcagcccagccacagcacatggattgctatgtgaaggatgatgttccacaagaaaaccaggacggcttcaccag

SEQ ID NO: 217 - DNA, 461 bp, Homo sapiens
  CDS 78..461
  sig_peptide 78..233: Von Heijne matrix score 4.69999980926514 seq LGLALGRLEGGSA/RH
gcgcgccatcttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggdmccctggacccaa

SEQ ID NO: 218 - DNA, 469 bp, Homo sapiens
  CDS 187..468
  sig_peptide 187..255: Von Heijne matrix score 4.69999980926514 seq LKLLTSSDLPASA/SQ
taaatttgttgttgttgttgttgttgtttgttgttatttttttgagaagagtcttgccctgtcgccaaggcgggaatcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccagcacacccagctaatttttgtat

SEQ ID NO: 219 - DNA, 468 bp, Homo sapiens
  CDS 187..468
  sig_peptide 187..255: Von Heijne matrix score 4.69999980926514 seq LKLLTSSDLPASA/SQ
taaatttgttgttgttgttgttgttgtttgttgttatttttttgagaagagtcttgccctgtcgccaaggcgggaatcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgta

SEQ ID NO: 220 - DNA, 480 bp, Homo sapiens
  CDS 330..479
  sig_peptide 330..413: Von Heijne matrix score 4.69999980926514 seq VPALPLLSSLCMA/MV
ctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtttttccagcgctcttgggaggtgggctgtgctgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaaatggtgatgctg

SEQ ID NO: 221 - DNA, 364 bp, Homo sapiens
  CDS 142..363
  sig_peptide 142..246: Von Heijne matrix score 4.69999980926514 seq LLPLLQQCQVVRL/DD
aggccgtctcgctctgggtctccaggcccgcgaccgtccgccagtcgtcccgagaatctccggcctgtgaaactgtgaggggattcggccaagacgtcctcttccctctgcctyccacccaggccactcttcacctycaccatgagcctggacatccagagcctggacatccagtgtgaggagctgagcgacgctagatgggccgagctcctccctctgctccagcagtgccaagtggtcaggctggacgactgtggcctyacggaagcacggtgcaaggacatcagctctgcacttcgagtcaaccctgcactggcagagctcaacctgsgcagcaacgagctgggcgatgtcggcgtgcatt

SEQ ID NO: 222 - DNA, 483 bp, Homo sapiens
  CDS 178..483
  sig_peptide 178..381: Von Heijne matrix score 4.69999980926514 seq SLFTAFFLATIMG/VR
  misc_feature 293,340: n=a, g, c or t
gtttttccaggagggagcggcctttgctcagcgcgagacggctgggcgccgagtgggacagcgctggtgcggagactgcttccggactccaggtaccgcgcttggcgcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggncggctatggagcttaccgtgtctccaatgacaaacgagatgtaaaantrtcactgtttacagctttcttcctggctaccataatgggtgtvagatttaasasgtccaagaaaataatgcctgchggtttggttgcaggtttaagcctcatgatgatcctgagacttgtcttgttgctgctctggagcatc

SEQ ID NO: 223 - DNA, 490 bp, Homo sapiens
  CDS 318..488
  sig_peptide 318..377: Von Heijne matrix score 4.59999990463257 seq RLVXVSVSPQSRA/SL
agtgcggccgtcatggcgtcgccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggstgcatcacctccgcagagaccgtgcttatcacccagcagagccacgaggagctgaagaaggttctagatgctaacaagatggcggcacccagtcagcagaggctggttrtagtttcggtctcaccacagtctagagcatcgctggstgcacggtttcagctgaatcctacagatactgccaggaaattaacctcattctttagaaaaataggggwgcacttcgtsttcgasaccgccttctcagggaactt

SEQ ID NO: 224 - DNA, 492 bp, Homo sapiens
  CDS 97..492
  sig_peptide 97..135: Von Heijne matrix score 4.59999990463257 seq MLVLRSALTRALX/SR
aatgatccaggagccgctcctttccactcgggaaaccttcagaggagtctcagaaaggacacggctggctgcttttctcagcgccgaagccgcgccatgctcgtcctcagaagcgccctgactcgggcgctgrcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttgkaggcagaatgaatacagtgtttcatatttggaagtatgataattttgctcatcgaactgaagttcagaaagccttggccaaagataaggaatggcaagaacaattcctcattccaaatttggctctcattgataaacaagagagtgagattacttatctggta

SEQ ID NO: 225 - DNA, 564 bp, Homo sapiens
  CDS 315..563
  sig_peptide 315..446: Von Heijne matrix score 4.59999990463257 seq TLLSIIFSSLGIA/FS
gatcattgtctattgttctccaaacagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagatg

SEQ ID NO: 226 - DNA, 498 bp, Homo sapiens
  CDS 306..497
  sig_peptide 306..458: Von Heijne matrix score 4.59999990463257 seq AVLELGAETGVQS/SD
tacaaggcttcctcggagatggcactttaccagaaaaaacatggtattaaactctataaacctctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgc

SEQ ID NO: 227 - DNA, 524 bp, Homo sapiens
  CDS 302..523
  sig_peptide 302..352: Von Heijne matrix score 4.59999990463257 seq LLPLCQRIHCIIG/RF
agatgagtgttcagctctcagcagagaggttagctcctctctgcagcttgtcctgttgtctcctcaagtctggctgagtccggagtttttatgagcctcagaggggaggaagtgcatgctgattaatccatgggcaggcctggaaaagttcccactccagtctgcgggacccacagcctggccctcaggctcaggcttcccwggcttgaagattgggcttcacctgggacctaccccttctgcctaggagcatgtctgcctcctgctgcctttcatggtgcccagccaaggctaagtcgaaatgtggcccaaccttcttcccctgtgccagcggatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgagg

SEQ ID NO: 228 - DNA, 283 bp, Homo sapiens
  CDS 89..283
  sig_peptide 89..205: Von Heijne matrix score 4.59999990463257 seq FWFCFFLNRAILC/SV
cgatcaagtggcttttcctgcgacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgtttttttttaaaccgggcaatattgtgttcagttcaagctgtgaagaaaaatatatatcaatgttttccaataaaatacagtgactacccaaaaaaaaaaaaaaaa

SEQ ID NO: 229 - DNA, 450 bp, Homo sapiens
  CDS 97..450
  sig_peptide 97..396: Von Heijne matrix score 4.59999990463257 seq AVAILGGPGTVQG/VV
aagggtggctttagaggctcagtccccgcgacgccgcgctggttggtgctcctgcgccggagagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggtggcaggtgtccaggatgtggaggtgcacttggagtaccagatggtcttggtacacaccactctacccagccaggaggtgcaggctctcctggaagcacggggcggcaggcggtactcaagggcatgggcagcggccagttgcagaatctgggggcagcagtggccatcctgggggggcctggcaccgtgcarggggtggtgcgcttcctacagctgacccctgagcgctgcctcatcgagggaactatt

SEQ ID NO: 230 - DNA, 306 bp, Homo sapiens
  CDS 83..304
  sig_peptide 83..127: Von Heijne matrix score 4.59999990463257 seq VLAGSLLGPTSRS/AA
ctttttttcctttgttccagggctggagcggctctgggctccggaatcgcccgcagccggtactgcvvgacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccagccgg

SEQ ID NO: 231 - DNA, 351 bp, Homo sapiens
  CDS 111..350
  sig_peptide 111..197: Von Heijne matrix score 4.59999990463257 seq LLGPLMAACFTFC/LS
  misc_feature 327: n=a, g, c or t
agacggtcgccgccgcgtttgcgcagggggagctggtcgccgccgcggccgcctggaattgtgggagttgtgtctgccactcggctgccggasgccgaaggtccctgactatggctccccagagcctgccttcatctaggatggctcctctgggcatgctgcttgggccgctgatggccgcctgcttcaccttctgcctcagtcatcagaacctgaaggagtttgccctgaccaacccagagaagagcagcaccaaagaaacagagagaaaagaaaccaaagccgaggagragctggatgccgaavwctggaggtgttccacccgangcatgagtggcaggcccttcagcc

SEQ ID NO: 232 - DNA, 522 bp, Homo sapiens
  CDS 97..522
  sig_peptide 97..207: Von Heijne matrix score 4.59999990463257 seq GMALSVLVLLLLA/VL
atcgcggcggcggcggcggcggcggttgaactgactcggagcgaggagacccgagcgagcagacgcggcccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagcaagctgctcaaccaggtactgtgaacctgccaacctccatcagccagcagaccatcgcagagacagacggggactctgcaggctcagattcattccctgttggcagaacccaccacaggtgtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagct

SEQ ID NO: 233 - DNA, 253 bp, Homo sapiens
  CDS 85..252
  sig_peptide 85..213: Von Heijne matrix score 4.59999990463257 seq XAXXLGASEQALG/XX
ggaattgggggtgaagcgatagcgttttgcccgcattcggggcgcgcggagctggggggtccctgtggggctcccggagttaagatggcgtcctcagcggagggggacvaggggactgtggtggckctggcgggggttctgcagtcsggtttmcaggarctgagccttaacaagtwrgckwcgkccctgggcgcgtcagaacaggcgctggggstgwtcatctccatcttcctgggaaaccagctctaccact

SEQ ID NO: 234 - DNA, 405 bp, Homo sapiens
  CDS 146..403
  sig_peptide 146..316: Von Heijne matrix score 4.59999990463257 seq WALVVPATREAEA/GE
  misc_feature 348: n=a, g, c or t
cattcgggaggctgaggcaggagaatcgcttcaacccaggggttggaggttgcagtgagctgagattgcgccactgcactccagcctggtgacaaagcaagactctgtcttaaaaaaaaaaaaaataggccaggcacggtggctcatgcctgtaatcccagcactttgggaggccaaggtgggcagatcacgaggtcaggagatcaagaccatcctggctaacacggtgaaacccatctctactaaaaataaaaaaggatttagctgggcgtggtggtgggcacttgtagtcccagctactagggaggctgaggcaggagaatggtgtgaacccgggaggcggacttncagtgagcagagatcacgccactgcactccagcctgggcgacagagcgagactccat

SEQ ID NO: 235 - DNA, 594 bp, Homo sapiens
  CDS 182..592
  sig_peptide 182..247: Von Heijne matrix score 4.5 seq SLLALLFILASWI/IF
agaaggttgtgaatccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtgagggacacttgggacgcaggaagcaatatggcggggatttcctg

SEQ ID NO: 236 - DNA, 400 bp, Homo sapiens
  CDS 214..399
  sig_peptide 214..330: Von Heijne matrix score 4.5 seq LVLVKRLLAVSVS/CI
agacgtaatgtaatatatattagtgtgtatatatctgtgtgtgtgtgcgtatattttactttttaatctctttgtctgtcagcttccccctacttttaagtttcttaaggtcttagtggtaaaacatttgcggtaaaaatgtatacccacttacttgtcaacagaggttcttgagatggggttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgtaaaaacca

SEQ ID NO: 237 - DNA, 481 bp, Homo sapiens
  CDS 145..480
  sig_peptide 145..420: Von Heijne matrix score 4.5 seq QPLLLLFLLLSLL/NV
tttttcaccttcttctcctggacagccggggccaccattccactggcttcattcttgctgctcagctgaatacaaggcctcagtggtttgctgggctttggtgagatcttaaaggcaaacctctcttggcgcaaggaaggagccatgcagttgtatctgtactcgatgtccacagccatcatggggctagatgaacaggctagaaccctggaaagggaagagaagaaagaaaacagtggagcaatcagatcagacagatgtgtaaaggcatcattccagcagggactggcaaacaatatttccttttatctatgcccacctggctacagtccacgtatgctcagattctcttctgcctctgccgccctgagacagcaagaccaaccccttctcctcctcttcctcctcctcagcctactcaacgtgaagaggatgagaatgaagacctttatgatgacccgcatccacttaatgaatagta

SEQ ID NO: 238 - DNA, 663 bp, Homo sapiens
  CDS 118..663
  sig_peptide 118..234: Von Heijne matrix score 4.5 seq LVLVKRLLAVSVS/CI
aaaaaaaacgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaa

SEQ ID NO: 239 - DNA, 540 bp, Homo sapiens
  CDS 114..539
  sig_peptide 114..410: Von Heijne matrix score 4.5 seq LAPGSFLAAVVDA/LE
ctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgcagtggcccccatctgcactgacaaaatcaa

SEQ ID NO: 240 - DNA, 559 bp, Homo sapiens
  CDS 98..559
  sig_peptide 98..538: Von Heijne matrix score 4.5 seq LPFLILANHQTSS/SS
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacattgcctcttcagaggatgatttagaagctgctagaaatgagctgcactcagctcttcagcatccacagttatgcactttaccctttttaatattggccaatcatcagacaagcagcagctcgctcagtacagagaaa

SEQ ID NO: 241 - DNA, 479 bp, Homo sapiens
  CDS 131..478
  sig_peptide 131..241: Von Heijne matrix score 4.5 seq ENSLIILLQGLQG/RV
aactctgcgcccggagacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagcattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaa

SEQ ID NO: 242 - DNA, 516 bp, Homo sapiens
  CDS 30..515
  sig_peptide 30..167: Von Heijne matrix score 4.5 seq AFCLVASVLTCGG/LL
aagaagagatcctcaccggttgagttcagatggaagagaacagtaagaaggaccatcgggctttgctcaaccagggagaggaggatgaactggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagacgaatttcaaagatatatgaggaagaaggtattctgcctctacttatccacactgaagtttcctgtaagcaagaagtgggaagaatccctggtggctgaccgccactctgtcataaaccaagccttaataaagccagaattaaaactgcggtgcatgcaagtgcagaaaatcaggtatgtttggaacgacctggagaagcggtttcagaaagttgggttgctagaagacagcaattcctgctctgaca

SEQ ID NO: 243 - DNA, 558 bp, Homo sapiens
  CDS 167..556
  sig_peptide 167..403: Von Heijne matrix score 4.5 seq RWAMLGALGCTFP/EI
aactcacactctctcttatctcctttcctttcattgtagttaacgaaaagattacgataatgggaacatcagctatccagcaatcctccttcgccggccaaacggctctcaagccctccaacgaactcctccgcaagttggtgtctccggtggtggccgtgtgaccatgcgtcgtaccgtcaagtctactcctcaaagcatttggtacggaccagaccgtcccaagtacttgggaccattctcggagaacacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggctctcagattttctcagaaggaggtcttgattacctcggaaaccctaacttgatccacgcgcaaagcatcttagccatctgggctgttcaagttgtgcc

SEQ ID NO: 244 - DNA, 478 bp, Homo sapiens
  CDS 258..476
  sig_peptide 258..347: Von Heijne matrix score 4.5 seq LTLIIPAVFRAEG/GG
taaatattgtcaggtgtccaatgcagaatcatgtcatgtgaggctgttcctttgcaggggacttcatgtgagggtagagtgtttcttgtggcatcttttttgggatgcaaaacttatcctacaggtcatttatagtattttggaatgagtaaaggctttttgctgtccaacggaattattaaaaagcacttattatctttctcattaaacgagtcatctgttctactttcaatgcacttgtgtcaagtgagtatgacatgcaaggatttggagatacagaagtgaacaggcattgctgggcgcggtggctcacgcttataatcccagcagttttcagggctgaggggggaggatcgcttgaggtcgggagttctgtacccgcctggccggtgtggtgggaccccgtctctgctaaaagtgcaaagattggcggggtgttgtggtgcgtgcctttgatcccagctattcgggaggctga

SEQ ID NO: 245 - DNA, 470 bp, Homo sapiens
  CDS 27..470
  sig_peptide 27..119: Von Heijne matrix score 4.5 seq TALMVGAASLLEG/RP
atctttctggactggccctgcagaggatggcatgcaccactactgcccccgcccaggaacacatgcttctcacccctctcactgctctgatggtgggggctgcttctctgcttgagggccggccacagatctcagctccatactcccgagctgcatgttgcagccctggggcactgggatgtcctgcagctcgggttgggattctggatctgatgtattcctgggttgccaggaaagtgctcaggtgcagcaatactgggctgcaggggctgcactgtgcaccagcttatgcagcacagcttggtatggaccctgggaggggccaacgagcaggagggcctgtagagcagacatacttcagtcccatggggaagctgcccactctttcgtggctggaaggctgtacagcagtcatgacgctggcatctgcttggcttctggggagccctcgggaaacttacaatcatgag

SEQ ID NO: 246 - DNA, 451 bp, Homo sapiens
  CDS 65..451
  sig_peptide 65..439: Von Heijne matrix score 4.5 seq XVLLLKVWSQGTA/FS
  misc_feature 406: n=a, g, c or t
cttttacgacgcgccggaaagcaacggcaagggccgcagccagcaccgggcggagagggctaccatggggaaaatsgcgctgcaactcawagcsacgctggagaacatcaccaacctccggcccgtkggcgaggacttccggtggtacctgaagatgaaatgtggcaactgtvgtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcakgtnttgctgctgaaggtgtggagtcaggggacagccttcagtgacatt

SEQ ID NO: 247 - DNA, 458 bp, Homo sapiens
  CDS 94..456
  sig_peptide 94..210: Von Heijne matrix score 4.5 seq LVLVKRLLAVSVS/CI
acagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggattctaggatgttatgatgctttacagaaaaaatatctaaggatggttgttctagctgtatacacaaacccagaagatcctcagacaatttcagaatgttaccaattcaaattcaaatacac

SEQ ID NO: 248 - DNA, 473 bp, Homo sapiens
  CDS 266..472
  sig_peptide 266..307: Von Heijne matrix score 4.5 seq ILVTVPGVCPAQC/CW
tagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattggga

SEQ ID NO: 249 - DNA, 322 bp, Homo sapiens
  CDS 13..321
  sig_peptide 13..261: Von Heijne matrix score 4.5 seq FIFLAAVSFPLSC/VL
  misc_feature 37: n=a, g, c or t
caaatgtaaggtatgtgctctgatctcggggcttggnggaggtgggagaatgagggaggctgctttgtgggggagaagtgtctgtctgtcccgggtctccgtggcctgccagtcacttggtccttctgtctccatccctcactccacgttactgactggctatctcccacctccatcttcctggctgtccatccttctttctctctcctctcttggtcctactttatttttcttgctgctgtctccttccccctttcctgtgtcctttcctccatcctgtcatctctctcaaatctgcctcttcaaaaaaaaaaaaaaaaaa

SEQ ID NO: 250 - DNA, 548 bp, Homo sapiens
  CDS 60..548
  sig_peptide 60..308: Von Heijne matrix score 4.5 seq VPFMFAGLGLSWA/GM
ctcttttccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccaaactctccacagctgccaacactggacaaattgatgacccccaggagcagcacagagtcatcagcagcaacctggscctcatccargtgcargscactgtcgtggggctcttggctgctgtk

SEQ ID NO: 251 - DNA, 453 bp, Homo sapiens
  CDS 118..453
  sig_peptide 118..234: Von Heijne matrix score 4.5 seq LVLVKRLLAVSVS/CI
  misc_feature 411: n=a, g, c or t
aaaaaaaacgcatgcgcgtcgggcacagcgcgtgcagcctcgtgcagctcttctggtctccggsgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatgtatacacaaacccngaagttcctcagacaatttcagaatgttaccaattcaaattc

SEQ ID NO: 252 - DNA, 578 bp, Homo sapiens
  CDS 22..576
  sig_peptide 22..69: Von Heijne matrix score 4.40000009536743 seq ASVLLFLAWVCFL/FY
acttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaargcgtgtagtcttcatgggagatgatactggaaagacttttcc

SEQ ID NO: 253 - DNA, 672 bp, Homo sapiens
  CDS 36..671
  sig_peptide 36..566: Von Heijne matrix score 4.40000009536743 seq EFLFCLFKHLCLG/GA
gaaacggcccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaa

SEQ ID NO: 254 - DNA, 479 bp, Homo sapiens
  CDS 272..478
  sig_peptide 272..322: Von Heijne matrix score 4.40000009536743 seq FAAFCYMLSLVLC/AA
cttcttcgatttgcggacggttccctccagcgactctcgacacacgttttcctgtcttcgccggaggccgggtctggggtcgccggagcctgcgggaatccagcgcttattcgctaaccctcgagtcgcttcgctagctgtgcgccctcctgggcactagcctggagaggagcgtgcagacgcgctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggacatcgagcgcatctgcttccttctgcgaaastgggtgctgcc

SEQ ID NO: 255 - DNA, 327 bp, Homo sapiens
  CDS 41..325
  sig_peptide 41..211: Von Heijne matrix score 4.40000009536743 seq VIRHLLLSPASPG/RS
agtattagttcttgcagctggtggtggcggctgaggcggcatggatctcagcgagctggagagagacaatacaggccgctgtcgcctgagttcgcctgtgcccgcggtgtgccgaaggagccttgcgtcctgggcgtcgatgaggcgggcaggggcccgtgctgggcccatggtcatacgccatctgttattrtcccctgcctcgcctggcagatctggaggcgctgaaagtggcagactcaaagaccctattggagagcgagcgggaaaggctgtttgcgaaaatggaggacacggactttgtcggctgggcgctggatgtgctgt

SEQ ID NO: 256 - DNA, 476 bp, Homo sapiens
  CDS 97..474
  sig_peptide 97..276: Von Heijne matrix score 4.40000009536743 seq ACLAASLALALNG/VF
ctttggggccgaagtgggcgtgcggctcgcgctgttcgcggccttcctggtgacggagctgctccccccgttccagagactcatccagccggagagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggc

SEQ ID NO: 257 - DNA, 506 bp, Homo sapiens
  CDS 127..504
  sig_peptide 127..189: Von Heijne matrix score 4.40000009536743 seq VLDGLTASSPGSG/SS
aggacctcggagagcgccaggmgccgcgaccagagggcccagagaagcggccggagcccgcctacctcggccccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgagacgagaacaggtgctatacgaatactcgggagacctggtgttgattgctattgccaacatgaaagtggtgcagctgtcctacagctccaatttttgatcaatgagggtgccttggt

SEQ ID NO: 258 - DNA, 447 bp, Homo sapiens
  CDS 36..446
  sig_peptide 36..128: Von Heijne matrix score 4.30000019073486 seq SILVLNVSFRTTA/DD
  misc_feature 273: n=a, g, c or t
aaaaataaataaataaaaacacgccgccgccatcaatggcgatgtcgcgcttcgggcgctccgggcagccggagaaccgcgaatctttctccatcctcgtcctcaacgtctccttccgcactacggctgacgatctcttcccgctcttcgatcgctacggcaaggtcttagacatctacatcccgcgcgaccacaggactggggatccgcgagggttcgcgttcgtgaggtacaattacgaggatgaggcgcgggatgccattgacgggcttnatgggatgaggtttgatgggcgtgcgctcatggtgcagtttgccaaatacggacccaatgctgaaaagattcataggggtagaattacagaagaaaatccaaagccaaggggtcgttgcagaagccgcagtccaagacagaggtatcgagaggattatcgggatagagactata

SEQ ID NO: 259 - DNA, 433 bp, Homo sapiens
  CDS 172..432
  sig_peptide 172..321: Von Heijne matrix score 4.30000019073486 seq LGFRICLFHDSDC/RQ
  misc_feature 28: n=a, g, c or t
cctcactacctgtctatgcgccttgcwnccctcccctcccccctccccgtctcctctcttcaggcattgtcttagttactgaagtagcttcaaatggatctttaacctgtttgtgagattgtacagaaggttctgttctacctacttgattctttaattaaaacatttgctatgaggtgtgataacaatttccagcattcgaagttgttactgagaaatggccagtctgagcaacgtggtgcatttctgcagttccgcacgggactttggtcagtgcgtgttttgggtttcagaatttgccttttccatgactctgactgcagacagcctcttctgggcagtctgttgctgttggcagcggccastcccgagtgcccttccamcctcgctggttcaactttgactgtaaatgtcatgaatgtagccactagag

SEQ ID NO: 260 - DNA, 467 bp, Homo sapiens
  CDS 89..466
  sig_peptide 89..214: Von Heijne matrix score 4.30000019073486 seq LTADVLAVSSSVA/ST
actccctccaaccgccacaagcagcaaagggcatagatgaccacaggagagccctagggggaggccggctccaccagmagccccatacatggcactcccagggtaccccctgggcaacgtggatgacagcaggtctaaggacagcccagcaggagagccccaaggtcaggtcccactcacagcagatgtcttggcagtgagcagctctgtcgcatccactgacyggcaggatatagatcaggcctccttcaagacggccacccccagggccatatcaacatctggagacaaagacaagagtgcagttgttccagaacacggccagaagacacccagaaaaatcacacctctgcttcccagccaaaatccaagtcccctgcaagtgtctatgagccttcagaatccagcgtgggacaggcaggttcaagacgcaaggacaagtcagagtctagtggttttccaagtca

SEQ ID NO: 261 - DNA, 508 bp, Homo sapiens
  CDS 89..508
  sig_peptide 89..214: Von Heijne matrix score 4.30000019073486 seq LTADVLAVSSSVA/ST
actccctccaaccgccacaagcagcaaagggcatagatgaccacaggagagccctagggggaggccggctccaccagmagccccatacatggcactcccagggtaccccctgggcaacgtggatgacagcaggtctaaggacagcccagcaggagagccccaaggtcaggtcccactcacagcagatgtcttggcagtgagcagctctgtcgcatccactgacyggcaggatatagatcaggcctccttcaagacggccacccccagggccatatcaacatctggagacaaagacaagagtgcagttgttccagaacacggccagaagacacccagaaaaatcacacctctgcttcccagccaaaatccaagtcccctgcaagtgtctatgagccttcagaatccagcgtgggacaggcaggttcaagacgcaaggacaagtcagagtctagtggttttcccaagtcacctcctgggtaaagacaagatgtcacaaatggcgagtgtt

SEQ ID NO: 262 - DNA, 477 bp, Homo sapiens
  CDS 78..476
  sig_peptide 78..365: Von Heijne matrix score 4.30000019073486 seq IMNLTVMLDTALG/KP
agtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttacttgtcagatggaactgg

SEQ ID NO: 263 - DNA, 503 bp, Homo sapiens
  CDS 103..501
  sig_peptide 103..213: Von Heijne matrix score 4.30000019073486 seq LWEKLTLLSPGIA/VT
gattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccgktccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaacgagaagcg

SEQ ID NO: 264 - DNA, 571 bp, Homo sapiens
  CDS 217..570
  sig_peptide 217..276: Von Heijne matrix score 4.30000019073486 seq GCLLEPFVHQVGG/HS
cattttggtgcgagagaaacaataggacggaaacgccgaggaacccggctgadggcggcagcagagcatcctggccagaacaagccaaggagccaagacgagagggacacactgacaaacaacagacagaagacgtactggccgctggactccgctgcctcccccatctccccgccatctgcgcccggaggatgagcccagccttcagggccatggatgtggagccccgscgccaaaggstgccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggcctggcagccatccctggagcctcactccctcccactctgtgctttccctccctctcctccttctcctcctcctggcctcagccagcatctcacaccctcagttttcaa

SEQ ID NO: 265 - DNA, 497 bp, Homo sapiens
  CDS 233..496
  sig_peptide 233..436: Von Heijne matrix score 4.30000019073486 seq LAPLRILLPGLIP/FP
agtttgctatcgacaaagggagacaaagtcaaggggtgaagggaaaggagggccaagtagagcctccacgaccctcggcttcctcctcaccagctccccctccctccaagtccagtaagaagttgggccaagctggaagggattgaccggccgtttacctctccctcgccggcctcggcggagattccaggccctatagaaaccaggacgtcccttagcgccaccgcctcacatgccagtgstgccgggaacccagcgatatccgcaccagcgagaaggttccaggctgccggcggcggcgcagagagcgggaagagaggctcggaggaagccccgggcgtgggcgtggtcaggctccgagagcggccggggatgcggccacacccggcctggtaaactcgcacctcttaggatcttgctcccgggactcattcccttccccaccccctattttaaagttttatttgggtcgtctgtatcaattttagaacgagata

SEQ ID NO: 266 - DNA, 552 bp, Homo sapiens
  CDS 357..551
  sig_peptide 357..497: Von Heijne matrix score 4.30000019073486 seq IVSVFLLSTETIS/GL
ctaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatg

SEQ ID NO: 267 - DNA, 483 bp, Homo sapiens
  CDS 221..481
  sig_peptide 221..430: Von Heijne matrix score 4.30000019073486 seq ASVCISLPEGCSG/GR
aaggaagcgccgccccttcctacggctacgggaaggatcgtccagtggctgaggctggacagagcacagacaaaagataaaaagcaagatttgagagaggttcctggatcaactggctcaatctgcttagttctacaaagtggagtttctgggcatcattcttcatttctgtacacaaagtgctgtgaagctcaagaagaaatagctctgcacaggaacgatgtgcactgccctactgcttctttatctaagatggtgtttcaacttaaaacttgtgaatgtgaaatatgagccaaaagactctctcggccctgaaatgacctttgtagcagatgctgccagaggccccctgttatcctccctggactctccagctaacctgatgtcaactgccagtgtgtgcatctccttacctgagggctgttctggtggcaggagtccttgctactcacagaaatggccaccagaagtgccagaaaaatt

SEQ ID NO: 268 - DNA, 599 bp, Homo sapiens
  CDS 112..597
  sig_peptide 112..252: Von Heijne matrix score 4.30000019073486 seq VASFFHLFFRVSA/II
tcttacagtggtccctgctggcccttggtgaccggtcgcctcagttccgacccggacccgtacgctgctggctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgrgttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcytttagtgcactcttctccttcagagtaaagtggttggcggtggttatcatgggtgtggtgca

SEQ ID NO: 269 - DNA, 467 bp, Homo sapiens
  CDS 254..466
  sig_peptide 254..403: Von Heijne matrix score 4.30000019073486 seq ARLLVPVTCGAEA/EG
  misc_feature 324: n=a, g, c or t
tgtttataatcagtctggcctcattgcaaaaacattcatttaatattcatctgccaattttsttttttgcttctgcttggcttttagagttcctcatatttttgtgtctctgtctctgtgctttccgaggtctttcaatctcttatgtctctcaatctaaagaaaagatgtccttgtatcactttcagtggtttacttcaaatcacaacacaaatgaatttatagtttggaaaaatgttgataatattaaaatatgttcatttcctccagtgtgtttgtagtctctctccattttggcagccttttaaatacttacgcagtaantctaatcagaaaagatacagaagacaccgggcatagtgatgcacgcctgttagtgccagtcacttgcggggctgaggcagaaggttggcttgagcctggaggtgtaggttgcagtgagccgagctcgcgccactgcactccag

SEQ ID NO: 270 - DNA, 173 bp, Homo sapiens
  CDS 4..171
  sig_peptide 4..126: Von Heijne matrix score 4.30000019073486 seq RVVSWLFSIVVFG/SI
acgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggagca

SEQ ID NO: 271 - DNA, 739 bp, Homo sapiens
  CDS 222..737
  sig_peptide 222..311: Von Heijne matrix score 4.30000019073486 seq VAHALSLPAESYG/ND
accgaaaattactgacgagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagcttwccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaa

SEQ ID NO: 272 - DNA, 479 bp, Homo sapiens
  CDS 330..479
  sig_peptide 330..470: Von Heijne matrix score 4.30000019073486 seq RSTALVLSILSAG/QP
tttccttttaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgacatgctagtttgatacctgagacggggaagaaaaaagtcgccgagattcagggccacgcgggaggacgccgctcagggcagagcatgagctcctgcgggacttcgaggcgacacttctgcagatgtttgggctgcgcgccgcccgcagcctagcaagagtgccgtcattccggactacatgcgggatctttaccggcttcagtctggggaggaggaggaagagcagatccacagcactggtcttgagtatcctgagcgccggccagccgggc

SEQ ID NO: 273 - DNA, 449 bp, Homo sapiens
  CDS 15..449
  sig_peptide 15..326: Von Heijne matrix score 4.30000019073486 seq FLLVVLTLPISIQ/YR
tagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcact

SEQ ID NO: 274 - DNA, 473 bp, Homo sapiens
  CDS 71..472
  sig_peptide 71..169: Von Heijne matrix score 4.30000019073486 seq GYALLVIVTPGRA/AE
agtgagaccgcgcggcaacagcttgcgctgcggtastcccgtgggcgctccgctggctgtgcaggcggccatggattccttgcggaaaatgctgatctcagtcgcaatgctgggcgcaggggctggcgtgggctacgcgctcctcgttatcgtgaccccgggtagagcggcggaasaggaaatgctaaaggagatgccactgcaggacccaaggwgcagagaggaggcggccaggwcccagcagctattgctggcccactctgcaggaggcagcgaccacgcaggagaacgtggcctggaggaagaactggatggttggcggcgaaggcggcgcgcgcgggaggtcaccgtgagaccggacttgcctccgtgggcgccggaccttggcttgggcgcaggaatccgaggcagcctttctccttcgtgggcccagcggagagtccggaccgagataccatgccagggactctccg

SEQ ID NO: 275 - DNA, 542 bp, Homo sapiens
  CDS 43..540
  sig_peptide 43..180: Von Heijne matrix score 4.30000019073486 seq AAQAGLLASCGWA/GP
aagttgtcgataggcgggcactccgcctagtttctaaggatcatgtctgcgagccaggattcccggactgagcctaaccccgaggagcggccgcgtgaggcaccaggagcccacccggcgccgagcgggcgggtccattttgccgcacaagccgggctattggcaagctgcggatgggcaggtccaccttccttcgggggtgagcggcctgagatccagagacaatggccccgatgggatggagcccgaagcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaa

SEQ ID NO: 276 - DNA, 469 bp, Homo sapiens
  CDS 175..468
  sig_peptide 175..249: Von Heijne matrix score 4.19999980926514 seq LTPSVPLCPGAWL/GQ
  misc_feature 137: n=a, g, c or t
cggtgtccggggcagggcagggctggggcctgggcctcaggagcctaggctaggggcactccgagagcccctttttgtgataatgttttgcactttttcgtacagggtgggcgggggcgggaggggctaccgcctgnaacttttgatgctttttttttgtgtgggagaggcctgatgccgtttctgctttctgctgaggccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgcctttgtacagcctccacccccattaaaactgctctggacttgcaaaaaaaaaaacaaa

SEQ ID NO: 277 - DNA, 484 bp, Homo sapiens
  CDS 204..482
  sig_peptide 204..395: Von Heijne matrix score 4.19999980926514 seq SCLVSGWGLLANG/EL
aaaacggcgaggactgcagcccgcactcgcagccctggcaggcggcactggtcatggaaaacgaattgttctgctcgggcgtcctggtgcatccgcagtgggtgctgtcagccgcacactgtttccagaagtgagtgcagagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggtgagctcacgggtgtgtgtctgccctcttcaaggaggtcctctgcccartcgcgggggctgacccagagctctgcgtcccaggcagaatg

SEQ ID NO: 278 - DNA, 472 bp, Homo sapiens
  CDS 35..472
  sig_peptide 35..91: Von Heijne matrix score 4.19999980926514 seq AVAASAASGQAEG/KK
  misc_feature 20: n=a, g, c or t
cactcgytgyytcggcasbngctgctcttctaagatggctgccgctaccggtgcggtggcagcctcggccgcctcgggtcaggcggaaggtaaaaagatcaccgatctgcgggtcatcgatctgaagtccgagctgaatcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaa

SEQ ID NO: 279 - DNA, 511 bp, Homo sapiens
  CDS 261..509
  sig_peptide 261..479: Von Heijne matrix score 4.19999980926514 seq IFSKGFLLPPSSS/LP
agaaatcctagggagcatatagtccgtggctaaaacatgtcccagctccttggatggaatggcagtaaaggttctgtggctctttactgacctaactccttggattttcctcattcagtcccactgcaagcgtgtgggaggacttaaaaaaatgctattcacatgtgaaggaatctaaatacgatgattatatgaagcgatctctaagtcattttattttataattctttcagacaaaaatctacgtaccatcagaaactatgtctctgcagatggtaacagtcagtaataacatagccttaattcagccakgcttctcactgatgaattttgatggacaagttttcttctttggacaaaaaggctggcccaaaagatcctgccccactggagttttccatctggatgtaaagcataaccatgtcaaactgaagcctacaattttctctaagggattcctgctacctccctcctcttcgctacccagccacttgcacaattcaaaggcagc

SEQ ID NO: 280 - DNA, 499 bp, Homo sapiens
  CDS 286..498
  sig_peptide 286..489: Von Heijne matrix score 4.19999980926514 seq VGLSGLAAGFASA/SW
attttgttctgcggtgctggtatttagagcgcragccgtgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcstgcctatggcacagccaagagcggtaccggcattgcggccatgtctgtmatgcggccggagcagatcatgaagtccatcatcccagtggtcatggctggcatcatarccatctacggcctggtggtggcagtcctcatcgccaactccctgaatgacgacatcagcctctacaagagcttcctccagctgggcgccggcctgarcgtgggcctgagcggcctggcagccggctttgcatcggcatcgtggggga

SEQ ID NO: 281 - DNA, 472 bp, Homo sapiens
  CDS 178..471
  sig_peptide 178..465: Von Heijne matrix score 4.19999980926514 seq SRLFALMCCPGQA/LN
  misc_feature 220: n=a, g, c or t
acttggtgggagtcgctcaagagagcaagatgttctcgtgttgcttccccacttcgagaggttgctgcttcaggaacggagggagtgagagccttttctgacgatgccgaagaaggctcatccctcaccccagacgcctgtcgcccgttgtaataaggcgcatccagctcctggtccatgtgcagaagtaagagcactgccagcaccagcggcggasagnagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgccctaatgtgctgcccgggacaggcccttaaca

SEQ ID NO: 282 - DNA, 490 bp, Homo sapiens
  CDS 34..489
  sig_peptide 34..90: Von Heijne matrix score 4.19999980926514 seq AVAASAASGQAEG/KK
  misc_feature 18..19: n=a, g, c or t
cactcgctgsstcggcanngctgctcttctaagatggctgccgctaccggtgcggtggcagcctcggccgcctcgggtcaggcggaaggtaaaaagatcaccgatctgcgggtcatcgatctgaagtccgagctgaatcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatg

SEQ ID NO: 283 - DNA, 479 bp, Homo sapiens
  CDS 23..478
  sig_peptide 23..79: Von Heijne matrix score 4.19999980926514 seq AVAASAASGQAEG/KK
  misc_feature 8: n=a, g, c or t
tcggcasngctgctcttctaagatggctgccgctaccggtgcggtggcagcctcggccgcctcgggtcaggcggaaggtaaaaagatcaccgatctgcgggtcatcgatctgaagtccgagctgaakcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatg

SEQ ID NO: 284 - DNA, 489 bp, Homo sapiens
  CDS 171..488
  sig_peptide 171..359: Von Heijne matrix score 4.19999980926514 seq PLMLSCGHNFCEA/CI
actytggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcaactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttac

SEQ ID NO: 285 - DNA, 466 bp, Homo sapiens
  CDS 166..465
  sig_peptide 166..453: Von Heijne matrix score 4.19999980926514 seq LILSPMQPSPSFC/IS
ctcttctgatccaggaacaactatcctgagctgccgttcatgattcaggttggcatcaatcaaattggaagcacatgaattatacattattgtttctgagccacagcatcaccagcatctgttgtttcctgactttttaataattgtcattctaactggtatgagatggtatcacataaacagaaaaccgracaccacatgatcttgtgtctgaagttggttacctccaatgggttcccgatcttgctggcttcaagaatgaaggcacggaccctcatgggtttggccattctaggtcttctgaacttccaaatgaatcttaagatcagtttgtcaatgtctacaaaaaaagccagcagaatttttgataggattgttataaacatccagaacaatttggagaatattgccttcttaatattaagtccaatgcagccctctccatcattctgtatttcagtgtgca

SEQ ID NO: 286 - DNA, 451 bp, Homo sapiens
  CDS 176..451
  sig_peptide 176..442: Von Heijne matrix score 4.19999980926514 seq KVLLFSCCFSSLC/HM
attttgctgccacccttcatgttgtgagaatgctcaagcagcctgggaaggggcccacatgggagagcccagtgtggaggagctgaggccttccaccagcatccagcaccacattgctggctgtgtgaggaagccaccttagaagcagattttccaaccccaactgagccttcagatgattgcagtcctggctaacatcttgtctgcagcctcacgagagaccttgtgcctaagccatccagccaacttgttcctgattcctaatcgagatacaaatttacagagccctgcctgggccgtgggcccatctgagctgctgaaaccaggatctgttactggacagagacaaaggctctcaatgcccttcgtacccagatctaacccaggcctcagtgatacctctaaggttcttctgttcagctgctgcttctcatctctctgccacatgcca

SEQ ID NO: 287 - DNA, 609 bp, Homo sapiens
  CDS 104..607
  sig_peptide 104..454: Von Heijne matrix score 4.19999980926514 seq ILLLQSVACWCYL/NP
  misc_feature 553,600: n=a, g, c or t
ttgactgtgaactcctgtgactgccagtggtgtacctgaaggaccactggcctttttacacaatggctaacagcgattttcttgtacgcaaatttgggttaagatgtatgggtattttgcggggctgtgtcggcgtctccagaaattctggcgtgtcactgttaagggcttttttgttaagaagaaggaaaaaaaaatcccttcagctgagacttattttcatgaggaaaaaattgttgtacttggccaagtgttgatgaatgaatctctacccattgagaagagagctcaagctgcccagaaaattggactgctggccttcacaggaggaccacctgctgggaactttgcagctgagtacatggaagaagtggctcacttgttgcaagatgaggagttggcaccaaaaataaagatcctgctgctccagagtgtggcatgttggtgttacttaaaccctgtcagccagaaaagagccaaaagtctgcaatttattcctattctcattagtttttttgaaggcagattcgagtctactatcaaaagtgaacanaacagctacctcctccttaaaattttggacttgttacgttctcyctntcatgacat

SEQ ID NO: 288 - DNA, 296 bp, Homo sapiens
  CDS 24..296
  sig_peptide 24..101: Von Heijne matrix score 4.19999980926514 seq LLRTVTLTARSEA/SF
ttcacaaggaagaaactccaaacatgtccaaatatcagaaggaacaaactcctgacacactgcttttaagaactgtaacactcaccgccaggtctgaggcttcattcttgaagtcagtgagaccaagaacccaccaattctggacacactgggtttacagatgtgagcctcggcgcttggccaccatgccttttttagggtggcctatttcatatgtgtacacacttctccgttttgaaatgagacgttcttacacccaaacagatcctgaaataaagcttcaggttttctcagat

SEQ ID NO: 289 - DNA, 503 bp, Homo sapiens
  CDS 140..502
  sig_peptide 140..388: Von Heijne matrix score 4.19999980926514 seq VTNLLMLKGKSQA/FL
gctttctcgacaccaggggtctggacttagtgaccatggacgcttccccctcacctttctctctccccaagaaacttaatgaattatctgcccgttgttgttacagatcttataacagtcggtttaaagcggggatctgatgagcttctttcttctggcatcattaacgggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaac

SEQ ID NO: 290 - DNA, 386 bp, Homo sapiens
  CDS 17..385
  sig_peptide 17..142: Von Heijne matrix score 4.19999980926514 seq FILFLPVVFYLSS/FL
  misc_feature 76,237: n=a, g, c or t
tgatgtggaagatgcaatgaacatcactcgawaactatggagtcgaactttcaactgttcagtcccttgcagtganacagtgcctgtaattgctgtttctgtgttcattctctttctacctgttgtcttctaccttagtagctttcttcactcagagcaaaakaaacgcaaactcattctgcccaaacgtctcaagtcyagtaccagttttgcaaatattcaggaaaattcaaacanagacctacaaaatggagaattgacatatcacgtgaatgaatggtggaagacacaacttggtttcagaaagaagataaactgtgatttgacaagtcaagctcttaagaaatacaaggacttcagatccatttttwaaataaagaattttc

SEQ ID NO: 291 - DNA, 499 bp, Homo sapiens
  CDS 94..498
  sig_peptide 94..462: Von Heijne matrix score 4.09999990463257 seq CASGLTCVELADA/EV
ttttctccagagctgtgtgtgcacgagataaacaactcctgaaacttcctccccatacaaggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggcccygytccctgtcy

SEQ ID NO: 292 - DNA, 671 bp, Homo sapiens
  CDS 518..670
  sig_peptide 518..625: Von Heijne matrix score 4.09999990463257 seq SDLRLCHCTLAWA/TE
gagttggctgcccagaaatctgagagaaaataagacatgtaaagtcctgctcacccatgaaagtttctaaatacaggagctctgattctaaaatcatctccatttatattggtttatctttttaagacactttgttgtttcagagctaccttgccatgaagattcattaccttttctttgctcttttcttccttggccagctgtctacctcagtttatcttcttcagcaagttcttctttcagttcagaatatcctcaagcaggatgagcctggagaaaaactgtgaaattattggagtttacctttaaaaccataaaatgataagggcctgatagggttaagaatcaaaagaaaggaatggtgggccaggcacggtggctcacacctgtaatcccaacaatttgggaggccaaggtgggcagatcacaaggtcaggagttcaagaccagcctgaccaacacggtgaaaccccgtcactactgaaaatacaaaaactagcctcagtcgtggtggtgcatgcctgtaattccactactcaggaggctgaggcaggagaatcacttgaacttgggaggcagaggttgcagtgacctgagattgtgccactgcactctagcctgggcgacagagcarvttcgtctcgaaaaaaaaaaaaaaatgcgaaaagctt

SEQ ID NO: 293 - DNA, 512 bp, Homo sapiens
  CDS 139..510
  sig_peptide 139..339: Von Heijne matrix score 4.09999990463257 seq LRLLLQHGANVNG/SH
tttttcggacggctgcagcatcgcgttggggatcgaaagcgggggcttctgggacgcagctctggagacgcggcctcggaccagccatttcggtgtagaagtggcagcacggcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaakgagcaaacaaggaatgccaggatgactttggaatcacacctttatttgtggctgctcagtatggcaagctagaaagcttgaagcaata

SEQ ID NO: 294 - DNA, 490 bp, Homo sapiens
  CDS 330..488
  sig_peptide 330..473: Von Heijne matrix score 4.09999990463257 seq FLSLSLVAPFSKP/LX
  misc_feature 479: n=a, g, c or t
gagaacctgggaaaggactgggtggctgaaagatggctggaaagcgcatttagccaaccgagcctgcgcatggaacctgcggcgctgcacagctgcatagagatgtggagcacctccctttaccgtagaaagtaggcgagccagctcgaggcactatactgaggaagcgctgcggcctacttccgccgtttttcttaacatcaaagaaacttccggtagtggggtgtcttgcattccaccgtgtcggtgccccagaatgagacgcaagctgatctgcagatcccgcagtgccttctgctcttttcggggcaggttggccggtagggataatgccgccattggaacgcggcctttatgtcgggttctctcaagagtctaagatcgcaccctcaccatcggatggaatgatcccactcccatccacaccgctttgttttctttcgcttagccttgttgcgccgttctctaagccactcatntccttagatca

SEQ ID NO: 295 - DNA, 322 bp, Homo sapiens
  CDS 107..322
  sig_peptide 107..196: Von Heijne matrix score 4.09999990463257 seq XVTFCLDLSNVDS/GV
tcctgaggagtgctttacttccaactatgtgatcaattttggaataagtgctatgtggtgctgcgaagratgtatatctgttgatttggggtggagagttctgtagatgtgtattaggtctgcttggtgcagagctgagttcaattcctggatatcchtggtwactttctgtctcgatctgtctaatgttgacagtggggtgttaaagtctcccattattattgtgtgggagtctaagtctctttgtaggtctctaaggacttgctttatgaatctgggtgctcctgtattggatgcatacatatttagtatagttatctck

SEQ ID NO: 296 - DNA, 201 bp, Homo sapiens
  CDS 40..201
  sig_peptide 40..162: Von Heijne matrix score 4.09999990463257 seq GILILWIIRLLFS/KT
agcgcttgtgacccgccttccggaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtc

SEQ ID NO: 297 - DNA, 496 bp, Homo sapiens
  CDS 247..495
  sig_peptide 247..315: Von Heijne matrix score 4.09999990463257 seq PELLGSSSPPTSA/SQ
  misc_feature 245: n=a, g, c or t
cagatgtattccccttttcctttgtaaattgtcttggccctctgaatctaccttccaactgtctgtatccttggatattttacagacttcggcttttgctctgtgaccctaattttgtttaggttctacttggtgtgagcacattaatgttttttgttttattttgagcacatttaaaaactaattgtggaggaaaagtaataaaaaatgagattttaaacattattattattattattattagngatgaggtctcactatgttgcccaggctggtcctgaactcctgggctcaagcagtcctcccacctcggcctcccaaaatgctgggattacaggcatgagtcactgcacctgtcctattattatttttgagacagggccttgctctgtcacccagactggggtgcagtggtgtggtcgtggctcactgcagccccaagctcctggacttgagccatcctccagcctcagcctcttgagtggctggggtcaca

SEQ ID NO: 298 - DNA, 492 bp, Homo sapiens
  CDS 220..492
  sig_peptide 220..267: Von Heijne matrix score 4.09999990463257 seq LACVRESTSVAWA/CK
ttagggggcctgtcacccagcacgtgcatcgggggctgtcccgggggtcaggggagggaggccagcgggcgwcggggtccgcccgaccccatccacgaccccgactcctatccgatcctatccccggccccgctcgggcctttccccttgcgccctggctcggctggctcgacgagcagtaagttcgtagccgccctccgaagccgggcgtagcatgggatggcagagttggcgtgcgtgcgtgagtccaccagtgtggcatgggcatgtaaggtgcgcggagggactgcaccttctccatcaggtgcagaaggccacgtcatgctgaacaagagccgagaagtagaatcgccagtgtcaagccgtccacgttgtggatgcccactgttcccccaggatcactcaagaccctgtgacttgtggtcactgatgagtggaccaagtgaagtccacaagatggctgctgtggctccaggcatcacgtccacatgc

SEQ ID NO: 299 - DNA, 478 bp, Homo sapiens
  CDS 267..476
  sig_peptide 267..446: Von Heijne matrix score 4.09999990463257 seq CGCLVFKIPSCFA/ES
  misc_feature 84..86: n=a, g, c or t
tacatgttttctagtaacctggtttttcttttcacattcaggccatcaaactccaaaccatcacgcaaccagactggagcctcnnncaataaccttttttgccaggaaccctttcataggcccctgagggagatcagactgctgttttctgaaaacagtaccctctgtcagcaggaagcagttaagattggtcttcatccttatctttattctaacggcagttagatgtacttctttaggtgcaaaatgatagatgcaggaggcagatgagggaacctacccagggcattgtatgtgtatgcctgcaatggactagggacccacctgcacactggaagggtggggtggagccactggaacatttacactttgcgcagaagggaggagcctggcatcttcagttcctgtgtggttgcctggtgttcaagattccctcttgctttgctgagagttgtttttccttttcacccaataaatt

SEQ ID NO: 300 - DNA, 248 bp, Homo sapiens
  CDS 9..248
  sig_peptide 9..53: Von Heijne matrix score 4.09999990463257 seq VLSPHLSLLPTFP/QE
aaaattcgatgaatgttctgagtccacatctctctcttctccccaccttcccccaggagcgctatgaagcagccatccaacggtcagtgaagaagacgtgggccgaaatccggcagcagcgctggtcctgggcaggggccctgcaccacagctctccaggacataagaccaatcgcagcctgcagctgarcgcatgggagagcagcatcgtggatcgtctgatgamgcccactctctccttccttggt

SEQ ID NO: 301 - DNA, 489 bp, Homo sapiens
  CDS 221..487
  sig_peptide 221..313: Von Heijne matrix score 4.09999990463257 seq VFKLVLLGSGSVG/KS
agtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagagtaccacagcgtctgccacctctacttcagggtg

SEQ ID NO: 302 - DNA, 483 bp, Homo sapiens
  CDS 170..481
  sig_peptide 170..226: Von Heijne matrix score 4.09999990463257 seq LLLGQRCSLKVSG/QE
attgtgacatcaccgtgcactagccaatggctgcctgcctaagctgggtccctggtctcctgggactactagccctttgttgatagggagaagccaacatctcccgcagaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccaca

SEQ ID NO: 303 - DNA, 496 bp, Homo sapiens
  CDS 264..494
  sig_peptide 264..371: Von Heijne matrix score 4.09999990463257 seq GVFWSLFLGWIWL/QL
atcgcgactaaacggagtgcggcggcatttcctggtgtctgagcctggcgcggaggctatgggcagccaggaggtgctgggccacgcggccggctgkcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcaccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatat

SEQ ID NO: 304 - DNA, 622 bp, Homo sapiens
  CDS 233..622
  sig_peptide 233..562: Von Heijne matrix score 4 seq WGALLHHPPFALG/VC
attttgaaaatctgacatcagctgggcagtcgcccccctcctcctttcctccctctactctgacacagcacttagcacctgaawtcttcgtttctctcccagggaccctccattttccatatccaggaaaatgtgatgcgccacaggtatcagcgtctggatcgccacttcacgtttatagccacaagtgactcagtggaagatccagagtcaacagaggctcgtcaggaagatgtctacagaaaaggtagaccaaaaggagaraagctggggaaaaagaggtgtgcggagaccagatcaaaaggaccggacaaagaggaggaaccaccgggytgctgcatcccatggccaggggtggcgtccaggtggcagagcagctaggaacgcaaggcctgaaacctgggggccagacaccctgctctcccggcccatggtcaacgaccctccagtacctgcctttactgtgggcccagtagggtgggccaagtcttggcaggccgtgcccgcagctgctgctgcagtttggggtgctcttctgcaccatcctccttttgctctgggtgtctgtcttcctctattggctccttctactattcctatatscgacagtcagccacctcag

SEQ ID NO: 305 - DNA, 522 bp, Homo sapiens
  CDS 74..520
  sig_peptide 74..484: Von Heijne matrix score 4 seq FLQSQLSVPEIEA/CV
gatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccarggccgaagtaccatgactgtgtctgatgc

SEQ ID NO: 306 - DNA, 500 bp, Homo sapiens
  CDS 109..498
  sig_peptide 109..465: Von Heijne matrix score 4 seq YTILLIQLLVTLA/VV
agtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaa

SEQ ID NO: 307 - DNA, 487 bp, Homo sapiens
  CDS 38..487
  sig_peptide 38..166: Von Heijne matrix score 4 seq AAWCSLVLSFCRL/HK
cttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagcactctactgc

SEQ ID NO: 308 - DNA, 495 bp, Homo sapiens
  CDS 28..495
  sig_peptide 28..156: Von Heijne matrix score 4 seq AAWCSLVLSFCRL/HK
agcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagsttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatgaggaagacacagaggatgaggagttccacgggctggatgaagccactctactgcgggctctgcaggcctac

SEQ ID NO: 309 - DNA, 483 bp, Homo sapiens
  CDS 28..483
  sig_peptide 28..69: Von Heijne matrix score 4 seq RSLHLMSFILTGA/AR
  misc_feature 263: n=a, g, c or t
aatcacaatttgttgaatctcaggtaaatgaggtctttgcatttaatgagttttatcttgacaggcgccgctcgcccccgggccctttcgtccacagcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgsyccagcgacgcgncccgsggggacgtcgctgtccgtcctgctcgccctgtgccctctcactgacttctcccgggtcgtgtcttttaaaaactcctgttttcacaccttacaaagccagctctgagcagacaggacgtcctctcgtagaacctgcgcacccgttccagcgcatggcgcccgggcgcgagcttagcttagaccgtggtgtcctctgtccgtctgtcctgcgcctg

SEQ ID NO: 310 - DNA, 467 bp, Homo sapiens
  CDS 142..465
  sig_peptide 142..231: Von Heijne matrix score 4 seq RGPFLMSVATVAA/AP
  misc_feature 43,78: n=a, g, c or t
aggcctcttgcaggagagtccctggtcccagccagcgggaggncttctccagtttgtggctctcggagagttcgmmrnrtccctccctctcagataaccacctatttctgacctctggaggccgggctgagccsaaattttatgaccagcgcccgctggccgtcgtcaccctctaatttctcgcaaaactcccggggacccttcttaatgtcagtagccacagtcgccgccgctcctgcgcctagaagccttccacgaccctcaaccccacagagccccgagcaggctcgggttcccgcagatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctag

SEQ ID NO: 311 - DNA, 435 bp, Homo sapiens
  CDS 201..434
  sig_peptide 201..404: Von Heijne matrix score 4 seq SGXXADAVXPALC/QR
  misc_feature 76: n=a, g, c or t
ctctttctcgactccatcttcgcggtastgggaccgccgttcagtcgccaatatacagctctttgtccgcgcccangagctacacaccttcgaggtgaccggccaggaaacggtcgcccagatcaaggctcatgtagcctcactggagggcattgcccggaagatcaagtcgtgctcctggcaggckgcgcccctggaggatgaggccactctgggccatgtgcggggtggaggccctgactaccctggaagtagcaggccgcatgcttggaggtaaagtccatggttccctggcccgtgctggaaaagtgagaggtcagactcctaaggtggccaaacaggagawtgaagaagaagaagacaggtcgggctdakcggcggatgcagtacawccggcgctttgtcaacgttgtgcccacctttggcaaagaagaa

SEQ ID NO: 312 - DNA, 493 bp, Homo sapiens
  CDS 339..491
  sig_peptide 339..464: Von Heijne matrix score 4 seq TSPSILFVPATLA/SP
aagttctaaacagctgagttttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagttacagatgatgtggtgcagaagcatagcaagtctaagaagaaacagtagtcatcattgtgaccattgtaatggccctttgcagtttaccagtacatccccaagcatcttatttgtccctgctacattggcctctccgactccaatgcccctggttaaatc

SEQ ID NO: 313 - DNA, 570 bp, Homo sapiens
  CDS 180..569
  sig_peptide 180..383: Von Heijne matrix score 4 seq LSITILLLNFLRS/HC
aataggtccggttccgggggcgcgtggctgcagcggggcccgcgtggtgcctcctgaggcggcccccggatgaagagatctgggaaccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctggkcctcgcrctcctgggactgggcgtcgtgctcgtgctctccagcttctttgcactggggttcgctggaactttcctaggtgattacttcgggatcctcaaggaggcgagagtga

SEQ ID NO: 314 - DNA, 386 bp, Homo sapiens
  CDS 99..386
  sig_peptide 99..371: Von Heijne matrix score 4 seq LWSITQFFTEIAA/AS
aaatatcatagacacagaagttacatatgcttttattaagagttaatgatttaaaaaataacctaatgatatgagtgctaaatttgtaaataattgaaatgagtcactttcttctggtaacaccttcctgggatgaccaaataggaacagctctggtctggagctcccagcgtgcccgacacagaagacgggtgatttctgcattttcacagaggtacctggttcatctcattgggactggttggacagtgggtgcagcccacagaggttattcctttgtagttgtgatccagcatggatgtggtgtggttgtatcagtgactgcaggtagtctgtggagcattacacagttctttacggaaatagcagctgcaagtgaccaggac

SEQ ID NO: 315 - DNA, 482 bp, Homo sapiens
  CDS 323..481
  sig_peptide 323..373: Von Heijne matrix score 4 seq VVSWLQSTLVADA/VN
cataaggctatagctgccatagatagtgattcctctgatggagctgggcaaagtaaacagaaaacctctggaaaggattcagcattccagatgccattaagaacattcaggatccgtgggaggagatcaaaatatcaacattaacaggagtttggaaaaagtgaattccaaccctcttggatgactctgaggaattcgagacttgagtaaaggaagtcatgcagatgtacagcaagagaatgagaagtggagcctgaagatgtaactgaactgctgcaatctcatgatcacacttgaatggatgaggagtcgcttcttataaatgagcaaaaaagtggtttcttggctgcaatcaactcttgttgcagatgctgtgaacactgttgaaatgacaaaggatttagaatattacgtaaacatagttgataaagcagcagcagggtttaagaggattgactcctattttgaaatgagttcggctg

SEQ ID NO: 316 - DNA, 478 bp, Homo sapiens
  CDS 171..476
  sig_peptide 171..395: Von Heijne matrix score 4 seq ALAPAXVCAQSSS/SN
  misc_feature 463: n=a, g, c or t
aacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggcttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgsgtctgtgctcaaagcagcagctccaaccctgcstctgtccccttccccacccactgcctgagccttctgagcagaccaggtaccttggntgaaccggtgtgtgg

SEQ ID NO: 317 - DNA, 460 bp, Homo sapiens
  CDS 66..458
  sig_peptide 66..437: Von Heijne matrix score 4 seq QSLALLLMTLGQQ/DV
agagtgtgtggtctcattgaagagcaagaacaaaatgtgcatatgtgaagagagatgtatgcagaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctagg

SEQ ID NO: 318 - DNA, 557 bp, Homo sapiens
  CDS 67..555
  sig_peptide 67..231: Von Heijne matrix score 3.90000009536743 seq LPRGLSLSSLGSA/RT
aatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagaktgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgaatgttggagacacagtcgcgatgctgcccaagtcccggcgagccctaactatccaggagatcgctgcgctggccaggtcctccctgcatggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgarggcgaacaaga

SEQ ID NO: 319 - DNA, 587 bp, Homo sapiens
  CDS 92..586
  sig_peptide 92..130: Von Heijne matrix score 3.90000009536743 seq MLYLQGWSMPAVA/EV
atagactttatcatacttcgtagcatccagtatgttttctttgctaagattattgattttgtattgaagggtcccatgtccatcgttttcaatgctttatctccagggttggagcatgcctgctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatga

SEQ ID NO: 320 - DNA, 489 bp, Homo sapiens
  CDS 304..489
  sig_peptide 304..477: Von Heijne matrix score 3.90000009536743 seq LTLRRCTSSVSGA/AE
gcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaarrrgcacggcattccmatggscacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatcctattatgggratgactctgactttgagacggtgtaccagcagtgtgtcaggtgctgcagagcgttct

SEQ ID NO: 321 - DNA, 475 bp, Homo sapiens
  CDS 303..473
  sig_peptide 303..371: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgaccactgtgcctagcctgagccaccacgccggcctaatttttaaattttttgtagagacagggtctcattatgttgc

SEQ ID NO: 322 - DNA, 462 bp, Homo sapiens
  CDS 304..462
  sig_peptide 304..372: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcgatggctaattttttgtactttcagtggagatggggttttgccatgttggccaggctgttctcgaactcctgagctcgggtgatccaactgtctcggcctcccaaggtgctgggattacaggcgtgassvamctggtgcctagcctgagccaccacgccggcctaatttttaaattttttgtagagaca

SEQ ID NO: 323 - DNA, 474 bp, Homo sapiens
  CDS 302..472
  sig_peptide 302..370: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasacctgtgcctagcctgagccaccacgcsggcctaatttttaaattttttgtagagacaggggtytcattatgttg

SEQ ID NO: 324 - DNA, 496 bp, Homo sapiens
  CDS 242..496
  sig_peptide 242..439: Von Heijne matrix score 3.90000009536743 seq LTLSFADVGPAAS/HS
aaggatgtgctctttcccaaggagagggagctctgttgcctccttcccacagaatcactctgtgcaaacctcttcccctccttggccccagtctccccaattctaaaatcggatactggataaaatgccacggaagaacctagggatgcaccaggaaccacgcgcctgaatgccacaggtttgatttgattcatgaccctcatctggacacaagctctaaaatacttgagccttggcagaaatggctgatagagtccacagaacacgctgtcctcatctcagagaggagaactctgaacccagagggaaggatttacctgcagttgtatggcaagccagaggtaggcgctgcactggaacgcagcctaaccagcctaaagaaaccatgggaggagaggctcttaccctctcctttgcagatgtgggcccggctgcctcacactccagagcagatgggccacaggcttataggtcccaaggaagcttcacttcatgt

SEQ ID NO: 325 - DNA, 520 bp, Homo sapiens
  CDS 355..519
  sig_peptide 355..408: Von Heijne matrix score 3.90000009536743 seq CSLHLLGSGDSHA/SV
tagtcaacacaggataaactaatcaggagtgccaggtttggagggaggtaggccctattaagaaggtggcatcacacttgggagaaggtgaggaaattagctacatagaccctggcaaaggcccgcaggtgacaatatgtttgatgagttaaaggacagcagagactactgcagctgggatcaatgaggaagagagttgtacaaggtgtggtcagaggggaactgtgagacctcttgggaccattggtaggctttagcttttactctgagtgacatagggagccattgcaggggttagtttttctgtgtttgagacggagccttgctgtgtcgcccaggctggagtgcagtggcatgatcttggctcactgcagcctccacctcctaggttcgggtgattctcatgcctcagtctcccgagtacctgggaccacaggtgtgcaccgccatgcccggctactttttgtatttttagtagagacggagttttgccacgttggccaggctggtcttggactcc

SEQ ID NO: 326 - DNA, 480 bp, Homo sapiens
  CDS 303..479
  sig_peptide 303..371: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccakgcctggctaattttttgtactttcagtggagatggggttttgccatgttggccaggctgttctcgaactcctgagctcgggtgatccaactgtctcggcctcccaaggtgctgggattacaggcgtgacamctgtgsctagcctgasccaccacgccggcctaatttttaaattttttgtagagacagggctcattatgttgccagggt

SEQ ID NO: 327 - DNA, 292 bp, Homo sapiens
  CDS 136..291
  sig_peptide 136..225: Von Heijne matrix score 3.90000009536743 seq VLPTAPAPACATA/ST
  misc_feature 31: n=a, g, c or t
avgcagccccggccggaggagagcgccgcgntgcacgggggcgtcttctggagccgcggcctggaggagcaggtgcccccgggcttttcggargcccaggcggcggcgtggctggargcggctcgcggcgcccggatggtggccctggagcrcgggggttkcgggcgcactccaaccgactggcccgttttgccgacggcacccgcgcctgcgtgcgctacggcatcaacccggagcagattcarggcgaggccctgtcttactatctrgmgcrcctgctgggcctccagcg

SEQ ID NO: 328 - DNA, 515 bp, Homo sapiens
  CDS 320..514
  sig_peptide 320..505: Von Heijne matrix score 3.90000009536743 seq APLSSLRLPPCTG/VY
agcgcacgcctgctaggatcagcggtggtggttccgcgatggtaggcggcggcggggtcggcggcggctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcaggtaagtgtggactggtggtgagggtgttggcccgggcacccctaagcagtctgaggcttcccccttgcacaggagtctatgggc

SEQ ID NO: 329 - DNA, 513 bp, Homo sapiens
  CDS 303..512
  sig_peptide 303..371: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacamctgtgcctagcctgagccaccacgccggcctaatttttaaattttttgtagagacagggtctcattatgttgcccagggtggtgtcaagctccaggtctcaagtgatccac

SEQ ID NO: 330 - DNA, 543 bp, Homo sapiens
  CDS 224..541
  sig_peptide 224..301: Von Heijne matrix score 3.90000009536743 seq FMSIIVLVIVVIC/LM
agagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggyctcrgtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaa

SEQ ID NO: 331 - DNA, 475 bp, Homo sapiens
  CDS 303..473
  sig_peptide 303..371: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacaactgtgcctagcctgagccaccacgccggcctaatttttaaattttttgtagagacagggtctcattatgttgc

SEQ ID NO: 332 - DNA, 495 bp, Homo sapiens
  CDS 303..494
  sig_peptide 303..371: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgacacctgtgcctagcctgagccaccacgccggcctaatttttaaattttttgtagagacagggtctcattatgttgcccagggtggtgtcaagctcc

SEQ ID NO: 333 - DNA, 496 bp, Homo sapiens
  CDS 272..496
  sig_peptide 272..421: Von Heijne matrix score 3.90000009536743 seq HLTTVLYLQLAIC/SS
  misc_feature 70: n=a, g, c or t
agatggattccgggtgctggttgttcggcggcgagttcgaggactcggtgttcgaggagaggccggagcngcggtcaggaccgccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccaccgtactctacctccagcttgctatttgttcaagtttgcagaacttggagaaaacaattttctgcctgcagaaactgatttctttgcatccttttaatccttgg

SEQ ID NO: 334 - DNA, 461 bp, Homo sapiens
  CDS 174..461
  sig_peptide 174..281: Von Heijne matrix score 3.90000009536743 seq LNYALRCVHSVQA/NS
  misc_feature 436: n=a, g, c or t
cgagatgccccgcggggaagctcctggccccgggagacggggggctaaggacgaggccctgggcgaagaatcgggggaaccggtggagcccsgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggtnagtgcacatttctgaacaggctgct

SEQ ID NO: 335 - DNA, 475 bp, Homo sapiens
  CDS 303..473
  sig_peptide 303..371: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctgagctcgggtgatccaactgtctcggcctcccaaggtgctgggattacaggcgtgasaacttgttrmcctagcctgagccaccacgccggcctaatttttaaattttttgtagagacagggtctcattatgt

SEQ ID NO: 336 - DNA, 472 bp, Homo sapiens
  CDS 319..471
  sig_peptide 319..384: Von Heijne matrix score 3.79999995231628 seq FAPKLLLHCPVQS/EC
taattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaa

SEQ ID NO: 337 - DNA, 638 bp, Homo sapiens
  CDS 279..638
  sig_peptide 279..569: Von Heijne matrix score 3.79999995231628 seq ATCSLVVWISSFT/HY
  misc_feature 25: n=a, g, c or t
gcagtcgttgcctcctcctcccctncctcctcctccccttcctcctcctggccgcttagtctcacacccgccgggccgttgttccgagacgttgttgagtcccctgtgtcctcttctgggagctagataagggcctggttccacttctcagtattcagggaatggattccctgcttactcccttccttcctttggatgccacaaaatgagcacttgactgaaaatatgcttatacgcgtttttacagactacgccaagccacaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaagtgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgtttggataagcagtttcacccattaccagtcamcaggaagggattcsatcgaaacgtcatcatgtggctggacatcgagcagtcagtca

SEQ ID NO: 338 - DNA, 562 bp, Homo sapiens
  CDS 292..561
  sig_peptide 292..489: Von Heijne matrix score 3.79999995231628 seq LWLDSCVVPPLSP/PP
tttttcgwcgactcttaccggttggctgggccagctgcgccgcggctcacagctgacgatgggggacccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaa

SEQ ID NO: 339 - DNA, 429 bp, Homo sapiens
  CDS 180..428
  sig_peptide 180..335: Von Heijne matrix score 3.79999995231628 seq WPTASGWTPAARA/CG
aagagcgtgagtgccgctgacagaagtcaagagaatcggctgggacggggttggggcgacaacgggccgggggggaccgacaggccagagccccttggggaggagcagcggctggaggcgcgaggctcctccggatgsccggagagccgsttgcgacttaactcccgcctctttcccagatgccgcgtcactgstccgscgccggctgctgcacacgggacacgcgcgagacgcaacccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggct

SEQ ID NO: 340 - DNA, 511 bp, Homo sapiens
  CDS 30..509
  sig_peptide 30..230: Von Heijne matrix score 3.79999995231628 seq SLPLAVFYGPLDA/KN
wwmyccmagssgggccgggscgcgtcaatatggcggcgcagggctcaccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaagaatacaaactggcccttttacaatgctatggaagatatcttcagcagttcaataccaa

SEQ ID NO: 341 - DNA, 487 bp, Homo sapiens
  CDS 116..487
  sig_peptide 116..421: Von Heijne matrix score 3.79999995231628 seq LVCLARVVPRIKG/LX
actgttcttcgcggggaccscttgctgatcggcatctttgtgctgctgtggtgtctttaccgccgggcagctagacagcggcccttcgcacatcaccggcttccggacgacggagatgaaccggttctgcatttggacgccccgaaagacccctacgacctctacttttatgctccggatacctgggtcccttcccacatcgccaccaagcagcccccgcccacacctcctctgccaccaaagctgcccccgccgccccgcggggktcgcccgcagcgtctggaggccctgtcccccgccacgctccccaacaacttcgtgtgagccccaccgagttctgccggacctgcacatccccacagtgaaggaaaaccctgcgcttctggtatgcttagctagagtagtgccccggataaagggtctaatrtacagagatgcttgcgctgtgatcagagaacaaggtctgagaccgaataaatatcatgtt

SEQ ID NO: 342 - DNA, 460 bp, Homo sapiens
  CDS 68..460
  sig_peptide 68..304: Von Heijne matrix score 3.79999995231628 seq LGLQCDAVNLAFG/RR
atttttcctccggaagtgcggatcccagcggcggtcgtgtagctgagcagscctggggcttggttctatgtccctgtggctatgtttccagtgtcctctgggtgtttccaagagcaacaagaaacgaataaatctctgcgcctccaccccrgagaccyggaccaagttcacrcaggacaatctgtgccgykcccagcgcragcmcctggactcggccaacctgtgggtkctkgtggactgcatcyttcgcgacacctccgaggacctgggactccagtgtgacgcygtgaacctggccttcgggcgccgctgtgaggarctggaggacrcgcggcacaagctgcagcaccacctgcacaagatgctgcgggaaatcacagatcagaaacaacgtggyggcactgaaggaggccatcaaggacaaggaggmacctctgcacatagcccagacccttctgta

SEQ ID NO: 343 - DNA, 452 bp, Homo sapiens
  CDS 1..450
  sig_peptide 1..159: Von Heijne matrix score 3.79999995231628 seq CILLYVVFQKLSA/RL
atggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacg

SEQ ID NO: 344 - DNA, 478 bp, Homo sapiens
  CDS 86..478
  sig_peptide 86..136: Von Heijne matrix score 3.79999995231628 seq GFVAALVAGGVAG/VS
ctcaaacatggcggcgccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttartaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatc

SEQ ID NO: 345 - DNA, 472 bp, Homo sapiens
  CDS 152..472
  sig_peptide 152..217: Von Heijne matrix score 3.79999995231628 seq SIILSCSVPDTLP/NG
attcaggcagagcaagctccaggtttcaccacaatgcccatccctgcctccccactccacccacctttgccttccttactgctgtatctgctgcttgaactggcagcttttttccaggagtcacacatgtgttccatgtgcamaaacggagatgtcacagactgtatcaactggggagtcaatcatcttgagttgcagcgtacccgataccttaccaaatggacctgtcttgtggttcaagggaacagggccaaaccggaaattaatctacaatttcaaacaaggtaactttcccagagtaaaagagattggagacaccaccaagcctggcaacacagacttttscacccgcatccgtgaaatctctcttgctgatgctggcacctattactgcgtgaagttcataaaaggaagagctatcaaggagtaccaatcaggtcggggcactcaggtgtttgttactgagcagaat

SEQ ID NO: 346 - DNA, 537 bp, Homo sapiens
  CDS 197..535
  sig_peptide 197..304: Von Heijne matrix score 3.79999995231628 seq WLGCIVFPFSALL/QQ
cctttttaaacaatatccattctcttgatgtctacaatatcacctttcttatagattcgcatatacatggccaaaggaacaactccatgttttctaaaaggcctagagaacatacatcagctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagattagtggaacatttcaagtaactattccaccagttttgctcgggtatacttggagtaatacttatgtatttcctaaagaagattccaatgagcagaatttaaaagaatgtacattcttaaatatttttgctaccattgaacctcaaatatcatatgtcacctgtaatccaacactagataagtttttagatcaaacagaggtcttgcagagagcacagat

SEQ ID NO: 347 - DNA, 488 bp, Homo sapiens
  CDS 22..486
  sig_peptide 22..384: Von Heijne matrix score 3.79999995231628 seq SLATLPFLSTVVT/DK
aaagtcacatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagttttgtggtgttttctatc

SEQ ID NO: 348 - DNA, 470 bp, Homo sapiens
  CDS 51..470
  sig_peptide 51..425: Von Heijne matrix score 3.70000004768372 seq SVYLDLTLDMALG/KR
aatttcgtgaacgcaatccggagtgcccaacatggcggcggcgtaagtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagagaaaaacgtggagccatttaccagtgttcttagtttgccat

SEQ ID NO: 349 - DNA, 564 bp, Homo sapiens
  CDS 15..563
  sig_peptide 15..272: Von Heijne matrix score 3.70000004768372 seq WAVVLADTAVTSG/RH
atccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccag

SEQ ID NO: 350 - DNA, 494 bp, Homo sapiens
  CDS 199..492
  sig_peptide 199..243: Von Heijne matrix score 3.70000004768372 seq LGFFSPVPGSTSS/AT
ctcttgtcagagtcggagctacagtcagtgccttcagctctgagctcaggcataccggtccctgtttttgcagttaaggactctaaagtgttgtgacgtgttcatcaagtttttctcaaccataagttaacaattccagtaattgtcatctctcagtcctgattaaacctaattgatttcactagtttttgacccatcatgtgtttgggtttcttctccccagtccctggctctacctcttctgccacaaacgtcagcatggtggtatctgccgaccctttgtccagcgagagggcagagatgaacatcctagaaatcaaccaggaattgcgctcccagctggcagagagcaatcagcagttccgagacctcaaagagaaattccttatatctcaagctactgcstactccctggccaaccagctgaagaaatacaaaaagcaaaatgatcttgaagaggtgaaaggacaagaaacagttgctcccaggctcag

SEQ ID NO: 351 - DNA, 520 bp, Homo sapiens
  CDS 251..520
  sig_peptide 251..295: Von Heijne matrix score 3.70000004768372 seq LLMFTQLLLCGFL/YV
aggaagccagagggctggaaatacagcagcctttgaagtaccctctgttaatttggatggatctcagtgtgccccgttcgagacctctccaccaacaccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatcccccggtcccacaggatgcttctgccagcggatcctta

SEQ ID NO: 352 - DNA, 490 bp, Homo sapiens
  CDS 28..489
  sig_peptide 28..81: Von Heijne matrix score 3.70000004768372 seq AAAAVMAPPGCPG/SC
gcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattg

SEQ ID NO: 353 - DNA, 491 bp, Homo sapiens
  CDS 164..490
  sig_peptide 164..364: Von Heijne matrix score 3.70000004768372 seq TAALFLLMTVVTS/SL
  misc_feature 173,175,289: n=a, g, c or t
attccataccattctccctactctcccggactctccctccctccctaatcttctcgtccgtcgtctcccatggaacggctcatctccacgcccgccgcctccccgacccaaacccgtatccggggacccctttccctcccctctcggctcccagcggccgcgcatggccsscntngcgctgccggcccggcgcgatcgcstggcgtcgccgctgcgccacgaggctctctccgccgcaccggaggaggcgccgagccagccgccgccaccggctgccgtcggcachcgntgggagcttctcgggagtctgctcccaaaggcttgcaccgctgcmcttttcctattgatgacagttgttactagttccctgcactctagccttcctgcatatgcatcgatgcaaccagttgcsaaaactggtggaggaggaggtctcttcacgacagagatactaagcagtggctgggctggttttttagctgggtgcttac

SEQ ID NO: 354 - DNA, 363 bp, Homo sapiens
  CDS 76..363
  sig_peptide 76..288: Von Heijne matrix score 3.70000004768372 seq TRSLQLLSGPCLA/HH
aatatagccagccgcggctgcccttgcgcttcccgagctggcggggtccgtggtgcgggatcgagattgcgggctatggcgccgaagtttttcgtcagtactgggatatccccgatggsaccgattgccaccgcaaagcctacagcaccaccagtattgccagcgtcgcygcttagascgccgctgcctacagagtcacactcaatcctccgggcaccttccttgaaggagtggctaaggttggacaatacacgttcactgcagctgctgtcggggccgtgtttggctcaccacctgcatcagcgcccatgtccgcgagaagcccgacgaccccctgaactacttcctcggtggctgcgcgga

SEQ ID NO: 355 - DNA, 234 bp, Homo sapiens
  CDS 23..232
  sig_peptide 23..136: Von Heijne matrix score 3.70000004768372 seq LVSGSLLPFGGVC/VX
gaggtactgagacagggtgctgatgggaaggaggggagcctttggggggccacccggggcctggacctatgcagggaggccacgtcccaccccacctcttgtttctgggtccctgctcccctttgggggtgtgtgtgtgysttwyaattttctttatggaaaaattgacaaaaaaaaaatmsagagagaggtatttaactgcaataaactggccccatgtggcccccgccttgb

SEQ ID NO: 356 - DNA, 522 bp, Homo sapiens
  CDS 206..520
  sig_peptide 206..439: Von Heijne matrix score 3.70000004768372 seq SGLGFGIMSGVFS/FV
atctcgcgtccccaacggcccccgggtcggtttccgcggtggccatgactgcggccgtgttcttcggctgcgcttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttccttttattcag

SEQ ID NO: 357 - DNA, 485 bp, Homo sapiens
  CDS 6..485
  sig_peptide 6..314: Von Heijne matrix score 3.70000004768372 seq ALLQLKAAQGARP/SG
tcacaatgcagcgcggcgcgctgtccccggtgctgatgctcagcgctgccccggagcctccgccgcgcccgcctcccgccctctccccaccgggctcgggcccaggctcgggctcccgccatggctcggctcgtcccggtcctaccccagagccgtcggggagcctgggcgcggcgctcgacagcagcctgcgtgccgccgtggcgttcaaggcagagggccagcgctgctatcgagagaagaagttccgggaggccatcggcaagtaccaccgagcgctgctgcagctgaaggcggcgcagggggcccgccctagcggvctgcccgcccccgcccccgggcccaccagcagccccgggccggcgcgcctcagcgaggagcagcggcgcctggtggagagcacggaggtggagtgttacgactccctcacggsttgcctgctgcagtcggagctggtaaactacgagcgcgtgcgcgagtactgt

SEQ ID NO: 358 - DNA, 470 bp, Homo sapiens
  CDS 250..468
  sig_peptide 250..339: Von Heijne matrix score 3.59999990463257 seq VIIFALSGHVLFA/KL
agttggaagccggaccccatagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctkgtgatgggcacaatgggcccttggtacctgctgctgctgcttggtcactgtgtggcctctatgt

SEQ ID NO: 359 - DNA, 332 bp, Homo sapiens
  CDS 42..332
  sig_peptide 42..101: Von Heijne matrix score 3.59999990463257 seq IPLNLXLHXGXXS/RE
aactaaagccgggagtccggtgaacgggcagaagcagggccatgcccagagccacccccaagatccccctgaacctgcasctccatcavggaascawttcmagggagcctccaggagcccagacaccagccccccascakggtaagtccttcaagggtgggatctggaagaggaaagaggagggacaccagccaggtggaggtgtcctaaaaatgaccatcagaaattggggtgaggggaggggcatggtggacttctgtgggggtggggtgtctctcagtgcagctcaggtgcctccagcatcccttaccagggagcaagctcccatctgt

SEQ ID NO: 360 - DNA, 413 bp, Homo sapiens
  CDS 117..413
  sig_peptide 117..194: Von Heijne matrix score 3.59999990463257 seq GTRALMVVSLVLG/FL
cttggacacctgggcgcccctggccctcggcagaacacggcgccggacagaagaggtccagcggttagtgggcgcggccggcggcacgaaggctggagccgcctgcatttccagcaatgacggcgccctttcccctcgcccgcagcggccttgcaggcactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgca

SEQ ID NO: 361 - DNA, 737 bp, Homo sapiens
  CDS 81..737
  sig_peptide 81..128: Von Heijne matrix score 3.59999990463257 seq FSLLSISGPPISS/SA
agaatgtttatcctctggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagtgctctcaccagrcwgcagcttgggggacacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccagatggcacccagcacagcagaatggctacaagtgcgtggcctgtgccgcatgtaccccaccctggacttcctcaagagccacatcaagaggggcttcagggagggcttcagctgcaaggtgtactaccgcaagctca

SEQ ID NO: 362 - DNA, 470 bp, Homo sapiens
  CDS 110..469
  sig_peptide 110..208: Von Heijne matrix score 3.59999990463257 seq LVPHSPLPGALSS/AP
tcttgtcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagcagggtgtcatcacagcgggctactcctagggataagcccccggtcccctcatccctggccagtgtccctgacccccatctactccttmctggggacttctcagcgccasccattggcgsctgsgttgccagcatccaggccctgcggcaggccctgtgctagcg

SEQ ID NO: 363 - DNA, 451 bp, Homo sapiens
  CDS 271..450
  sig_peptide 271..438: Von Heijne matrix score 3.59999990463257 seq SCLXSPALWGGRG/RW
  misc_feature 371: n=a, g, c or t
aattttatgtacattagaaaaaaaatatatccttagcttatccatccgatgggttcacggacattattgcttaggatgacactaaaatagatattaagttttaaaaaaagtcatctgtaacttgcctcagtgtctagaagggtacccagcacataggtgctcaacaaatattttgttgaagaaatgaatataatttaaaaatatgaaataagtaatagtatgggagatacatagatatttcataataacaactatcaaggttgtaggataatgataaatttgatgataagtttaacgctgataagtttgagaaatagcattcttaacacccttgtcttcagacaagaaaaccaagtctctcagaaaggaanarcttgcctcagggctgggtgtgatgcctcatgcctgtmatccccagcactttggggaggccgaggcaggtggatcactt

SEQ ID NO: 364 - DNA, 488 bp, Homo sapiens
  CDS 79..486
  sig_peptide 79..201: Von Heijne matrix score 3.59999990463257 seq LHTSVTLFLLSYC/DC
agatgattccctgattctccagagagattacacacttcgtttgtggctaaggttactgtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaagacttgcttg

SEQ ID NO: 365 - DNA, 597 bp, Homo sapiens
  CDS 432..596
  sig_peptide 432..566: Von Heijne matrix score 3.59999990463257 seq SAMFSCHLGQITS/LN
acttccgccgccgstccgccgcctccggaactaaacgcggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtactctgggtcagacctctgaagacttctcagatggatcctagtctctgggcttgcctgaaattactcgctgctcagggagagagttgaaatggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtgagcttagagagcacagcactgggatgtgaagacatgggttcaaattgcacctctgccatgttcagctgtcaccttgggcaaattacttctctgaaccttagttttctcatcattaaatggg

SEQ ID NO: 366 - DNA, 455 bp, Homo sapiens
  CDS 250..453
  sig_peptide 250..339: Von Heijne matrix score 3.59999990463257 seq VIIFALSGHVLFA/KL
agttggaagccggacsccatagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggctcctkgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactg

SEQ ID NO: 367 - DNA, 494 bp, Homo sapiens
  CDS 21..494
  sig_peptide 21..107: Von Heijne matrix score 3.59999990463257 seq FPLYLLNFLGLWS/WI
gtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgc

SEQ ID NO: 368 - DNA, 412 bp, Homo sapiens
  CDS 229..411
  sig_peptide 229..336: Von Heijne matrix score 3.59999990463257 seq VKLCLSCLCSLHS/PP
atcccctcgaccgctcgcgtcgcatttggccgcctccctaccggtgagttctctccaggagccctggatactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgt

SEQ ID NO: 369 - DNA, 482 bp, Homo sapiens
  CDS 243..482
  sig_peptide 243..302: Von Heijne matrix score 3.59999990463257 seq HKLLALYKSLARS/IP
agtgtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtwtwtcgtatgttctccaaa

SEQ ID NO: 370 - DNA, 513 bp, Homo sapiens
  CDS 277..513
  sig_peptide 277..399: Von Heijne matrix score 3.59999990463257 seq AGAGLPALDLAKA/QR
cccgcttagacaatgccccggagccgccagaccgtcgcgcccctgccccatcgtagtatatgagctcgcctacacaaggacccccgctaaaagccagagccccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggcc

SEQ ID NO: 371 - DNA, 437 bp, Homo sapiens
  CDS 62..436
  sig_peptide 62..103: Von Heijne matrix score 3.5 seq AVPAAAMGPLALG/QS
aggactgactgcgccgtggaggcttctgcagtgttgtgagttggaagctggggagctcggcatggcggtccccgctgcagccatggggcccttggcgttgggccagagcggccccggctcgatggccccgtggtgctcagtgagcagcggcccgtcgcgctacgtgcttgggatgcaggagctgttccggggccacagcaagacgcgcgagttcctggcgcacagcgcaagggtgcactcggtggcctggagttgcgacgggcgtcgcctagcctcgggggtccttcgacaagacggccagcgtcttcttgctggagaaggaccgggttggtcaaagaraacaattatcggggacatggggatagtgtggaccagctttgttggcatccaagtaatcctgacctatttgttacggcgtccggagataaaaccattcg

SEQ ID NO: 372 - DNA, 394 bp, Homo sapiens
  CDS 204..392
  sig_peptide 204..368: Von Heijne matrix score 3.5 seq HLLXLPSPQLTCP/IS
  misc_feature 274,339..340: n=a, g, c or t
ccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaaggcgcccgggagcccggtctctctgagctcagagccagaggagtggtgcccgccaatgcctgagagaagtcacctgacggagcccagctccagtggagggtgcctggtcaccccatcccgaagranaccccctctcccacaccttcctatggacagcagtccacagcsactcttacaccctcacctcctgnncctscccagcccccaactgacatgccccatctccatcagatgcccaggagggtg

SEQ ID NO: 373 - DNA, 474 bp, Homo sapiens
  CDS 276..473
  sig_peptide 276..335: Von Heijne matrix score 3.5 seq FLFEMESCSVAQA/GV
atcttgacccaggactgctactctcccaagcagtgagaaaaatccatttctgttgtttaagccactcagcctgtggcattttgttatggcagctccacagttctagtttgcccttccatttccttttgtgagtttctgaaccagacaacaccttgggaggtatattaaagggtttaacattttggataataaaagattcactcacttctattggagaagtgacgacgctgagtggacagaagtagaatgaaaaactcaacctgtgaagcaccctgatgtaccaaatgacttttttttttctttttgagatggagtcttgctctgttgcccaggctggagtgatcttggcttactgcaacctccgcctcccaggttcaagtgattctcatgcctcagcctcccgagtagctgggattacaggtgcgcgcccccacgcccggctgatgtttgtatttttagtagagacggggtttc

SEQ ID NO: 374 - DNA, 319 bp, Homo sapiens
  CDS 156..317
  sig_peptide 156..206: Von Heijne matrix score 3.5 seq WLTAVASLLPSPG/NS
atatacaggtggcagctctcgtcccctgagagcgggcgaaggccagggtcccacactcgcagcgctgcgacggcgstcgggacctccctcgtccactgcttgagttccagaggtgggtgcttccctgtcctgaacttcagagtgcggagtcataaatgggttccggctggcttactgcagtagcctcgctcctccccagccccggtaactccgagctacccgtccaggccctcgggcgtcgcgggggcagggactgggcgcggaacgaggcagggagggacctggaaaaaccacccagattgcattgcagtgggcgagg

SEQ ID NO: 375 - DNA, 429 bp, Homo sapiens
  CDS 265..429
  sig_peptide 265..387: Von Heijne matrix score 3.5 seq ALALVGLCHIVRX/XG
ttacttttaagtcacttttgggttcactagtggattaaccagaagtgattgtagttgagtccagttttgctttttaataatgtgttgaagttttagtttttactctttgttgactttgctgcttattggcaccakkkacagagtttctagatacaattttatggattggttttaatttttatgagtttgtctctgcagtgattcggtttctcagagtctcatggcatcatagtttttccagaatgacacagtagccacckgtggatgacagcscasktgktgksacagtcacttctgcctgttgctctgacaccaacccattgsagctctgctgtgggcttctcctgggctctggcattagttggtctgtgtcacattgtcagawyagktggctgctgtgtggtgccatcgagtcctgctggttcccct

SEQ ID NO: 376 - DNA, 524 bp, Homo sapiens
  CDS 100..522
  sig_peptide 100..198: Von Heijne matrix score 3.5 seq FLCLGMALCLRQA/TR
gtagagtgctgaaggtcctgccaacgstctcttggcgtctcaacgttcggatcagcagcttttttccattctctctctccacttcttcagtgagcagccatgagttggactgtgcctgttgtgcgggccagccagagaatgagctcggtgggagcgaatttcctatgcctggggatggccctgtgtctgcgtcaagcaacgcgcatcccgctcaacggcacctggctcttcacacccgtgagcaagatggcgactgtgaagagtgagcttattgagcgtttcacttccgagaagcccgttcatcacagtaaggtctccatcataggaactggatcggtgggcatggcctgcgctatcagcatcttrttaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgat

SEQ ID NO: 377 - DNA, 459 bp, Homo sapiens
  CDS 95..457
  sig_peptide 95..415: Von Heijne matrix score 3.5 seq LTAYDMTLAESYA/QY
aaggccgttccttcagtgttttcagacgccctgggaacgcggctgcagggtccggtcttcggtttgcacagctagaggccgcgcasagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcga

SEQ ID NO: 378 - DNA, 284 bp, Homo sapiens
  CDS 96..284
  sig_peptide 96..248: Von Heijne matrix score 3.5 seq SXFLXLEXPLATG/QG
  misc_feature 31,33,35,123,136,224,281: n=a, g, c or t
agtaccccagctgtgtccacctacctttctndntncackccccctttkacttccctccctcccctccccctttcccttgcccattcttcctccacatgacttctcctttcctcattgattttncagcccggtcgcnctcacccctcggaaaataccatagcgaccttgcstgcactcctgggtctccgccgccttgcaggaaaggattcagcsccttcctcaanctcgagstgcctctggcgaccgggcaaggttacagcgaccaccctgtccatactgcnggc

SEQ ID NO: 379 - DNA, 496 bp, Homo sapiens
  CDS 323..496
  sig_peptide 323..469: Von Heijne matrix score 3.5 seq FVLAASNLPCLKA/IX
agcttgtctgtgctgagagtatgcaggctgatgtgttggtaccaaacctcatccttgttccttgtttccttagtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgcttgaaagccatttgsactccagcctggcgacagagc

SEQ ID NO: 380 - DNA, 495 bp, Homo sapiens
  CDS 110..493
  sig_peptide 110..151: Von Heijne matrix score 3.5 seq LCLGALWDECCDC/VG
aattccatattgccaataagaagtctgatgccagtctgtttcttattctctataggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccrcaccaccagaatgtgtctgtccccagcaataatgttcacgcgccttattccagtgacaaaggtaactgccaacagttgactttttccattccgccccctcatgtggtctgtcgtgtaatctataaaacctatat

SEQ ID NO: 381 - DNA, 530 bp, Homo sapiens
  CDS 297..530
  sig_peptide 297..422: Von Heijne matrix score 3.5 seq VLYHLFMCHQGGS/AV
aaacactcagcccctccaagtctgtttcctcacctgcaaagtggggatcatggtctctacttcccagaccatcctgrgccatgataagtaaccagtgccaaaagccttttgcccagggcctgtctctggccaaggccaggccgccaactggatgacagcattacctggacctgtcttgccctgtcctgtgttgtgtctgaaccgtggtccccttgaggacgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctcmgtgctctatcacctctttatgtgccaccaagggggcagcgctgtgtacgcccggctcctcgccctggacatgtgtggggtctgccttgtcaacacccttgggscctgccatcatccactgcaccctggcctgcagcctggctgcgcc

SEQ ID NO: 382 - DNA, 300 bp, Homo sapiens
  CDS 15..299
  sig_peptide 15..293: Von Heijne matrix score 3.5 seq VPLXLXXFPSXFC/RT
cacttcagaactagatgtcctggaggatgttctgcaatgtgaagctctcggtccttgccactaggttgcagttccactgcttccaagctggcaatggcattcatggtgggctgaacatctccagtggcagatcccagaatgtyaratdccsamsacacgcggacttatctagcaccacctcttgggcatttssttgcaggaagcttaacaaagctagagaaatggattctaggarctcatatctgcaratkbckgtacctttakkaytgkgkscatttccatctsstttttgcagaactk

SEQ ID NO: 383 - DNA, 569 bp, Homo sapiens
  CDS 15..569
  sig_peptide 15..329: Von Heijne matrix score 3.5 seq LDRCVAFIGQARA/EG
ctctgggcgcggccatgttggaggctccgggcccgagtgatggctgcgagctcagcaaccccagcgccasagagtcagctgtgccgggcagatgctggaagtgcagccaggattgtatttcggtggggccgcggccgtcgcgascagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggcsgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatatgaagtggatacctctagtgcaatttataagcaatatcgtttacaaaag

SEQ ID NO: 384 - DNA, 480 bp, Homo sapiens
  CDS 153..479
  misc_feature 453: n=a, g, c or t
attcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaaggganaagacatacagacggttaatatcgatg

SEQ ID NO: 385 - DNA, 421 bp, Homo sapiens
  CDS 233..421
  misc_feature 59,366: n=a, g, c or t
tccgcggattgtgcacagttcttgaaggtgggaacagaagagaaggcccgggggggcgnggagggggtaccaggctctgcacagtacccaaggggcttctggcagcaggaaggaagctacacatcagagttggggacttgtgccctggggctgcctggcatctgggggcctcctcagagccagggctctttctggttgaggctgagactcactggtgtcatcaggcccctccatgaatgagacaaacaaaacacttgttgggccttcggagctccssagagcgkctgctgtgacccctggccaggcactgggctcgggcatggcctgtgctggtaggatttgtgctgggggctgtggtcctctcgntcctcattgcacttgctgccaaatgccacctctgccgccgataccatgccagcta

SEQ ID NO: 386 - DNA, 498 bp, Homo sapiens
  CDS 125..496
aaggatatragagacaaatttggactcaggagartcatcctggtwtcagtctaaagctcaggaaagcatccctgtgtccagacctaaacataaggtcccctccttctcccaggacagcaaggagatgccacctaaaaacaaagaaaaagggaagaaatctggggcacagaagaagaaaaagaactggggtgcagatgtggtggccgagtccaggcacaggctggtggtgctggagaaggagctgctccgagaccacttggagatgagtcgccagtgccatgccctgcaggaggatatgcaaacccgcagcaagcagctggaggaagaagtcaaaggccttcgggggcagctagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacag

SEQ ID NO: 387 - DNA, 497 bp, Homo sapiens
  CDS 290..496
acacagccaggcagccccgcgtggggagtgcaggtggtttcggttgcggcagtcgcgtcccgggagcgtcgctgcctggtgaacgctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgasatkgtgagccagaggtcgtctggactcttccgtactagtcagttttcgaactagatggggctttgggatcaccagtcggagcccttcgtgttacagctagaatgggtactaggaaaaaagttcatgcatttgtccgtgtcaaaccccaccgatgactttgctcatgaaatgatcagatacggagatgacaaaagaagcattgatattcacttaaaaaaagacattcggagaggagttgtcaataaccaacagacagactggt

SEQ ID NO: 388 - DNA, 474 bp, Homo sapiens
  CDS 57..473
caaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctt

SEQ ID NO: 389 - DNA, 320 bp, Homo sapiens
  CDS 136..318
  misc_feature 265: n=a, g, c or t
agttactaggcaaccctatcgcagacgcgggcggccggccaagttcacccaaagttgaagaaaaaatttgggggagagaaggtggagcgagaggcgagaagaggaagcacggagcggggaaaagcttggaagggaatgaagctggccttgggctcccgctcacaggaagaaggtcccacgcgggccagagcagcctccccgcagccctgttgcgacccgatctccgtcctgcaccccggccggggcccaccccagagcgtacagngggcgctgggaacgacgtccacaaagcgctgccacgggtcgaaaccctggaggtt

SEQ ID NO: 390 - DNA, 490 bp, Homo sapiens
  CDS 71..490
acaatgcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgam

SEQ ID NO: 391 - DNA, 457 bp, Homo sapiens
  CDS 35..457
agtccatcattgaccgagatgtcattaagagagcatggaaaatacattagatgttatagaacatttggcaaataatgttaaagaaaagttatcagagaagcaggcttattcatttcaactaagtaaagaaacggaggagcagaagccaaaattagaaagaktgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctagggagtacaagtac

SEQ ID NO: 392 - DNA, 309 bp, Homo sapiens
  CDS 38..307
aaaaaaacgaagaaaaagattcagggatagtaagaggatgaagagagctggtgaagcagctgaccaaatggcccgaggtggtatgcagccgcggacaggaccaacccactgcccccggctcaggcsagagctcggcgagaccgtctgtttaamaagcatttgctatasgcsacsttgmattatgamagcatgtgacccasasagcmatcctaggaagcagttstcaagtcaccaatgggtaaaaggcttsagtgatcsaytcctaaagcsaaaaggcactgctcggtmtsttsagcstcagatggttca

SEQ ID NO: 393 - DNA, 349 bp, Homo sapiens
  CDS 186..347
attatttgcattgaccttgatgactggaaagcaaatgcaacatgaaaatgtgtattttacagagaaatcmggctaactaaaaggagtcacactgggcgtggtggcttattcctgtgatcccagcactttgggaagccaagacgggtggatcatgaggtcaggagttcgagaccagcctggctgacatggggaaacmmttgtctctactgaaaatgcaaaaattagccaggtgtggtgtcacacgccttgattctcagcwactcgggaggctgaggcaggagaatacctcgaaccaggaggcagaggttgcagtgagccaagattggcgcsattgcgctccattctgggg

SEQ ID NO: 394 - DNA, 503 bp, Homo sapiens
  CDS 50..502
  misc_feature 65: n=a, g, c or t
caaggtttatatcaagactcatggtgaacatgtaggttttagaattttcatggatgccatactantttctttgactagaaaggtgaagatgccagatgtggagctctttgttaatttgggagactggcctttggaaaaaaagaaatccaattcaaacatccatccgatcttttcctggtgtggctccacagattccaaggatatcgtgatgcctacgtacgatttgactgattctgttctggaaaccatgggccgggtaagtctggatatgatgtccgtgcaagctaacacgggtcctccctgggaaagcaaaaattccactgccgtctggagagggcgagacagccgcaaagagagactcgagctggttaaactcagtagaaaacacccagaactcatagacgctgctttcaccaactttttcttctttaaacacgatgaaaacctgtatggtcccattgtgaaacatatttcattttttgatttcttcaagcataagtatc

SEQ ID NO: 395 - DNA, 409 bp, Homo sapiens
  CDS 8..409
  misc_feature 20: n=a, g, c or t
agtcaagatggcgggagcanctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaat

SEQ ID NO: 396 - DNA, 450 bp, Homo sapiens
  CDS 208..450
aaagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacasggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaa

SEQ ID NO: 397 - DNA, 443 bp, Homo sapiens
  CDS 107..442
ctctgggcggctgctgccgtgccgctgctgctgctgcgggggtcgtgcggcggccaggggatttgggcaggcaccgtggatccccgggaaggggacgagttgacagatgtgcgtgaggaggtctctggtcggcctcaccttttgtacctgctacctgacttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactgaaaacatctcctgcaagatctgtagtgccctcctcctcctggccgcagcaggatgctt

SEQ ID NO: 398 - DNA, 574 bp, Homo sapiens
  CDS 370..573
tccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaacctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagat

SEQ ID NO: 399 - DNA, 370 bp, Homo sapiens
  CDS 139..369
  misc_feature 128: n=a, g, c or t
atcttcgaacttagacttccggaaggactttggcgaggcttgaktgtgcgtcagaatcccctgaagagcttgttaaaacacaaggtgctggccccatccagaattgctgattcggggcagccattttngggggtgctgatggatacctgcggggtcggctatgttgccctgggggaggccggccccgtgggaaacatgactgtggtagactctcctggacaagaggtgctaaatcagcttgatgtcaagacctcttcagaaatgaccagtgcagaggcttccgtagagatgtcattacctacccctttrcctggatttgaggattctcctgatcagaggaggctccctccagagcaggaaagcctctcca

SEQ ID NO: 400 - DNA, 456 bp, Homo sapiens
  CDS 225..455
  misc_feature 44: n=a, g, c or t
ctgtcggggctgggacctgccgtcgcccccgttcgaggttgaanccccgggcctaggactcgacccccagcatcccacggggcctctttcctttcccggctcattccgctgtcattttgacctggggttcccctccagcccctcgcctcgttcccttcccagcatcccagggccgaggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaaccgttcatcctcacctatgcaaagaaagggaagctattgctgggattttgaggagatggtcctagaacaattggagattcata

SEQ ID NO: 401 - DNA, 482 bp, Homo sapiens
  CDS 185..481
tgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgc

SEQ ID NO: 402 - DNA, 287 bp, Homo sapiens
  CDS 11..286
  misc_feature 77..78: n=a, g, c or t
ctctttccccatgtctttctggctgtctctatgttcctcttctcttatcctcaactttctgtccattcgggcctccnncccacctcccacgccccagcccctccctccttggtctccttttcgatatgccaaaccaattttgggtcgagtgcatttaacgagaacaaaacaaaaggctcataacaacaagaacgtttcagaaaaaaaaagttttaaaaaaattgttgagtcaaaaagtcaaacaataaagaaattaagatttcttggaaaaaaaaaaaaaaaaaaaa

SEQ ID NO: 403 - DNA, 216 bp, Homo sapiens
  CDS 67..216
  misc_feature 123: n=a, g, c or t
attatttaaaacgttttaatcggggcttccgggtagaaggtggagcggcagggtgtaattgggttgatgggtgggacctgtcttgaccatcggagttttataatcgagggccaggagggccgngttgctctcctggttatgtatgtacttgtacataaccacctaaagaatggtgaaataaatgttcttggaaattcccaaaaaaaaaaaaaaaaa

SEQ ID NO: 404 - DNA, 417 bp, Homo sapiens
  CDS 193..417
gaagggataaattcctgatgtctccattaagctcctctgtgtaaaatactccatggcaaagttgctgctatttaaagtagtgagtttgatcttggctttgatctaaccttttgatcttgaaagaaggatggagtagcaataaagagagggcaagacagattttctttaaagaaatgtgataaagttaaagggatggtcaagacccagcaagcaacaggacaacccgactctccgccccggcccgccctcaccggcaggcgggttccagcaactgctgatgcggatgagaaggcctttggcgggtggaggaaaatctgggtatcgcacatttttataaaccgctgcagagggagcgtcgcgccgggggcggagtgcgggcttgcgcggcaagtgcgcgccgaggtcacgaaatggatt

SEQ ID NO: 405 - DNA, 436 bp, Homo sapiens
  CDS 18..434
ctttctttctcgacaagatggccacaccggcggtaccagtaagtgctcctccggccacgccaaccccagtcccggmggykgyyccagyytcagttccagcgccaacgccagcaccggctgcggmtccggttcccgmtgcaggatccagcctyatmmtcagaccctgcggcagcagcggctgcaactgcggctcctggccagaccccggcctcagcgcaagctccagcgcagaccccagcgcccgctctgcctggwcctgctcttccagggcccttccccggcggccgsgtggtcaggctgcacccagtcattttggcctccattgkggacagctackagagacgcaacgagggcctgcccgagttatcgggaccctgttgggaactgtcgacaaacactcagtggaggkcaccaattgcttttcagtgccgcacaa

SEQ ID NO: 406 - DNA, 450 bp, Homo sapiens
  CDS 104..448
actaagccggggagcgcatcccggctactgcgggtcctgagtcttcacctgcggascttacggcagctgagcggttgggagggacctgagccgcggcgctaggatgggaaacagtgcgctccgcgtccatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagctctct

SEQ ID NO: 407 - DNA, 510 bp, Homo sapiens
  CDS 226..510
ctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagca

SEQ ID NO: 408 - DNA, 435 bp, Homo sapiens
  CDS 227..433
tgtgcagttgttgctttacattaacatcttcataaatttattatacagttaatgtttcttagacagtttaccagctgtcatttatcatttacttggtaatttagtgatctcaattctgatttaattcacctagtcactgagaattacttatgctttgcttgctctcagtaaagcattagaattaagtaatgacgagaagaacaaaggattttcttaagtatagtacatgaacttaaatagtttgggttaccttgttttagtgttacagacggtttttaataatccctggattcaaattggccgggtatggtggtgggtgcctgtggtcccagctactcgggaggctgaggcaggagaatggcgtggacctgggaggcgasgttgcagtgagctgagatcgtgccactgcactccagcctgggcgacagagcgaga

SEQ ID NO: 409 - DNA, 485 bp, Homo sapiens
  CDS 185..484
tacagactgagcgcgtccaggcctgacagctctgcggctcgggccctgagagacagcgtctcgggctagagtgcagtggtgcgatcaaagttcactgcagccttgaacgtctggactctagggaccctgctgaatagctggggctacaggcgtgtgtcactgcgcccaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctac

SEQ ID NO: 410 - DNA, 237 bp, Homo sapiens
  CDS 37..237
tcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtswtccatccgcgtttcaagagggagttcattcaggaacctgstaagaatcggsccggtacccagaca

SEQ ID NO: 411 - DNA, 482 bp, Homo sapiens
  CDS 223..480
agagttcagcaggtgagcsccgggcccggatggtgggactgggcccgggttcccaccgcatcgtccgcctcagccagaaccttctggtccccgcccccggatagggacccaggaggcccaagccccttcttccggcggggagtgggagcctctcggatctccgtttacagttcaggacctcagctgcactttggcgctaacgcctgtttcccaggactgtcaatggcaggataccagctctggtcaccatggaccccactggatgagagtttccaatggctgcggcgcacgacacctacaccttcctccaagcacccattcaaggcatccccctgcttcccacacacaccgtccgaccttkaagtgcagctgtgctttcaagaggtcactctagtcctagacagcccattcctggaatctggagtgagtcccaagttaccctgccacacatcagagttgcgcacgatgaacaaaaaaggact

SEQ ID NO: 412 - DNA, 482 bp, Homo sapiens
  CDS 331..480
taattctatcttttaccatttaattgcatctataatcataagtaaagttataattttccaagtatttttcaggtattgatattgcaatgatgttatacaacttataaaacaagattatataaaacttggctttcaaatcttatgttcctattttttatttccagtttcayctttttyctatccattctcttgaactttcttctttgaaatcagcagagtccctgggtattaacctagcacaactcctttctgggtcattgcacatcccggtagtatcattaagagttgtcagaaagatccctggcagcctttcggtgaaactctatcatcatgcaatcatggcagtactatgttggaagtcagagtccctttgcaaacataataaaacactttaatatatttgttaaagttacaaaccaagtatgtacaaatttaaaaatcacggccgggcttggaacgatgtacgataccctcatagtgac

SEQ ID NO: 413 - DNA, 419 bp, Homo sapiens
  CDS 96..419
  misc_feature 419: n=a, g, c or t
actttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcargccgaagctgaagcgcgctccacaccaaggagcagatcgtggagatgctggtgcaagarcagctgn

SEQ ID NO: 414 - DNA, 463 bp, Homo sapiens
  CDS 188..463
acactgcaccccaaacactcaagtccctgtgtaaatcttcactcctccaagcacagagggaagcctgctccgtaggctctgttaagtgtactgctgccgctgacatcatcataaataggaagggagagagtccaggaaccacagggctcacttcctagcctcttctatttaagattttcgagggcagatggcactatatttaaccagcamaagtagtattcattgtgcccagggcctcttaaggaaaactgaacaaagttttagaatgaacctgccctcacctcactcctgctcaaccatttcacccaacaacaagttagaggcagagaagatgaatattattaaaatgatgcttctaaatcaggaccttatgggtgctttggctctcaacttttttcataaaatatctgtccagtccagaccgaggagccagcttcgacagcattctggcatgatcatcttc

SEQ ID NO: 415 - DNA, 219 bp, Homo sapiens
  CDS 37..219
  misc_feature 187,192: n=a, g, c or t
agtccgccgtccgccctccgcgcccgsgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccntgcgnatgaggacccggagcggaaaaccttct

SEQ ID NO: 416 - DNA, 460 bp, Homo sapiens
  CDS 66..458
aagtttttgttttgttttgtgtttttgatttttattttgtttttgtsttcctaggcttatggctcatgcagaaactgaagaaatccgggtctctactgcagctgaccttcagggataatgctgatttgcgcaaatgtttcctctaccaactaagccaaaaaacagggctgcagtattttaaaaacgtcgtgctggttgcttctccccaagaccgttatgtgccatttcattcagccaggattgaaatgtgtaaaactgccctcaaagacagacacacagggccagtttatgcagaaatgatcaacaacctcctgggccctctggttgaagccaaggactgcactttaatccgacacaacgtgttccacgccctgcccaacactgccaacacccctgatcggccgaccgctcacatcgctgtgctggattcagaacycttcctggagaattttyttggtgg

SEQ ID NO: 417 - DNA, 474 bp, Homo sapiens
  CDS 297..473
cactgttttcttgtgtctttcacaagtgtattttgcttcataaagatcctgcctagccttttactttacagtcacgtgctgcataatgacctttgggtcaatgacagattgcatatacgatggtggccccataagattataatggagctgaaaattctgttgcgtaagtgatgttgtaatcattgaaatggcttagcgcactgggtgtagtagctcacacctgtaatcccagcactttgggaggctgaggcaggtggatcacttgaggccaggagtttgagaccagcctgggcaacatggtgaaacctgtctctactaaaaatacaaaaattagctgggtgtgttggcaggtgccggtcatctcagctacttgggaggctgaggcaagaaatctcttgaacccggggggcggaggtagccgtgagcctggatcacgccactgctctgcrcctaggcaatggagtgagactcggg

SEQ ID NO: 418 - DNA, 507 bp, Homo sapiens
  CDS 223..507
agccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcwtacagcttttgaaagctcatgaaaatgctttagaaaaacagtacagtgaaattacaaaccataggaatatgcttcttcaaacctttgag

SEQ ID NO: 419 - DNA, 172 bp, Homo sapiens
  CDS 1..171
atgggatcccccacagatccatacaaacaggctgaccatcagksctggtcccaggccaccaggctgggtgcaatgcagaaatggagatctgccccgggsaaggcaggtgagtgtaggaaggagggagggctgcgagaagctgggggcagcctccatccccctgtggcctggg

SEQ ID NO: 420 - DNA, 505 bp, Homo sapiens
  CDS 8..505
atcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaattttaaaaatcacttggagttactaagcaattcggaagagaaacac

SEQ ID NO: 421 - DNA, 504 bp, Homo sapiens
  CDS 323..502
aacccaatcacgtaaattccctcacggcaccacagtatcggggaaattgcaagctagcttgaatcggccggatcggagctcgggttgaccaccgccgctgtcgggactcctctacgactgcagtcggccgttgggtggagttgcgaaggcggcatttgagagttcatcgggagcaggttgcgtcaggaagtctcggcgttaaggaacccccacgttctcacccgacctctcttcgtggcgatgcacacctagactgaagtagaattggcttgcagctcgacgtgcggggcacgacaccaccatagtttcggcttcggttaggatgcggtggctggggcgaacgatggtgtgcgactggaggcgcttcctgccgtcgtcgaggcccgcatctccaggaacgcgtggcggcatgtggcgctacagagaagacaacatattggccttcgatctctgtgtgggcgaccacgattggatgggatcgggaaacggttgtacccataggga

SEQ ID NO: 422 - DNA, 271 bp, Homo sapiens
  CDS 28..270
  misc_feature 34: n=a, g, c or t
ctttttctttctaactccgctgccgccatgghhnctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgacyatcgraaggagcaagagcaagatcaccgttgacatcygaggtgcctttctccaaaagg

SEQ ID NO: 423 - DNA, 315 bp, Homo sapiens
  CDS 51..314
cgtggagaaggttgctcttctgttgttagaaaaagaagtattagataagaatgatatggttgaacttttgggccccagaccatttgcggaaaaatctacctatgaagaatttgtggaaggcactgtcagcttggatgaggacacctcacttccagaaggccttaaggactggaacaaggagcgggaaaaggagaaagaggagcccccgggtgagaaagttgccaactagaggcccagaggaggccatctcagtctgtccactgtggtttcagctggtgcattatttcagctgtggctttcagaagaatgggaatg

SEQ ID NO: 424 - DNA, 213 bp, Homo sapiens
  CDS 54..212
ctcctsctggcgcgcctccgcaccgcattggtggaccggcccccagcccctccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggkgtcctccgcgggccggcg

SEQ ID NO: 425 - DNA, 407 bp, Homo sapiens
  CDS 176..406
aaattcaaaatcaacccccctcgtcgcaaggccacaaccactccactcctccccatccctagctagccactagggtttgccagcctttgcagcgtcgsgctcgsgsctcatcccctcgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgstccgcgagatctccctcctcaacctsctctcccactccatctacatcgtccgsstcstcgcsgtcgagcagg

SEQ ID NO: 426 - DNA, 324 bp, Homo sapiens
  CDS 105..323
acccccgaagtccgagcaccccgcgcccagggtcttcactccctcgcgttcgctgacgaggaaggtccccataccgcgaactttgtagctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagc

SEQ ID NO: 427 - DNA, 480 bp, Homo sapiens
  CDS 329..478
aacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggtgcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaaacttgccctgt

SEQ ID NO: 428 - DNA, 498 bp, Homo sapiens
  CDS 318..497
cttctccagcttaacagatgtggaaacttaagcccagagacatgagttgacaccccacccccagagctagagtctaaaaccctttctttcgctcctcatctcccacaggataaaatgcaaattaatcagactagtggtgaggccctccgtggtgtgactaacctgcatcccgacgttttcaccctactttgatccagaaagcacctttccgccccatctcttctcctttccttaaataccccttacaacttcctgtaccattcttccctgttcagcttctacttggtttcttcgtacattctggatccacccctttcatgcatattccagaccacatttccactggagcagttgaaatgagagagatgggaatgggactcacccgaaccagaggaatttttattacagacccattaacagaggtgtcaaagtcacaggaacaaggatgtgcacctcagaaacacagagctcagtggaaaatcagttttgcttctattt

SEQ ID NO: 429 - DNA, 309 bp, Homo sapiens
  CDS 67..309
acacaacttggggcccctctcctctccagcccttctcctgtgtgcctgcstcctgccgccgccaccatgaccacctccatccgccagttsacctcctccagctccatcaagggctcctcaggcctggggggcggctcgtcccgcacctcctgccggctgtctggcggcctgggtgccggctcctgsaggctgggatctgctggcggcctgggcagcaccctcgggggtagcagctactccagctgctacaactttggctctggtggtggctatgcagcagctttgggggtgttgatgggctgctggctg

SEQ ID NO: 430 - DNA, 469 bp, Homo sapiens
  CDS 286..468
caagaattatggattgtgttggttgttttaaatgtcgtctgtggggaaagctttagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgt

SEQ ID NO: 431 - DNA, 464 bp, Homo sapiens
  CDS 278..463
tattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctctcagtccaggtgaaataaggtttatag

SEQ ID NO: 432 - DNA, 494 bp, Homo sapiens
  CDS 167..493
  misc_feature 490..491: n=a, g, c or t
tccctctgctttgtccaaagcaatcaagacctacttgtgcctgcccagctcttcccaggagtccctcataataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgaacatatgcaggataaacatattatcaaagctgtagaacagcagcagcaagaggaagaagatgaaaagatgagaaaattcatcaaagcaaaaaagcgtcttatacaaatggggaaagaaaaagaggctgaaacacacatgcttatggagaaacgaagagaaagaatacataacttcctgagtgaactgttgaaagagaaacttgacaatgaagatatgattattgctagagatattgcagaagctgaggctgaatggggaacnngag

SEQ ID NO: 433 - DNA, 413 bp, Homo sapiens
  CDS 174..413
aagtgagaagatggacctgatctcatagacgaccccattaccatagaaaacttggtgggcgaggaggagccaagatggccgaataggaacagctccggtctacagctcccagcgtgasaacgcagaagacgggtgatttctgcatttccatctgaggtggccttaagcaatatatgagaagaagtgaattaggagagggatttctgcagaaaagtgccaagtgttcttcatcatggatttctctttctggatgttccaacatcttggatgacaacaagaagtcaaaggcatttgcctgcggggcgcggtggctcacgcctgtaatcccagcactttgtgaggccgaggatcactggattctactgtgtttgagaaaaaaaaaagtaggamctataaacttaaattatagccaa

SEQ ID NO: 434 - DNA, 323 bp, Homo sapiens
  CDS 104..322
cctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatag

SEQ ID NO: 435 - DNA, 548 bp, Homo sapiens
  CDS 386..547
agaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaaactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtgaaaatattggcattacatcacgacgcag

SEQ ID NO: 436 - DNA, 493 bp, Homo sapiens
  CDS 184..492
ctttttttttttttaaactacsatctcccaacttttaaagcsagatacttgasaaggattttagatcttaatgggttcgatggwagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtg

SEQ ID NO: 437 - DNA, 457 bp, Homo sapiens
  CDS 78..455
  misc_feature 442: n=a, g, c or t
ctctcgatttctcgcggmsccctccacctttatcgccgccgcctccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggtgcaccccgtccatcaccgagtccaagtccaagaatgatgccaggacctcctgcttctggatatgaccggtcacctctattttacggaggaggtggtggcgccccacctccaattccgcttggaactggtagctatggtgctcsatatccasaccttgggatgcgatatggctatggtccacmagtaggacctcstggttnatacggtcttttctc

SEQ ID NO: 438 - DNA, 343 bp, Homo sapiens
  CDS 153..341
tcctaatcgaaaagaagatccggactctgggtgttttgctaccgtgaccgtttagaacagaaactgttcatacttggtgcgctgtggactcttgtgatwattaaccmagagtagctytatttgtccamcctcacacctaaagaagaaagaaaatggcttgkgctgagttttcttttcatgtaccaagtcttgaagagcttgctggagttatgcagaaggggktaaaagataactttgctgatgtccaggtctctgtrgttgattgccctgatttgactaaggaaccctttacctttcctgkaaaggcatctgtgggaaaactagaattgcagaarwtggaggg

SEQ ID NO: 439 - DNA, 428 bp, Homo sapiens
  CDS 255..428
ccgtttccggggtggagccagggagggcgggagtttaggctgcgctgacccctctcagccccccctccagtgcctcccaaatctccaagcccaccctgtcccgtggtggcaactgaggcttctcgggggcatcagcctcagattacctgagaactgggcagcctcgtcctgagaatgacggagaaggggacctggggctagggaatccctgattcaatcatgccgctccccaggagacgttcggagcccaggacatgtcgggaatgaggagatacgaggtggcgctggaggcggaggaggagatctactggggctgtttctactttttcccctggcttcgcatgtggcggagggagcggastcgggcgcaccccggggagcagaagctggagcctctgcgaggcctgatgagctgtctgtccagcggc

SEQ ID NO: 440 - DNA, 537 bp, Homo sapiens
  CDS 138..536
tacttcgactcctctccctgtcccagggaggggagaaaaggtctgggattcattgccaggaggggcttcccccaggatttcctacttctttctttactgctgtgcttgaagctcacaggagacccctcaagagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacakggccaatccctactgcagctgccgakgacggccgtcaagtctgtctccacgctcatggtctctgccctgcagagcggctggcagatgtgcagctggaagtcatcagtgagtt

SEQ ID NO: 441 - DNA, 360 bp, Homo sapiens
  CDS 149..358
aaacctacttgttaacacctgtcacagggttccccctccagcaagcggagaagccctttgctgcagccaattatcgagggcgaaactgcttccttcttcaaggagataaaggacagtggaccaaagactagtccttacattgatctggatgactgagaccctttcatgcctycagtttcttgcctatgcaactgacaaggaagaagaggaggggtcagaagacgatagcaatgtgaagccagacttcatggtcactctgaaaaccgatttcagtgcacgatgctttctggaccaattcgaagatgacgctgatggatttatttycccaatggatgataaaataccatcaaaatgcagccm

SEQ ID NO: 442 - DNA, 502 bp, Homo sapiens
  CDS 329..502
attcatgctgatgcattttgatgctttgtgcattcatttctttctgtgctttgttggaatctggctatctgcttacagctattgaggaaactcagctttttaggagtgtttacagcctttttcatacctaaataggatgaacagtagatataaacttgccaaggcagaaatgtgttgataaatcaaaatgtgtatttgtggagggttgtgcatctcttggttgcagcttgctaaataggccattaggaatcttctttcaatgcttttttcttgagcactgcctggggtggtgaaaaagcagagggcaagcctttgtctgacgccaaaaatgtcttcagtgaagaggccaagaggaaggcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagag

SEQ ID NO: 443 - DNA, 467 bp, Homo sapiens
  CDS 91..465
gacgctacaggatggagcggggcgcaggagccaagctgctgccgctgctgctgcttctgcgggcgactggtttcacatgtgcacaggcagatggccgaacgstacacggcggtsatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgstggaggcacccacgaccctcggtgacaacacagcagcgaacaacgtgcgcttccgctgtttcagacggcgaggaactgca

SEQ ID NO: 444 - DNA, 464 bp, Homo sapiens
  CDS 285..464
ctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgckccgggcctgcagcagccgggtgggaaggctcaagatggcgtgcttgttggagaccccaatccgcatgagcgtcctttcggaagtaacagctagcagtcgccactatgttgacatgctatttgaccctgatccccagaaagttctacaaggtgtcatacatgaaaaatgctgtaattggaaacaacaagcagaaagccaatctcattgttttaggagctgttccaagattgttgtacttgcttcagcaagaaacctcaagcacagagctgaaaactgaatktgca

SEQ ID NO: 445 - DNA, 504 bp, Homo sapiens
  CDS 141..503
gaagtcccggggaggggtgtgacgtacatccggcgagtagctggcggtcccgggtgctgctggttagtgtgctctgagggagggtccgagccagccgctgttttgccggagagcccctcaggccgtagtaagcattaataatgtctttcatctttgagtggatctacaatggcttcagcagtgtgctccagttcctaggactgtacaagaaatctgaaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcrcgtcgcgtttggaaaaattatctcccagcaattaatgggattgtctttctggtggactgtgcagatcattctcgcctcgtggaatccaaagttgagcttaatgctttaatgactgatg

SEQ ID NO: 446 - DNA, 476 bp, Homo sapiens
  CDS 56..475
agggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctcatgagaggcacctgcggca

SEQ ID NO: 447 - DNA, 505 bp, Homo sapiens
  CDS 49..504
acgagaccatggagaagtaaactcttcacccatcagggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgc

SEQ ID NO: 448 - DNA, 495 bp, Homo sapiens
  CDS 95..493
acttatcctataggctacggaataccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgctt

SEQ ID NO: 449 - DNA, 503 bp, Homo sapiens
  CDS 299..502
  misc_feature 493: n=a, g, c or t
aggagctctgggattccagcggctggaaggttgcccagggctcacctctgatgggcgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactgacgtcacagagcagctggatgccggggtgcggtacctggatctgcggatagcccacatgctggagggctcggagaagaacctgcactttgtccatatggtgtacacaacggcgctggtggaggacacactcacggaaatctcggagtggctggagcggcatccacgcgaggtnggtcatcctg

SEQ ID NO: 450 - DNA, 461 bp, Homo sapiens
  CDS 20..460
attttagagtgaaacgctcatgtgcagtggatgctgtggtgctccacctccaatccctcttcaggtccggtgccctgtcctccagatgctgggcacactgcctgccgattttcacagctgcacccctctctgggaactgtggacaagtgaagggccaaccctgctccagagctccctgcaggatccggaaagctgccaggtttgggacgcctggagtgagaggcagctccacaagcgcagttgctgtgcaagctgctcttccactgtggccacagaatccagcagatgtgaaggcactatgcttatcagtggactttccaagttggaggcctcactgttgcttcaagtgtggtatggcagcacccatctgctgtgtccatctacactttattatatatctatgcacctcatcagggaagcacgggaacccgcaggcactgctagtaggaaggcaagctggs

SEQ ID NO: 451 - DNA, 507 bp, Homo sapiens
  CDS 6..506
gccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcc

SEQ ID NO: 452 - DNA, 480 bp, Homo sapiens
  CDS 154..480
tattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgacggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcac

SEQ ID NO: 453 - DNA, 511 bp, Homo sapiens
  CDS 265..510
ttttattctttattgagacggagytcgctctgttgctcaggctggagtgcggtggcacgatcgcggctcactgcaagctccgcctgccgggttcacgccattctcctgcctcagcctctccgagtggctgggactgcaggcgcccgccaccacgcctggctaatttttttgtatttttagtagagacagggtttcaccgtggtctcaatctcctgacctcgtgatccgcctgcctcggcctcccaaagttctgggattacaagcatgagccaccgcacccagcccacttttctttctctatattttggatctgtgtctctttcttttctcaagtctctcattccacctgacgagaaacacccacaggtgtggagaggcaggccacccttcattagccgggcatggtggcacatgcctgtaatcccagctactcaggaggctgagggcagaattgcttgggcctgggagacagaggttgcggtgagccagatcgcaccattgcgctccagcc

SEQ ID NO: 454 - DNA, 493 bp, Homo sapiens
  CDS 337..492
gaagctgtcatggctgctcctgtacgtagtcacggtcttgtgctctaaggtgagtggaggacgagcttgggcttagcggcasccgtatcacatcctagactttttacttcgaggagaagagtctcacgagttgtcctggaagtaagtttaaaggaggtgggttaatgctgggcggcccagctgcggaaggacaggctcttgaagttggttctggggtctggtgaggctggctggttgtataagatcttcctcttaagcgcaggccacgtgcagacatcgctttcgttttctgcttcttccactgagccgttctacctgcccaggtccctattcttgatggtctgggttcggccgttgctaaatcgtcatgttgaaaatgatctatcagccgggcgcggtgactcacgccttgggaggccgaggcgggtggattacctgaggtcaggagttcaggaccagcctggccaacatggtgaaactccgtctttacaaa

SEQ ID NO: 455 - DNA, 593 bp, Homo sapiens
  CDS 176..592
  misc_feature 10..11: n=a, g, c or t
aactcatggnnvcrgcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccggraagcctgggtctctctagcttattttgtgtctc

SEQ ID NO: 456 - DNA, 483 bp, Homo sapiens
  CDS 99..482
gccgttcgctgctcggsgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaaca

SEQ ID NO: 457 - DNA, 464 bp, Homo sapiens
  CDS 242..463
attagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgcmttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgagggcccaagaggaaaaggatgtggctcaggctgggagggacttcagttagcatggtgggggagaaccagtaccacatacccagtaggtaataaggtgt

SEQ ID NO: 458 - DNA, 378 bp, Homo sapiens
  CDS 119..376
  misc_feature 143,318,332: n=a, g, c or t
gaaagacggagagaggaaaagggacaagggcaaggcaagagagaggcgtcgtcgtttgatctgctgccggagtgcgaagaggaagaggaagaggaagaggagcgccggagttgtaaagatgttsctggtggactggttctatngggtgctgtcatcgcttgggctgtggcagaaggaggctaagatcctcttccttggcctcgacaacgccggcaagaccaccctcctccacatgctgaaggacgagcggctcgtacagcaccagccaacgcagtaccccacgtcagaagagttgagcatcggcaggatcaagttcanggcgttcgaccttnggggccaccagatcgcccgccgcgtctggaaggactactmcgccaa

SEQ ID NO: 459 - DNA, 517 bp, Homo sapiens
  CDS 144..515
agcgtggggtatctcgaggtgccgggttgcagtcgctcaggagcgctagggtttgaggcctgctttctgctcgcgccasagagcactacctgaggcagcgaggcgcasgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaaga

SEQ ID NO: 460 - DNA, 475 bp, Homo sapiens
  CDS 197..475
aacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggcgctctcatcccccgtaagagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgtttt

SEQ ID NO: 461 - DNA, 528 bp, Homo sapiens
  CDS 303..527
acagtcaaggactttaatctcaaaccatagtgtcatgatcacgagccaccaagccccttccacaagttcttaggaagccagataagactagcaacacaaaagctgttagcaggaagggcgttttaaagacacaagccatgttttgtgcttcctcacctcccagaaggattttccctggatgatccactaacacaccctttccgagatgttttctcaagggcctccattgtcttcagcatcctctcatctctttcctgtcccttttcccagctgttgtcacttctccctcccaaagctcccagatgcctagagaaaaccttccaattgtgttctcctggagaaaggcccaagctctggaacttttttccgtttactccactctccctcaggcttcagttatctgcccaggggtttggctgaaaagaaagcacgcctacatctgcctggcagccatctgggcctatgcttccttctggaccaccatgcccttgatcattgccaaggttaagtccttcttccaaagaagta

SEQ ID NO: 462 - DNA, 285 bp, Homo sapiens
  CDS 89..283
gccgagagtgtcctgtctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgbccgggctgggcaaccttgctgcatgtggacttycagaacacaccatactgsttcgaccagttgcggsgccgcttcg

SEQ ID NO: 463 - DNA, 457 bp, Homo sapiens
  CDS 161..457
gacgggaaggagccgagcttgggttatggcggcgcgggcgcgctgctggtgatgggcgtgasggctcggggaaatccaccgtgggcgccctgctggcatctgagctgggatggaaattctatgatgctgatgattatcacccggagaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgcccctt

SEQ ID NO: 464 - DNA, 188 bp, Homo sapiens
  CDS 37..186
aagaaggcggagacgccccagtggcggcgtcttcgaatgcggcctaaggtgcctgccgccagtctcctggcgactttccctatatcgcagagactcatccctctgaccccagcccggaagcactgtccctcggagtccgagacttccacctgggtcgtgtccaaggccccggskactccscggactcg

SEQ ID NO: 465 - DNA, 460 bp, Homo sapiens
  CDS 239..460
agattagggatactcaacctgtagcctgtgacaatcattatcgaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacaga

SEQ ID NO: 466 - DNA, 497 bp, Homo sapiens
  CDS 223..495
attctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaaatgaatattccaagagtagata

SEQ ID NO: 467 - DNA, 480 bp, Homo sapiens
  CDS 192..479
ctttagtacccgacgctgtctgggaattccgggcgtttcggctccttgtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgcctcgatgtggtcatgaaggaatggcata

SEQ ID NO: 468 - DNA, 492 bp, Homo sapiens
  CDS 125..490
acttgaggctcggttgggaagagatggtcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgc

SEQ ID NO: 469 - DNA, 388 bp, Homo sapiens
  CDS 40..387
  misc_feature 124: n=a, g, c or t
gtaagcggactgcagccgcgagctcctggaggcggcgggatggaggcggcggccgagcctggaaacctggccggcgtcaggcacatcatcctggtcctctcaggaaaggggggcgttgggaaangcaccatctccacggagctggccctggcactgcgccatgcaggcaagaaggtgggaatcctggatgtggacctgtgtggccccagtataccccgcatgctcggggcgcagggcagggctgtgcaccagtgcgaccgcggctgggcacccgtcttcctggaccgggagcagagcatctcgctcatgtctgtgggcttcctgctggagaagccggacgargccgtggtgtggagaggccccaagaaaaacgcgctgataaagcagt

SEQ ID NO: 470 - DNA, 478 bp, Homo sapiens
  CDS 197..478
aaggattctgaggccagccatcttggctcagcagggaagagtgctgtggtgagtgagggattttgccatggagaaggagaaggacccatagcagtttgtcaggttcatggaatccgagctggacctaaatgacatcattcaggagatgcacgtggtggccaccatgccagacctgtaccaccttctggtgagctgaatgctgtacagtcgcttctcggcttgctcggacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagag

SEQ ID NO: 471 - DNA, 467 bp, Homo sapiens
  CDS 81..467
aaaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtmctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgg

SEQ ID NO: 472 - DNA, 527 bp, Homo sapiens
  CDS 170..526
gctgagccccagcgaccgctttggtcggctgtgtagactgttgggtaggctgcgtgctagcttcggcgcggatccctgggcgtccgtacgtcggagtccttcgtcctccagggtccctgttctttgcgccasgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtrgaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaaccc

SEQ ID NO: 473 - DNA, 550 bp, Homo sapiens
  CDS 87..548
acggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccascatgccagacctgtacsacsttctggtggagctgaatgctgtacagtcgcttctcggcttgctcggacacgataatac

SEQ ID NO: 474 - DNA, 303 bp, Homo sapiens
  CDS 26..301
ttatatcggccaggtgcagtggctcatgcctgtaatcccagcactttgggagactgaggcgggaggatcacttgaggctaggagttcaagaccagccccgttgagtgaaaccccatctctactaaaaatacaaaaattagccaggtgtggtggcacgcgcctgtggtcccagctacttgggagattgaggcacaaggatcgcttgaactcggaggcagagcttgcagtgagccaggattgcgccactgcactccagtctgggcaacagagtgagactccatctcaaaaaaaaaaaaaaaaagg

SEQ ID NO: 475 - DNA, 169 bp, Homo sapiens
  CDS 10..168
atctggaaaatgggactttgcagcaagaaagagagagagacctatccaaattgcctggcacatagtaagcaccaagtgkttgctccctcctacccctctcctgctgggaactgtaacttctccacatggctgagaccccctggtggcaagacctgtgtctcccccactg

SEQ ID NO: 476 - DNA, 471 bp, Homo sapiens
  CDS 177..470
gttcgggaaaattttatggttcgggtcacagtaggaagcggacaatgaggcgggagggcagagagaaccgcaacgccgccgcgcacctggtgccgggtcgggtcgtttcctgggctttcagtggccggaagtcgcggcgcctgtactgactctaggaagggctggagttgttttgaatgggcgcccgtaagagaggtgggcaactctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctgggtgtcgggggaggagatg

SEQ ID NO: 477 - DNA, 252 bp, Homo sapiens
  CDS 71..250
tccacaagtatgttctctaccgaagagttgctgcatccttgaatcttgggtgatttgaggcacagaaactatgactttattttttgagatggagttttgctcttgttgcccaggctggagtgcaatggcacgtttttcggcttaccgcaactgccgcctcctgggttcaagcgatagctgggattacaggcatgcgccaccatgcccagctaatttatttgkrtktkkagtagagacggggtttctccatgw

SEQ ID NO: 478 - DNA, 472 bp, Homo sapiens
  CDS 248..472
tacagagagtcaaatagagagaatggagagagagaaacatatattatatattatatagagagagggaggagagcgagagagagtgaggacaccgaactgggctggcggctccaaagcacagccttccctgttccgtcccagcgggagctgtgttaggggtcccaaggttgccacccacgtgcscagctgtcccacgctgcagcgcagacggccacgcccacacccggccttttagctcaggtccaccatgggggacggcccagcgtgggtgggggtccagagggtcccgagtgggggccgtgctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtg

SEQ ID NO: 479 - DNA, 510 bp, Homo sapiens
  CDS 110..508
agtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgca

SEQ ID NO: 480 - DNA, 505 bp, Homo sapiens
  CDS 356..505
aaaaattatttgttagttgacgatgcaatcagcatgctgattaaggttgcttggttttttactaaacattaactgaatgaaaacgggtagtccttgttctgcttggggggctttaaggaagcaaatggactttcagaacagagattgtcaataaaggaatacccatctcgagttctggatatgtgctctgagaaggtgcccatgtcaccgaccacactggaggccaatgcagatactgggggaaggttccatggtagctaagtgtggacaagctaatcactgaagttccctgatgcagagttgataatctctctagagttggatgaaagactgtgctgccttgaagctctgagagatgccatgccaattcaaggcagggtctttattgttgaaactcttgcgtaatgacatctttattcaggtgaaaatacaggatgaatttcaactatatgatattgtttatgttcctcagacatgttatttgtctttacaaagattggtttca

SEQ ID NO: 481 - DNA, 352 bp, Homo sapiens
  CDS 188..352
ttttatgtgagtgcagtccaggccactgctggatgatctcactgttctgagaacatgtatttgcaaaaagcacacatcagaactcactgaagtcaggctacaactgtggactggccactctgcagtctgctggagctcacactcaggaagcgagaacgctttcattacttgccagagcaaaactgctatggttttaaactcaacacacacattattcacatcctattggtatactggtatgttgacttgggaatacgtcaggtttacacggcagttcagaatagtaaatatttggaagtttacaaactcttgcttccttaaaggtcagaacatcaggccaaagtacaacgtt

SEQ ID NO: 482 - DNA, 286 bp, Homo sapiens
  CDS 20..286
cttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcagaacgtggtgaagattgccatccagatgcgtgacgccatcccgcakctcatccakctggaccaggcgaakcccctggccgctgtgctgaargar

SEQ ID NO: 483 - DNA, 451 bp, Homo sapiens
  CDS 18..449
agcgcgaacccgaggagatgaaccctttaactaaggtgaagctgatcaacgagctgaatgaacgagaggtccagcttggggtggccgataaggtgtcctggcactccgagtacaaggacaacgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagttt

SEQ ID NO: 484 - DNA, 244 bp, Homo sapiens
  CDS 91..243
aggctcctcgaagccccccagcttccttcccacttcctttataccactctgatccatttctttctcttcgttctttctctycccacccagatggtctctgattatattttctctgcagagaaaggaactacagctcagcatataaaacacttttatagcaaaaaaaaaaaaaaaaaaaaaaaaaaaaaaraaaaaaaaaaaaaaaaaaaaaaaaaaaaaaaaaaaaaaaaaaaaaaaaaaaaaw

SEQ ID NO: 485 - DNA, 482 bp, Homo sapiens
  CDS 228..482
  misc_feature 315: n=a, g, c or t
aagttgacacagtactaagatgagactgaagcaaggwtcgtttctgtggtacctctatctggacaaaatatactgcttattatccgtgagawacgtgaaggctttggcagaatattttcatattctggacgtgcacggcaagaacacctttgaatgatgtgctgttctatcacttccttcatcatgtgactgacttgaaaaaggcacagatcaacattgtgtttgacatgctggactggaacgctgtgggcgagatcgactttgagaagttctacatgctggtgtgcatgctgctggcccaccagaaccatttgnaaggacagtttatgtatcgtcattcccggcctgtctttgacctgcttgacctgaaaggggatctgagaattggtgcaaaaaacttcgaaatgtacagatttctcttcaatattcaaaaacaagaactcaaagatctcttccgtgactttgacattacaggtgacaaa

SEQ ID NO: 486 - DNA, 383 bp, Homo sapiens
  CDS 149..382
aattataagtacaggtacctaataacagagctctaaaatacgtgaaacaataactgatagaactgaaaggagtagacaaattcacagttatagttggggacattaacaaccctttctcaataattgatagactactaaataaaaaaccatgaaggatatacaagaactgtacaacactggccgggtgtggtggctcatgcytgtaatcmyaacactttsggaagctrtggmgggtcgatsacttrmmkgwmatgagttcgmsaycagcctarccaacatggcgaaaccacatctctactamaaakrcaaaaaaattaggctggctstggttggcttaatgcctgtaatsscagcactttgggargccaaggtgggcatatcac

SEQ ID NO: 487 - DNA, 370 bp, Homo sapiens
  CDS 164..370
agtttggagctggagtgtctgctctggatacagtcgattctgacatcaattaaatatataaccagacacgtgcagtggcggggagggtcccctcacccagggtgcatctccagaaacgccgcctgcccttccccctctttagctcagtgttgggagtttgaagatggcctcttcccgtcctccaaagaatttagaacgagtctacgtrgacacgcaagtttcarcgarcagggatttcctgcraagmcgarcgcgagghacarccggmcccggargctcgggctcggggtctccccggggacgcrgccgactgaraaggccggggcrctcgccgggcrcrgcrccgtcctccgtrtcgcggggacggaag

SEQ ID NO: 488 - DNA, 267 bp, Homo sapiens
  CDS 24..266
  misc_feature 54,153,155,158: n=a, g, c or t
ttcttttgtctgcgccaagaggaatgtgttcagaagctgctgccttagggcagngcctacctgggcacacagaagagcatatgggagggcaggggtttgggtgtgggtgcacacaaagcaagcaccatctgggattggcacactggcagagcntnttngggggtatgtgctgcacttcccagggagaaaacctgtcagaactttccatacgagtatatcagaacacacccttccaaggtatgtatgctctgttgttcctgtcctgtc

SEQ ID NO: 489 - DNA, 282 bp, Homo sapiens
  CDS 1..282
  misc_feature 74: n=a, g, c or t
atgcgcaggtttcgcatacagcagtgcagtgccgttattccagtctccgtagaaacgctgggactatggcggangactgggctgttggagatgtccgagctccccggagatagcagtgtcccacaggtgggcaccgcgagtggcgtcasgacgtactgcggggggcaagtcggcggcggggtwcgggtgcaggaggctcgggaaggcccagtggccgaagctgcgcggtccatgggcttcatcctgcacaataaactccggaagcaagtcagtaaaaaaaaa

SEQ ID NO: 490 - DNA, 458 bp, Homo sapiens
  CDS 277..456
agtcagtgggagccaagccggggagcggtacctctgtctagctgccggcctgtctctgcagcccccaggcccccttctgttcgcagcgtgccctggacttcagggagagsagggaagctgagccccacccgctgtgggagtacccatgccgcagcctctccgagccctggcaratcctgacctttgacttccagcagccggtgcccctgcagcccctgtgtgccgagggcmcgtggagctcagaaggcccgggcagagcacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttca

SEQ ID NO: 491 - DNA, 457 bp, Homo sapiens
  CDS 299..457
  misc_feature 237: n=a, g, c or t
tatttcattctgcaaatatgtattgtctaggtgcttgggatagagcaataaacagaacagctaaatattcctttctcacagaatttatattctagtgggggaaacagtatatacatgtatataatgttagacattgagaaaaagcaaaaaaggggtatgcaatgccaggggcagtggggttgaaattttagaggggctaaaagggagagcctttatatatatatgtatatataaaanagggaagattattttgagtaaagacttgtggggaaagggagcagtgagccatgtggatataatgcagagaaagaacacattccaggtactgcaaagtgtttggggtagaaacaaacttggctggctgggtgtggtggcacacactatcatgccaggactttggggggctgaggtgggtggattgcttgatccgaggagttgcccagcagcctgggcaaca

SEQ ID NO: 492 - DNA, 486 bp, Homo sapiens
  CDS 125..484
ataaattgcattgtcgttttggtttgagataggaagatcgagggcaggaaggagagacttatttttgagctcgctgtaagactgaraaatcacgtagtccttcctgaaaccactaagaggaaaaatgtctgtgacastgcatacagatgtaggtgatattaaaattgaagtcttctgtgagaggasasccaaaacatgtgagaatttcttggctstttgtgccagtaattactacaatggctgtatatktcataggaatatcaagggtttcatggttcaaacaggagatccaacaggaactggaagaggaggcaacagtatttggggcaagaagtttgaggatgaatasagtgaatatcttaagcacaatgttagaggtgttgtatctatggctaataatggcccgaacaccaatggatctcagttcttsatcacctatggcaaasagccacatttggacatgaaatacaccgtatttggaaaggt

SEQ ID NO: 493 - DNA, 452 bp, Homo sapiens
  CDS 244..450
ctcagactgatccctctacttcattcgcgcttctctcagtatgtgcccggcacagatttgagtcggcagaatgctttcaagtcattgctgtggatggggtctgcactgggattattcagtgcctctctgctgaagactgcgttgactggctacaagcaatagcaactaacatttcaaatactcacaaagcacaatattaaaaaaatcaacagaaactttcctgtaaaccagcagattgtctacatgggctggtgtgaagcccgggagcawgascccctccaggacagagtgtactccccgaccttcctggccctgaggggctcatgtctctacaagtttctggcacctkvcagtgaccacctgggactggacgagagcagagaaaaacattctcagtttatgagattatgtgcaagatcctcaaggtatgatcaatatgtagtcagtatttg

SEQ ID NO: 494 - DNA, 295 bp, Homo sapiens
  CDS 121..294
agaaggcctcaggggtggctgtgtagcaagatgagggaggtttggagccctgcataaagagaaggacgggaccacagctgactgctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccg

SEQ ID NO: 495 - DNA, 487 bp, Homo sapiens
  CDS 217..486
ctcaccctcctctctgatcgggcccaccccctggatctagcaccgcctcttccgcgtttcttcgggaaggagcgatctgcaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatgtgacaggaggaggaagaagaagcggaggggccgggccactgactccttgccaggaaagtttgaagatcatcgagaaacaagcagggcacagtcggagtagggtgtttcgagaggtggagacgctgtatcagtgtcagggaaacaagaacattttggagctgattgagttctttgaagatgacacaaggttttacttggtct

SEQ ID NO: 496 - DNA, 468 bp, Homo sapiens
  CDS 291..467
atcctctccacccgctcccaggggctggagtctggaaaaccacgcgggaggaggttgtggggatatggacgagcatccgaggcccccggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattc

SEQ ID NO: 497 - DNA, 481 bp, Homo sapiens
  CDS 189..479
  misc_feature 474: n=a, g, c or t
acttttcccggagcaagagggcgtcttcacgcaggcaccgagaagctcccactagtgtatgccttaatggtgccgctcttgtccgcgtctacgcttgggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggttgggtgggtgacgtagacgactactcgctgcacgggggctgcctggtcacgcgcggcaccaagtggattgccaacaactggattaatgtggaccccagccgagcgcggcaagcctgttccaacaggagatggcccgccttgcccgagaagggggcacgactcacagcccgagtgggctctggaccgggcctaccgcgatgcgcgcgtggaactctgagggaangagttag

SEQ ID NO: 498 - DNA, 296 bp, Homo sapiens
  CDS 127..294
atatttttaataggatccgcagacacccaaaggagaagcttggtcttttccaggtatttccaacttgatttcaacccaaagcctttgaaaggaatgcattaccacatgaccacatgctgagaccccatgggtctaacacgggacctaagaaagtctctgcagccagatagtacatggtgtctccacaaaactaggcattctggagattgcccagaaagggatgtgaggggaccgttaaagatctgtcttgcttatctcatgcactcacattccttcagcctcctggagttcctgat

SEQ ID NO: 499 - DNA, 422 bp, Homo sapiens
  CDS 143..421
tgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggttttca

SEQ ID NO: 500 - DNA, 461 bp, Homo sapiens
  CDS 184..459
aaagcgttgttggcccggttgctctggagccgggtctcgggtctggtggctgccggccctgcggcatctcgccatggggagcacggagagcagcgagggccgcaggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatga

SEQ ID NO: 501 - DNA, 506 bp, Homo sapiens
  CDS 312..506
atctagggaagatgaacttaggaaaagtgatgcgaggagggtttaaggaaagccggcatcaaccttgtggccttagctggacaatgcttagtgacttctgaaaggacaaaccgtgcagaaatacaaggcatgacaatcataagtctttcttcaagaaatcsaaagtaatgactttactgctccatcctgcaatcaacagatactcagaaacagcccaaagatgaattacttagctaattctttggtattttctcgcaatcctctttttcattgtacatttcattttttaacagccattggtactgaaacttatgtttgcaaaagcaagagagttgattaataggtattttatacatctggtattttctcataaaagactagaaaacttatttcaattatcataccaccaacaaggatgcaatctgttcacaaggcctgtttacgagtggctgctttgggtaatggctgttttcttagcatgggaaatgaaatataatattattaat

SEQ ID NO: 502 - DNA, 427 bp, Homo sapiens
  CDS 109..426
taattaagttaaggatcttgagataaaatcatctttgattagggtgaccctaaatccaagtgtcctcagaagattaggtagaagactcaaaagagaggwgatgtagagatgaaaacatatcagagtgatgcatctacaaggcaaggaacastaaggatttccaacagstaccagaagcwaggagataggcagctatwcggattctcctcagggcctctagaaggaaccaaccctgtcaacaccttgattttggacttctggcctccacacctgagagaatatatttctgttgttttaagctacctggtttgtagtcattgttacagmagtccttatgasaccctagaaaccaacatagcccctatgacaccstctctcctaactacccccaccttctgtgataatgaacatgcccgggstgggcctt

SEQ ID NO: 503 - DNA, 481 bp, Homo sapiens
  CDS 263..481
aatctgttcgtcctcctccaggtggcttcctgtttgaagggctctcagatgatgaggatgactttcacccaaacaccaggtccacaccctctagcagtactcccagctcccgcccagcctccctggggtacagtggagctgctgggccccggccatcacccagagtgagctggccaccgmsttggccctggccagcactccggagagcagctctcacacaccgactcctggcacccagggtcattcctcagggacctcaccaatgtcctctggtgtccagtcagggacgcccgtcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcagggcaccggtggggacatccaagcagccctggagctcatcttt

SEQ ID NO: 504 - DNA, 489 bp, Homo sapiens
  CDS 190..489
aggggcacttgatgggaatcatggcagcatccaggccattgtcccgcttctgggagtggggaaagaacatcgtctgcgtggggaggaactacgcggaccacgtcagggagatgcgcagcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgagtccccgaggcygcggccatggactacgtgggcggctatgcctgtgcctggatatgaccgcccgggacgtgcagracgagtgcaagaagaaggggctgccctggactctggcgaagagcttcacggcgtcctgcccggtcagcgcgttcgtgcccaaggagaaagatccctgaccctcacaagctggaagctctggctcaaggtcaacggcgaactcagacaaggaggg

SEQ ID NO: 505 - DNA, 502 bp, Homo sapiens
  CDS 147..500
acaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaacaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaaca

SEQ ID NO: 506 - DNA, 458 bp, Homo sapiens
  CDS 52..456
aaggcccgcgctgggaaaaaggtggggggacaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacgtgcctcttgccttccgccatgattgtgaggcctccccagccgcgtggaaatggtatcagcatggaagccatgagtcagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcatt

SEQ ID NO: 507 - DNA, 502 bp, Homo sapiens
  CDS 334..501
tttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggastgggcttggttcccaggtcacagtttggcccccgctacaggatgctgccctgctcagagagagatttaatagggagctgaaggaatcgttagggggccagggagatgtgactgaggctggctttccacgtgaatgagacgggtcggtggagggtttggtgctacagccagtcagaagatttgcaaatgcgaacacattcctgtgtgaggcacgttaccctdmtgtcagttgttgtgaatatgtgtattttaagcaataagattcagctggtcagacttttctgggcagtctcagtgacgcatttcctgtgctgtgattgttctgaagacagagtggctctaaccactgtgagaa

SEQ ID NO: 508 - DNA, 473 bp, Homo sapiens
  CDS 271..471
tttccttgagcagtggttcgtagttctctttgaagaggtccttcacatcccttgtaagttgtattcctaggtattttattctctttgtagcaattgtgaatgggagttcactcatgatttggctctctgtttgtctgttattggaagcactaaacatggaaagaaacaactggtaccagccactgcaaaaacataccaaaatgtaaagaccatcgacaattatgaagaaactgcatcaattaatgggcaaaataactaggtagtgtcataatgacagcatcaaattcacacataacaatattaaccttaaatgtgaacaggctaaatgccctaattaaaagacatagactggcaaattggataaagagtcaagacccattggtgtgctgttttcaagagacccatctcacatgcaaagacacacataggctcaaaataaagggctggaagaagatttaccaagcaaatgttaa

SEQ ID NO: 509 - DNA, 469 bp, Homo sapiens
  CDS 272..469
ccttagaaatattctcttaggtttggtctcttttccattccaagcagagtagcctgggcagtagccttggtgtgctctgaactcctggacctcaattgcccatcactgagtgtcgtcgaaccttgtagttaacgaggttcgactttgtgcaggcgcgtggagttctgaacgtccacaccgtttcccctactgttctgtaactgcttctgagcgcagggactgggtctttttccttctgccaaaaaccctctcagcgccagtctcttgggaaatgctcaccaaatgcttgaatgaaaaacagaaccaagcacgaggctgggctgcatcgcatcccgtgatgtggaatgtgcattttctaagatttctgggaaggaagtacttaaggaaggctaagtggaagcgttgggagttggtctctgaagtgggagtaggatttggatatacaaaatgtgagactaggagctctcac

SEQ ID NO: 510 - DNA, 486 bp, Homo sapiens
  CDS 106..486
gaaaaaaaaaastgtttgttagcgtgacgtgcgtgaggagtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccggcacattca

SEQ ID NO: 511 - DNA, 205 bp, Homo sapiens
  CDS 25..204
  misc_feature 50: n=a, g, c or t
ccctaggagcccagcgccgccgccatgtcctccggggctagcgcgasgcncctgcagcgcttggtagagcagctcaagttggaggctggcgtggagaggatcaaggtctctcaggcagctgcagagcttcaacagtactgtatgcagaatgcctgcaagatgccctgctggtgggtgttccagctggaagtaaccccttccggga

SEQ ID NO: 512 - DNA, 318 bp, Homo sapiens
  CDS 130..318
ttctttktgcctccttcgcggagtcacaagatctcttcgcagcctcctttcggatccttccgcccggccccgcccccctccataaaaaccctccttactttttttctcgtccaacccacatcgtcagttatgagtggaagagcctcttccttccggcggggctgccgagcgcggccgtctatccttcctttcgagaaggaggggaggtccggaggggactctttttcgtggcggaggcgccgtcggcttggcctttcacgacgggggaggtgctgtacgtccaagatggcggcgcctgtaagctggarggactgtgag

SEQ ID NO: 513 - DNA, 470 bp, Homo sapiens
  CDS 169..468
attctgctgctgtccataataagggctcgtccacctcccttcctcttctgcccattgagcagtcaaagaactgaaagtccttataagcctgtgcacctgggcctgggcctacagataaggtagctgctattgctatggcccgcatcattgacctggtgccctgggacgatggctccacacatgtgtatgcctccccggccatcctgcttcccatggagcggcassaaccagctggcgggcgtgaagcagcagctctaccdcccagccctgcccaccctgcgccacatggacagggacaccgtcaaggcctgccttcctgatgagcactgccagtccaccacctactgccgcaaagatgaatttgacaacgcccattttacactccttggggtccccaacaaacccctgcagtgtttggacatcaccgccacaggccagaagcttcgcaacaggtaccacgagggaaagct

SEQ ID NO: 514 - DNA, 453 bp, Homo sapiens
  CDS 259..453
acaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccagagtgctccaatgagcctttcccctgagtgtcacatctgtattggcactcaaaaagtttcatattttggagcatttcagatttcagatttgggatgcttcatctatattgacagctgc

SEQ ID NO: 515 - DNA, 480 bp, Homo sapiens
  CDS 296..478
aagattggatattaagtataaatcagctctctgtgtatgtccttgtgtggtggtataactgacaacaggtagggttcctgatgggattgggttccaccaatcagagccacttgcatgagacctcaactgagagccaggatgtcatctccaccagaacaaggactacgttttgtatgttgctgttccgttagtgccagaacatgcccacccctgctcagtaaataagcgttaagtgaatgaattaataagtgaaaggctgtgtttgaagaggaggggctcactctaaatcttgaagatgttcagcctcgaaaaagtagaagtcattgtgaccaaagatgatgccaccatgcctttgaaaaagaaaggtgatgagcctcaaatggaaaaatacattcaagaaaggtcaatgctagtgagtatgaatgaacacatagcaaaaatttcaggtagaacagccatgccaagggctggtgggacagg

SEQ ID NO: 516 - DNA, 496 bp, Homo sapiens
  CDS 88..495
ggagtttcctcctcatttgactgatgtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggata

SEQ ID NO: 517 - DNA, 478 bp, Homo sapiens
  CDS 226..477
aacatttattagacacatgatagggaaagttggttaagggccttgaagaacaggcaaaggatgtggaattcatgtttttgagctctagatgatatgatgaaaattgtggttgaggattatttttctgatcttgaggaaattcaagtttgaatgatgaggatgaatgaggttaatcaacactgaaattggaatcaaaggcaaattcaaggccgggcgcggtggttcatgcctgtaatcccagcgctttgggaggccgaggtgggcgaatcgcctgaggtcaggaattcgagacctgcttggccgacatggcggggccccatctctactgaaaatacaaaaattagccaggtgtggtggcacacgcttgtaatcccagctacttgggaggctaaggcaggagaatcacttgatcccgggaggtggaggttcagtgagcctggatcgcaccattgcactccagtctgggcaagaagagtga

SEQ ID NO: 518 - DNA, 458 bp, Homo sapiens
  CDS 267..458
catcagttcataattcactttgatggttttcattacaagtgtatgcttatgcctcccaaacttataagtagttatatataaagagaggagggcaaagcagatacttggttactggaaaatttgagggtagagggaaagagcgtgtaaggaaagctggaaggccacagagatcctagtcaatagaagctggggtcatctggtaaaccgaggatgagagggagtttggaggaaagtcagtagtttccgttgctgcggagaagtcaagtatgttaatagcagagaaatatctattgattttggcaaagacgattactgaagagtggtggggtcaaaattcaattaacacagggattttaagtggaacagcaggaggtggggaaagcacagattgctgtttcccaaagtctactgtaagtagaggagcagtggatagagaaggagatggtcaaagagatggg

SEQ ID NO: 519 - DNA, 560 bp, Homo sapiens
  CDS 24..560
  misc_feature 103: n=a, g, c or t
acctttaccgcacgccgacaaggatggcgtcgtggtcgtcgccctcatccgccgccgccgcctcgggcgcccgattcggccccttcccgagccgagcgcagancrtcgtgccgtatccgtcgctcgcccgcggaacccccgcctcgacgctcgtcctcaggccccacccggacggccgtggccatggcctcctcgcgcacaccggctcctcttcctcgcggtgccgcgccgtcgccgccgaggtcgagggcctcaacatcgccaaccacgtcagccagctcatcggcaagacaccaatggtatatctcaacaatgtcgtcaagggctctgtcgccaatgttgctgctaagcttgagattatggagccctgttgtagcgtcaaggacaggatagggtacagtatgataaatgatgctgaacagaagggcttgattactcctggaaagagtgttttagtggaagctacaagtggaaatacaggcattggtcttgcctttattgctgcttccaaaggatataagttgatattaacaatgccttcatcaatgagcatggagaga

SEQ ID NO: 520 - DNA, 465 bp, Homo sapiens
  CDS 93..464
acagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggc

SEQ ID NO: 521 - DNA, 479 bp, Homo sapiens
  CDS 290..478
gtttccggccgaggctgcggcatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcc

SEQ ID NO: 522 - DNA, 278 bp, Homo sapiens
  CDS 94..276
attaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgacccgaggcctagatcgatcattagaagagaatctttgctacagagatttctgacacctgaaatgattcttcacatccctgagaaaggtcaaagttacaaactgattttttttttttt

SEQ ID NO: 523 - DNA, 417 bp, Homo sapiens
  CDS 105..416
ataaatttctgcctagtcaaagttaagagtggcgccagggatttgaaccgcgctgacgaakttggtgatccatcttccgagtatcgccgggatttcgaatcgcgatgatcatcccctctctagaggagctggactccctcaagtacagtgacctgcagaacttagccaagagtctgggtctccgggccaacctgagggcagacaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatc

SEQ ID NO: 524 - DNA, 466 bp, Homo sapiens
  CDS 288..464
aatgccatttaaagggcctttgattaatatgcaaacttagttacaaattttgttaatattggcttttataaaataaaatgtaatttattttctttgtaagtactccaattatctagcaaataggcattcctgattacttaaagaactcttgaaaatccagtgagttaaatttataaatatggtgaatcataaatatatcttgaaagttccagcattatagaaaaccaaatacttaatgttctcacttataagtggaaactaaagattgagtacatgtggacacaaagatggcatcagcagatactgggacctgcttgagggtggagggtggaaggagagtgagggtcaaaaaactacctatcaggcctggtgcagtggctcacgcctgtggtcccagcactttgggaggccaaggcagcgaatcatctgaggtcaggagttcgagaccagcctgggcgacagagcg

SEQ ID NO: 525 - DNA, 469 bp, Homo sapiens
  CDS 1..468
atgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaact

SEQ ID NO: 526 - DNA, 460 bp, Homo sapiens
  CDS 157..459
mcttctgttgggcgtttctgctgagaggcgggaggcgccgagagtctgtgcgaaggtccgtggacagactgctttgcctgttgttgctcttcggaggcggcgatccccgaagcgagctgaaatacggctgcaggctacaatttgcagccgaccrttatggrtgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacagghaggaaaggctcagccgcacctgggatgtggaaaccttggcaggggcgagcacccaggtcattttcacaagcagcaaaacaaaaacaaaacttcagctggtttccaatcactcac

SEQ ID NO: 527 - DNA, 483 bp, Homo sapiens
  CDS 71..481
aatttttggacttgctaggacagtgataagggccttgggtacaaaatgctcctgattctggtgtagctccatggcgagtcagaacactgaacaggaatatgaagccaagctggccccatctgttggtggagagccaacaagcgggggcccatctggttcttcacctgatccaaatccagattcaagcgaggttttggacaggcacgaggaccaagccatgagccaagatccaggctcccaagataactcaccaccagaagaccgaaaccaacgcgtggtcaacgtggaagacaaccacaacctttttaggctctccttcccaagaaagctttggacgattgtggaggaagacacattcaagtctgtgagctggaacgatgatggagacgccgtgatcatcgacaaggatctcttccagagggaggttcttcaacggaaaggtgcagagaggatcttcaaaacagrcaacttgacgagtttcat

SEQ ID NO: 528 - DNA, 457 bp, Homo sapiens
  CDS 207..455
  misc_feature 367: n=a, g, c or t
cttttagtggagcataacagttaggagatagaatctgggtggtgcaagtggcatgaagaaaaagatattctcttctgtgctttastgtttgcaagaagattgcgtactgcatcagtaattctctggccactctctttggaatccagctcacagaggctcatgtaccactacaagattatgaggccagcaatagtgtgacacccaaaatggttgtattggatgcagggcgttaccagaagctaagggttgggagttcaggattctctcatttcaactcttctaatgaggaacaaagatcaaacacacccattggtgactacccatctagggcaaaaatttctggccaaaacagcagcgttcggggaanaggaattacccgcttactagagagcatttccaattcttccagcaatatccacaaattctccaactgtgacacttcactctcaccttacat

SEQ ID NO: 529 - DNA, 495 bp, Homo sapiens
  CDS 242..493
aaaatggccttaggcgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgtgcacgtcccagtatgcccactctgtaatacccccatcccagtaaaaaagggccagataccagacgtggtggttggtgatcacattgasagagactgtga

SEQ ID NO: 530 - DNA, 474 bp, Homo sapiens
  CDS 209..472
ataattaatcagcggttattcggtgagcggtggtggtttattcttccgtggagttaagggctccgtggacatctcaggtcttcagggtcttccatctggaactatataaagttcagaaaacatgtctcgaagataactccaggaccactatattttctccagaaggtcgcytatacsaagttgaatatgccatggaagctattgggacatgcaggcacgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaaca

SEQ ID NO: 531 - DNA, 467 bp, Homo sapiens
  CDS 306..467
agtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtgggaggc

SEQ ID NO: 532 - DNA, 487 bp, Homo sapiens
  CDS 104..487
aatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgac

SEQ ID NO: 533 - DNA, 491 bp, Homo sapiens
  CDS 331..489
atagcgtctcagggtgttggttgagtaccacagaaacagagatgcatgttctctacatgctggaasagtcatcctgttgctaaggaaacagcctcactcagcaagggtcacctttggaaacaacggtaccatgtgaaggcctgggcatataacatgaaacaagaaagataaggcccgtgcttacatagaacttggtgaagaatctagaccataacaagcacacagagaaaacgtatcacaaattgtgctaaagttctgtaaagggattaagatgaagtgtcacaagactgaattagacagagtgcccttgaaagagtgccaatttttagaatggagggtgtagatccatcctttgcaactggtgaggacctcctcagtaaggcactaagccaggagtctatacagccatgccaacagcctagtccaaagacgtttacatcctggaagagaacttgctggcttttcacctcagcatgtattgggcaaactaa

SEQ ID NO: 534 - DNA, 193 bp, Homo sapiens
  CDS 7..192
cccgccatggctctgargcgcgccctgcccgcgctgcgcccctgcattccccgcttcgtccagctgtccacggcgccggcctcccgcgagcagcccgcagcgggcccagcggccgtgccaggaggtgggtcggccacggcagtgcggccgccggtgcmcgcmgtggacttmggcaacgcgcaggaggcgtacm

SEQ ID NO: 535 - DNA, 395 bp, Homo sapiens
  CDS 105..395
attccataatactcgtagtggttcttctttcctgactgagctttgactgccacagtccttgcagacagagtcttgttctgttacccaggctgaagtgcagtggtatgatctcagctcactgcaaccttgaactcctgaacagcaatcctctttcctcagcctcacaagtaactaggactacaggtgtgcatcatcacacccagctgatttttaaatcgtttgtagagacagggtcttgctacgttgtccagcctagtctggcctccagcaattctcctgcctttgactcccaaagtgctgggactataagcatacaccaccacacccagtcaagagagttctgtcatacaaagattagaggttcaccaaaaacggctactacatcttattgtttt

SEQ ID NO: 536 - DNA, 504 bp, Homo sapiens
  CDS 248..502
aaaaatcggatgcttcaagttccaggcataacctgggagatcagaaacgccctcagaaatggggttggttttcctctgaggaactgagaccctcttccaagacatgcgggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacct

SEQ ID NO: 537 - DNA, 501 bp, Homo sapiens
  CDS 232..501
atattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgtttttwttttgtwtttttttttttgagatggagtcttgctctatcgtccaggctggagtgcagtgtcacgatcttggctcactgcaacccccgcctcctgggttcaagctattctcctgcctcagcctcccgagtagctgggactac

SEQ ID NO: 538 - DNA, 225 bp, Homo sapiens
  CDS 43..225
  misc_feature 155: n=a, g, c or t
ttttcagcagcagcggtagagcagtgaccaggcgtctccgcgatgggccccggggacttccgccgctgcagagagagaatttcccargggctccagggactcccaggtagagcggactttggttcccacctcgtcccgcgtgcgacttcttcrgnracggcaggagcacggacatccaggakgargccctcrccgccagcmcgctgctggadgacctcagacgam

SEQ ID NO: 539 - DNA, 401 bp, Homo sapiens
  CDS 177..401
acgtggaaattcaggctgtgacatcaaaacgtcaccccccaggagagcgagtctattctgtgccattcagactccagtcagccttattggttccagccagtttcagccagtcagccagttttgttgcaagcagagagaattataacaagctgtttcttcgtctgtcttcttgcaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacagggctgcacgacga

SEQ ID NO: 540 - DNA, 472 bp, Homo sapiens
  CDS 272..472
  misc_feature 445: n=a, g, c or t
ttccctttcgaattccagggtatatctgggaggccggagacgtgtctggttattacacagatgcacagctggacgtgggatccacacagctcagaacagttggatcttgctcagtctctgtcagaggaagatcccttggacaagaggacsctgccttggtgtgagagtgagggaagargaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaangcttgcaagtcacatggtcatgaagga

SEQ ID NO: 541 - DNA, 452 bp, Homo sapiens
  CDS 20..451
agagggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtggg

SEQ ID NO: 542 - DNA, 506 bp, Homo sapiens
  CDS 185..505
attcctcgccaccgctaccgctgcctgcgcgctactgcctttgcctgcgtgctcattgtcagcgttgcccgccatggccaccgcccggctgtagcaggtgcgccacagctaccacaccaactgcgaggccgccatcaacagccacatcgacctggagttccacgcctcctatgtgtacctgtccatggctttctactttgaacgggatgacgtggccctggagcactttggccgctacttcctgcaccaatcagacgagaagatggagcatgcccaggagctgatgaggctgcagaaccagcgcagtggccgcatctgccttcatgacatcagggagccagagcgccaaggctggcagagcgggctcgaggccatggagtgtgccttccacctggagaagagcatcaactacagcctcctggagctgcaccagctggccttggagaagggcgagcccagctgtgcgacttcctggagagccactaccttacaccaacaggtcaaga

SEQ ID NO: 543 - DNA, 469 bp, Homo sapiens
  CDS 260..469
taagatacatacagtggcagattttctaaacatagaaagggagttcacatgctacatggtcaaaaataaaactgatacatgtccatttcattattcaataaatatttgtcagatgagtgaatgagagaatcagagtcatgatttcctgtctctagacctttaagtcaccaaacattgaagtgataatggtgttgctaatgtaattgaaaataaaatcgaaggagcaagctatggaggggaacagggatgaagctgagaaatgtgtcgacatcgtccaggaggctctgagtgctggcaaccgcgagaaggcccagcgtttcctgcagaaggccgagaagctctacccactgcccttggcctgcgcataaacaaatataaaaattactatgaagtacttggagttacgaaagatagtggtgatgaagatttgaaaamagcttatagaaagcttgctttgaagtttcatcca

SEQ ID NO: 544 - DNA, 490 bp, Homo sapiens
  CDS 291..488
cggtttctgcgcggtgcgaacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgctcgcgttgattccataatgagatggcatcaacatcagataaaggtgcccaaggaagaaatgacaagaaagattctcaaggaagaagtaataaggcattacatctgaagagtgatgctgaatttaaaaagatatttggccktactaaggatttgagagtgtgccttactcgaattcctgaccatttgacctctggagaaggttcgattcctttagcagtttg

SEQ ID NO: 545 - DNA, 467 bp, Homo sapiens
  CDS 282..467
ttatattataaagctacagcaattaagctaaggtattattggcgtaaaagtagacaaaagtgtcaatggaatggaatagaaagttcagaaatacacccacacttatatgggcaattaattttcaacaaagatacagagtcaattgagtggagagaggctagtctagtcaataaattgtgctgtaascgggctcagtggctcatgcctgttatcccagcactttgggaagccaaggtgggtgaatcttccgaggtcaggagttccagaccagcctggccaacatgacgaaaccccatctctacaaaaatacaaaaattaactgggcatggtggcctgtgcctgtagtcctagctactcaggaggctgaggtaggggaatcacttgaaccaggagatggaggttgcagtgagccaagatcacgccattgcaatccagtctgggtgacagagcgggactccatctcaaaa

SEQ ID NO: 546 - DNA, 454 bp, Homo sapiens
  CDS 228..452
ttaccctagatgttcccaccttcagtgctccacgccctccatagaccttcagagaaggtgaaacaggttatctgggaatctttccagcccgcagtcgssacggcsatccctttgctcscagcctggctccatcagcctccagcttcctttcttcattctgtcacttcagggaaggcagaagaaacattggaaagcatctagtccagtgggaagccaggggttggagaatgtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaagaggaggaggctctccactgtccaccctaacacataccctcccaacccaccttccagacccccttggttggca

SEQ ID NO: 547 - DNA, 485 bp, Homo sapiens
  CDS 155..484
  misc_feature 435: n=a, g, c or t
aaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtanaaatgtgataataaaagaaaattttgccttggagtgctccccagcctttc

SEQ ID NO: 548 - DNA, 526 bp, Homo sapiens
  CDS 344..526
  misc_feature 41: n=a, g, c or t
gcgaagtcaaactgttgctgtttgctgatgatgtaatcatntacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggraaactwcaaaacactkgsytggaaaraattcwtggktgvcmcaamcaaatggaaacacatcgcatgctcatggatgggtagaatcaatattgtgaaaatgaccatactgcgaaaagcaatccacagattcaatgcaattcccaccaaaacaccaccatcattcttcacagaactagaaaaaacaatcctaaaattcatgtggaaccaaaaaagagtctgcatagccaaaacaagactaagcaaaaaaaaaaaaaag

SEQ ID NO: 549 - DNA, 484 bp, Homo sapiens
  CDS 251..484
ttcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaactcgtctttactaaaaatacaaaaacaaaaattagccaggggtggtggtatgcacctgcagtcccagcaacatgggaggctgaacagcagaatcgcttgaacccgcgacagggaggttgtgatgagccaaggtcatgcsactgcactccagcctggggagacagagcaagactccatctcaaaaacaaaaacaaaacaaaacaacaacaaaaaaagaagttaaat

SEQ ID NO: 550 - DNA, 457 bp, Homo sapiens
  CDS 283..456
ttatattataaagctacagcaattaagctaaggtattattggcgtaaaagtagacaaaagtgtcaatggaatggaaatagaaagttcagaaatacacccacacttatatgggcaattaattttcaacaaagatacagagtcaattgagtggagagaggctagtctagtcaataaattgtgctgtaascgggctcagtggctcatgcctgttatcccagcactttgggaagccaaggtgggtgaatcttccgaggtcaggagttccagaccagcctggccaacatgacgaaaccccatctctacaaaaatacaaaaattaactgggcatggtggcctgtgcctgtagtcctagctactcaggaggctgaggtaggggaatcacttgaaccaggagatggaggttgcagtgagccaagatcacgccattgcaatccagtctgggtgacagagcgggact

SEQ ID NO: 551 - DNA, 527 bp, Homo sapiens
  CDS 154..525
  misc_feature 18..19: n=a, g, c or t
cacagaaagssaagcacnncactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacargctagaaaaaaatgctactgacaatataaggcaagcttttccagc

SEQ ID NO: 552 - DNA, 459 bp, Homo sapiens
  CDS 177..458
atcagctcgccgcgcrmggctgtatttgcggcctgtgcgagtaggcgcttgggcactcagtctccctggcgagcgacgggcagaaatctcgaaccagtggagcgcactcgtaacctggatcccagaaggtctcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacattt

SEQ ID NO: 553 - DNA, 513 bp, Homo sapiens
  CDS 287..511
  misc_feature 468: n=a, g, c or t
agtggggcaggccactaggcsaactaaaacgtggtcccgatatctctgcaaggaccccttgtatctcggagtggtgggagcagagaggtgagccggcagatgggagggcaagacttaacctcagatctgtaaaagtaacaagtcaacaataccttaatcttcactgtaagctactatctactgctatctactgcacataatatttatagtacatctgttcctctttagcttatgaaaaaagattacagagtatgacttaaatggaagaaaatctacattttaawttatgcaccagraacaakgtcagttttctttgkcaaaaatagtcagcagaggggagctcaacactgctgctgttcgaaatggctttacttatgcacttgtctcatcccagccaccaacagccaccaacagcccccagcaagaagactaccggagaagaagccaaacttcctgtccccacatgkntacaaaggagcttgtccactccacgcctggcaaaaaatgtcacra

SEQ ID NO: 554 - DNA, 463 bp, Homo sapiens
  CDS 130..462
  misc_feature 126..127: n=a, g, c or t
ccgggcgggtgcctggagccgccagagtttccgcacccgggaggaagatgcggccggggctcaggctccttgcagattcctaaccagcataatgctggagccgggaaccaccaacctgcagttttnngaatggccgtgttggacactgatttggatcacattcttccatcttctgttcttcmtccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggsttccaccccgtggctttcacgtggtcaacat

SEQ ID NO: 555 - DNA, 232 bp, Homo sapiens
  CDS 36..230
agagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaa

SEQ ID NO: 556 - DNA, 491 bp, Homo sapiens
  CDS 287..490
gaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagatttgaaaacaatttgtagccaacttcagtatgaatcaaagcattgttttaaaaggaaagattccttctgacattaaattgcattttccaagaaccagcaacatcaaccatccagactttaattatggaatcacaggtgcaatgcgtatctcctcagtagaggacaggaagatttgtgtgactgggactttatggatttggcatctcctgcaagatgtgtgtccaactcctggga

SEQ ID NO: 557 - DNA, 474 bp, Homo sapiens
  CDS 164..472
acacgtggtacggaaccggcgccgcgcttgctgstggtaacagggccttgctagtgggccttccttcccaggtcgcccctcactctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctctgacccacagaagaagaccgtgtgcatttacgggcactggatgtgcagcct

SEQ ID NO: 558 - DNA, 471 bp, Homo sapiens
  CDS 252..470
caagttaccagaaaaagtagcaaaacatgttacgttggttcgagagagtggctccttaacttattaagaatttcttgggagagtagctgagcttaatgatgtaacggctaaagtggcttctggccaggaaaaacatcttctctttgaggtacaacctgggtctgattcctactgcttttwggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggsgggctgacctcatcctgccttgtgctc

SEQ ID NO: 559 - DNA, 384 bp, Homo sapiens
  CDS 216..383
tccgtttttatctgttatagattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtggtaagttcagttttaataattgctataaacgagaaaatggctcatggacattcatagattattgtttatgcttttcatgacattagactatatttttctcacctgcttttatagatatatagttttatatatctataaaagttgtatgcttttagctcttatatctgtaaatcatttcaagctaattgtgtatagtgtgaaggggcaattgt

SEQ ID NO: 560 - DNA, 470 bp, Homo sapiens
  CDS 293..469
ctttcagaatgcagaatcagggagacagagggggcctggtccatctgtgtctgccccaccaaccaccataactgtgttggctccttctatacacccacttcaccacccttctcttcaccagcccttcgcatcatgtgacccaccgatgaagagggctggggctgccacagggaatggatgaaatccagactccaggaggatgtgatgatagaacgatctggacacagcgaatgaacacagacttcggtggtggagggttgaggctggaactctgctccagcacttgccaggcatggccttgagtacagtgctgtgctacctcacctctaaaaacgaggatcatcagaggcttgtcggtcagttctttaaatgtcattatgtgaagaatttaaatttagcacagtccttagctcgtaagaagtctccaataaattactacggtcattatcagtataaaaaaaaaaaaaaaa

SEQ ID NO: 561 - DNA, 504 bp, Homo sapiens
  CDS 91..504
gtcataaatggagcgacgtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtaca

SEQ ID NO: 562 - DNA, 488 bp, Homo sapiens
  CDS 222..488
ggagtaggtggaatatcctggggagaggaagtttggtcgttgggcagcggccgactttcctctcaggaaattgatactttatcaacatagagattaattatttgtatttgggagcagcagaactggggaccaattacctgtcaagagttttataaacccgtgacataaactgttattccattgctttcatcctccatctcaccttggaacttgtattacttatggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagtt

SEQ ID NO: 563 - DNA, 469 bp, Homo sapiens
  CDS 151..468
attttctggaatctttcgcccccggaaggcagcggcgggcgcctgtgtggaaagtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccggtctaccctttgatgacagggactcaaaccatacctcagaggggaatggcgactctttgttagctgatgaagacactgactttgaagacagcttgaatcgcaatgtgaagagagcagcaaaacgaccaccgaaaacaacaccggtggcaaaacatccaaagaaagggtcccgagtggtacatcgtcatagccggaaacagtcagagccaccagccaatgatcttttcaatgcygtgaaagccgcca

SEQ ID NO: 564 - DNA, 481 bp, Homo sapiens
  CDS 297..479
gtcgccgggtgtgcagcggcgtcgcggccagtagagggattctgggtaacggcccggacccccggctgggcttctggctcggcgcasaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacg

SEQ ID NO: 565 - DNA, 492 bp, Homo sapiens
  CDS 297..491
  misc_feature 486,489: n=a, g, c or t
gtcgccgggtgtgcagcggcgtcgcggccagtagagggattctgggtaacggcccggacccccggctgggcttctggctcggcgcasaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaanaanast

SEQ ID NO: 566 - DNA, 509 bp, Homo sapiens
  CDS 74..508
aggaaagagggtgcctcggtgggagagacccagcttttcgcgttagtaggcccgagcagtttgaactggagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaacagagacatttccagcaatgaaagataatttgcctccagttcgtggttcaaacagctgtcttcatgtaggcaaggaaaaatatt

SEQ ID NO: 567 - DNA, 479 bp, Homo sapiens
  CDS 94..477
caatgatatcaatgaagatgattttggtgattttggtgactttggctctgcagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgatgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttc

SEQ ID NO: 568 - DNA, 468 bp, Homo sapiens
  CDS 308..466
tttaagaaatacatttcataaggctatagctacatagatagtgatttctgtaacgcatctgggcaaagtaaattgaaaactttctggaaacgatttgccattctagataccattaagaacatttgtaattcatgggaagtcaaaataccaagatttacaggagtttggaagaagttgattccggcaaccctcatggatgacttggaggggttcaagactttagtggaggaaccaactgaagatgtggtataaataacaggagaattagaagtggagcctgaaaatgtgattgaatttttgcaatctcatgatcaaacttcaacagatgaggggttattacttatggatgagcaaagaaggtggtgaagatgctgtgaacattggtgaaatgacaacaaaggatttagaatattacatcaacttagttgataaagcagtgtcagggtttgagagaattgactccagttt

SEQ ID NO: 569 - DNA, 375 bp, Homo sapiens
  CDS 135..374
gtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagg

SEQ ID NO: 570 - DNA, 486 bp, Homo sapiens
  CDS 307..486
agaatatttaggattccatagctatgcacaggttttactctctgccttgaattgctttctcattctgatatggtttggctgtgtccccacagaaatctcatcttgaattgtagctccggtaattccaggtgttgtggaagggaatcagtggcagataattgaatcatgggggcggttcccccatactgttctcgtggtagtgaataagtctcgccagaccatcttcttttataaagagaaaccccttctgcttgattctgagtctctcttgccatcacctcgtgaggtgtgtcttcgctttctgtcatgattatgaggcttccccagccacgtggaactacacccagtggtgctcaccctagtgagtttcagagccaccacccctccagtggattcccggtgatttccacatttcagcatctccctgtaggcagtcatctttttcctggttctccagtgggcagagactcattgggtccacagcgt

SEQ ID NO: 571 - DNA, 601 bp, Homo sapiens
  CDS 176..601
agagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacagacttccaca

SEQ ID NO: 572 - DNA, 253 bp, Homo sapiens
  CDS 99..251
  misc_feature 153,166,190,253: n=a, g, c or t
agaatctgacattccaggactccactaggcctgttttcctctgtgggaactagagccaaggcgagagacccgtgccagccccgaggctcccggggcccatgggccaggcggggctggtacagggccccggggctctctcagcccatctgtcanccctcccccccgnaacccagatgtcccgtcttggcantgctgtcccggactgccacattaatgctccagaacccgccagctgggccctggggcggtgggn

SEQ ID NO: 573 - DNA, 496 bp, Homo sapiens
  CDS 343..495
ttttaaaaatattatctgagttcttcctttttaggaaggactagtttttttaaccagtccactgttattcatacacttgggttttacagtctttgaaacattatgaataatagtgttataagtatccttaagtataaatctggtgtataaccagagtcctggaagaagcattgctatgtcagaagacagacttaggtacttaccaacctttgggataggtaaacacacatacataccactaccacggctatcactaccagaaaagaagttcgacccagcttatactcaaagcctgagtgtatagcttttaaaaatagttatactgtccaggcgcggtggctcatgtctgtaatcccatcactttgggaagctgaggtgggtgggtcttatgagtccaggagttcgaggccatcctgggccatgtggggaaaccccatctctacaaaaagtgcaagaattagccgggcgtggtgttgtgtacctgtggtctcagctt

SEQ ID NO: 574 - DNA, 496 bp, Homo sapiens
  CDS 133..495
gctttcggcgtcggcctaggtgcgctgcgagcgcgcgcggaccgssacaggcggcggagcggtatgggcccgcctgrccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgcca

SEQ ID NO: 575 - DNA, 449 bp, Homo sapiens
  CDS 51..449
agaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagacacaggagggacttcttaaaaatattcaggtctcacatcaggaattttcgaaaatgaagcaatctaataatgaagctaacttaagaaaagaagttttgaagaatttagctactgcatatgacaactttgttgaacttgtagctaattcgaaggaagacacaaagttttacaatgagttgactgaaatcctggtcaggttccagaacaaatgcagcgatatagttttggcatggaagacagaaagagatgaactcttaaagcctgagaactgggag

SEQ ID NO: 576 - DNA, 451 bp, Homo sapiens
  CDS 149..451
gatggtacttagaggatgtagggccctacgtattagggcttcttagttgtagcgaagagcaattggtctggaactcaacagaggcaattattatcccgactgcaaatcgacccagtaatggcagaaactctgcagaagtcaagctgagatgagtgaactgagtgtggcacagaaaccagaaaaacttttggagcgctgcaagtactggcctgcttgtaaaaatggggatgagtgtgcctaccatcaccccatctcaccctgcaaagccttccccaattgtaaatttgctgaaaaatgtttgtttgttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccct

SEQ ID NO: 577 - DNA, 507 bp, Homo sapiens
  CDS 130..507
attccgctgtaacagcttccggcgggtcctggatgttgatgtcctgcatctaacgcggtgtaaccccgaagccgagcgagctccggagaatttcagtatctgctacggtaacttcatcagcccgccaagatggcgatgcaagcggccaagagggcgaacattcgactcccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaagggaggaacagttgaagcttctcaaggagaaatatggcatcaacacagatccacccaaaat

SEQ ID NO: 578 - DNA, 643 bp, Homo sapiens
  CDS 195..641
aacgttacatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaacctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacataga

SEQ ID NO: 579 - DNA, 510 bp, Homo sapiens
  CDS 191..508
ggatagttccagtggagaaagattagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttac

SEQ ID NO: 580 - DNA, 412 bp, Homo sapiens
  CDS 188..412
atcgaacggtgcagactgaagacgccctccgtcagcgacgccgtsaattggccatttgtcaattcttccttcaaggccggtgccgctttggagatcggtgctggaacgaacatcccggtgctaggggtgcaggaggaggacggcagcaaccgcagcagcagccttcagggaaggaattgtaaaagatatggaggtttgggaatcatcagggcagtggatgttttctgtttattcaccagtgaaaaagaaacctaatatttcagtacacaactccaaagaaaagcttcccaccatttggagtgataaactgaggaacagagagtgctggatatacaatgtgatgccacaggtcttccagactttttctttcaagcctggccggggtgaacaagtttggcaagtgtcggaccga

SEQ ID NO: 581 - DNA, 480 bp, Homo sapiens
  CDS 43..480
acacgcctgcaggtatggcgttctggtgtcagcgtgacagttatgcccgagagttcaccaccaccgtgtctcttgctgtcccgcggastgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcrccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcag

SEQ ID NO: 582 - DNA, 509 bp, Homo sapiens
  CDS 216..509
actgtctcccgcccacctcagccttcgggctaggttgagtgagggctcttgggttagttcctgttaggccccggccgggggagtaggttgaagtctcctaagatgcccggtgggctggggcacgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaaaaaaaaaaaaaaaaa

SEQ ID NO: 583 - DNA, 458 bp, Homo sapiens
  CDS 121..456
aggatagttcccttgacccacttcgtgtgggaatggaagtggctcatttcacttagcctgccactggccactcctcatgagacagagtgtgccagcaagggagtgtgggaactggagagaatgaaccctggacctggccactcttctctggcggaasaggttccgtgcgggccctacagcagcatccaagcccctgtcctctcggcacctgagttcttgtttggcatccaggaagaattaggtcacccacacggattgaaaggatatggacaacgaccagtctttccgttgtttaacgaaagcggcagttggattcctcccagaagtctacccaaggatccccagcgaaagggagccatagtccgaggctctggctgcctgcctgtttggagctttgatggcctcgaggtgagagataaaacaagctttacatggccaaatatgcatggatcaaacat

SEQ ID NO: 584 - DNA, 538 bp, Homo sapiens
  CDS 226..537
gtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttkcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctgg

SEQ ID NO: 585 - DNA, 513 bp, Homo sapiens
  CDS 202..513
cccttccccctctgtgggtcccgcgaggagactctcgggctttgagccaattgcaggtagcatggcccagggcttgattgaggtggagcgaaagttccttccagggcctggcacagaggagcggctgcaggagttggggggcacctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggartgcctggaagctggtgctcttgggagctgatgaagaggagccacagctcagggtggacttggatacagccgacttt

SEQ ID NO: 586 - DNA, 531 bp, Homo sapiens
  CDS 196..531
agaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaa

SEQ ID NO: 587 - DNA, 329 bp, Homo sapiens
  CDS 67..327
tctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactctgraagttttgcacaagcagtgtcaccam

SEQ ID NO: 588 - DNA, 491 bp, Homo sapiens
  CDS 183..491
catccaagggtgtccggtagctggcagctgtggcgtgggaggccgtggaggggacccgtcgtgacttaggcctcggggcagcgtgggagtcatcgtgttacccgggccccctctccagcttggagccctcccctcccggctgggacccgacacaggctcctgggaggcctctgcttgggtggatgactcatcgttttctcggcatccccgggctgaggaaatgttcaaggagacatggggcccttccttcagcaggccaggccctgactggatgctggcgagtcgagaaaaacacaatcgggcctccggcttgtctgaggacagccctcaggggtgtttccgagagcccctggcttccacagccttgcacagtcctcaagcaccctgcaagctgtgttatgaccccattctacaggttagcaaaccaaggcacaggctctgctgggcccccagctaagcaaccactgggtgccctcagtttcttcgtctgt

SEQ ID NO: 589 - DNA, 736 bp, Homo sapiens
  CDS 258..734
attgaggttccatctgtcttgcttgctccaagtcatctaatggctcttctgacgcttggaattaattctgccatggtcctagatttggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggagg

SEQ ID NO: 590 - DNA, 452 bp, Homo sapiens
  CDS 280..450
  misc_feature 132,134,136..137,141..142: n=a, g, c or t
aaccttattctatgctatgtgaaggcgtgaattaaatcatatttctctcctacatccaatatctcttaaatcccaattttgkktctctkcatctggacctcttagagtacttatkkgacaacaatcatagdnandnngkgnntctaattactttttatatgtttatatagtatataagaagattagatcatatgctgtataatttgtgtaaatttgtacacaataggcacttaataaattgtgctttattgaaattaaaaataaaattgacacttattaatgataagaaccttagagatcaaatggcccattttccagatgaccaaactgaggcccagtttctttaatgattctgccaaggtcaatctactagttacggacataactcagatttcaaaccatttcagtgacctatccaagaagaaatattttagaattgctgtcattagatt

SEQ ID NO: 591 - DNA, 523 bp, Homo sapiens
  CDS 138..521
tcttttttctctcctcacctgacggctcccctccgcgcctccgggggctccctcaggcctccccacggtcatttcagctggacagaggcagcagcgacagtgacagcgatagtggcagcagcggtggcagcgagastatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaagccctgataatgtttgataaggataatttagatgacatgcctatatcgtggagaatgatgtcatcatgcatgctctcactaaa

SEQ ID NO: 592 - DNA, 470 bp, Homo sapiens
  CDS 211..468
aagtcgctgatgtgaagggtaggggtcagcgtagttagggaatccgtgaggctcctgttactgcgcatgctctaagctccaagcccacaacctccttcgaaagaacactaccgccaacgctagcgctacggggcagatgtggttgtgggttttgtgcctgcagagatattaaagagaggccaggtgtggtggatcaagcctgtaatccaaatgctttgggaagacaaggtgggaggatcacttgaggccaggagtttgagagcagcctgggcaacacagcaagacgtcatctcttcgaaaaatggaggttcgctcttgttgcccaggctggagtacaatggcgtgatctctggctcaccgcaacctctgcctcctgggttcaagcgattcgtcagcctcagcctcccgagtagctgggattacaggcatgcgccaccacacccagctaattttgtatttttagtagagag

SEQ ID NO: 593 - DNA, 233 bp, Homo sapiens
  CDS 72..233
ttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacaccaaaaaaa

SEQ ID NO: 594 - DNA, 238 bp, Homo sapiens
  CDS 68..238
gatggatttgtatcaagaggctgtgctctgaatccccttatggggtcttgctaagctggaatcccacatgaagtcacaccgtcacggggccttctccactggggcctccaccacactgacgccactcaaggtcagggactctccaactacaaaaatgaaaggagagacccaatcttgctatgctgcccaggctagtcttgaacccctgacctcaagcaatcctcctgtctcagcctcc

SEQ ID NO: 595 - DNA, 374 bp, Homo sapiens
  CDS 199..372
gacgctgaggggcggaggcgggagaggcgaactcgcgatgagtggtctcggcaggctcttcgggaaggggaagaaggagaaagggccaaacccctgaagaagcaatacagaaactgaaggagacagagaagatactgatcaagaaacaggaatttttggagcagaagattcaacaggagctacaaacagccaagaagtatgggacmaagaataagagagctgccctacaggctttgcggaggaagaaaagattcgaacagcagctggcacaaactgacgggacattatcsaccctggagtttsagcgtgaggccattgagaatgcsactaccaatgcagaagtccttcgtaccatggagcttgctgcccaaagc

SEQ ID NO: 596 - DNA, 460 bp, Homo sapiens
  CDS 300..458
aacaaattcaaaagctagcagacggcaagaaataactaagatcagagaagaactgaaggagatagacacacaaaaaatgcttcaaaaaatgcaatgaatccaggagctggttttttgaaaggatcaacaaaattgatagaccgctagcaagactaataaagaagaaaagtgagaagaatcaaatagatgcagtcaaaagtgataaagggaatattatcactgatcccacagaaatacaaactaccatcagagaatactataaatatctctacgcaaagcaactagaaaatctagaagaaatggatgaattcctggacacatacaccctcctaagaccaaacgaggaagaagttgaatctctgaatagaacaataacaggctctgaaattgaggcaataatgaatagactaccaaccaaaaaaaaagtccaggaccagacggattcacagctcaattctac

SEQ ID NO: 597 - DNA, 461 bp, Homo sapiens
  CDS 157..459
aaagcagagaaatcagggctaatgaaccatctaaggtacaggccatgagggttcgattttgtgtaagagacatggccagatctattaggtggaccaggaatggaccaaaggcaatttaattttggttataattgaggatgttgamsaaagcattgaatggaagacattgcagaagvaagaaacagcagaaaawttaagggaaaaacttrgawtaggaccaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgcggcgatactgccaggtgctcaatgc

SEQ ID NO: 598 - DNA, 500 bp, Homo sapiens
  CDS 64..498
ctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttgtctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctc

SEQ ID NO: 599 - DNA, 521 bp, Homo sapiens
  CDS 335..520
agaacgtatattttggtggtggtagccttgtgcctccctttgtgcctgttataattgtgttgctctttgttcttagtctacgtctatctttccttgtagaggttgcgtgctcgcatttgaccttcaaatctaatagtttttcctccaattggagacgctttaggattctaagagaaagcaagctgcaaggggtttcccctttaatctagaaatgtggagtctcagcccacttaattttgctcactcttaaaagcatttcaaccaaagccattcattagggatttgatttggaggcaggagggattcctatactgttttaactggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggscatcccaaagggtttgcgtatatagagttctcagaca

SEQ ID NO: 600 - DNA, 505 bp, Homo sapiens
  CDS 79..504
  misc_feature 467: n=a, g, c or t
ataatttaaggctctaagaaggtggcacttggatctcttacaaagcatcatattttcaatgaggagaccattgaagtgatgtcacgtggctgttcatctgacctgaggtttcacacgtggctagggctgagaatgctgaaaaacattatagcagtagctcttctgatgctagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtacacaggagttctnggagaggaacgagccagacgcctcattcacaactacaa

SEQ ID NO: 601 - DNA, 169 bp, Homo sapiens
  CDS 14..169
aacaggactctccatgtggcaagggcacctggaggtgggagggcaggagcgtcgtcttgccctgggcaggaagaagcggtcgtttgccatggcaggtgtgaaatacccgggacaggaccctgtggatttagacatataccaaagctcccacatggtcgactatcagccc

SEQ ID NO: 602 - DNA, 247 bp, Homo sapiens
  CDS 40..246
agtagcagcggcagcagcagcagcagcggcggcgcccagatgcgctcccgcatcctccgcctcagagaggcgcgggacggttacgstcgaragggcttcggggcacctcgcgtycgggtcccctctsccaccttbacctyggggaagcgcgccgactccgccgcgatctggccgctccgcgagccccagtgcctgatgggtactagcagggccaccccagccagatggaggacaaggcctctccaag

SEQ ID NO: 603 - DNA, 530 bp, Homo sapiens
  CDS 257..529
  misc_feature 504: n=a, g, c or t
taatacactgcttctattcattgaggttcaaagtgtttttgaaaatgttgttgctttgcttttcatttgtttgttgttttgcttttcgtgttgtttgtagcatttataaaaatggggtgttaaaccaagaccagaaatacatagctgctgaaactctagaaaattgttgaaaaatatttgtctctttaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaaggtactctttttccttttaagcacagtttattatgttgtaattttaaagaatgcaagttattttaatatttgcaatgttgttaataggaatttgctgttatttaagantaaaattggaggtcacttaaaaacaa

SEQ ID NO: 604 - DNA, 478 bp, Homo sapiens
  CDS 205..477
aactatagaagatcgtatagtcctagaaacagtagaccgactggaagaccacggcgtasagaagccattccgacaatgatagattcaaacaccgaaatcgatctttttcaagatctaaatccaattcaagatcacggtccaagtcccagcccaagaaagaaatgaaggctaaatcacgttctagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctga

SEQ ID NO: 605 - DNA, 454 bp, Homo sapiens
  CDS 154..453
cctcgcggcggccatggcgtcggtggtggaatacaagggcctcagggccggctaccactgcggctactgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggtttgaaaaaaatgttgaaatttctggctaaaggggaggttcccaaaggaagttgtgaggatgagcccatggattccacaatggatgatgctgttgcgggtgactttgcvdhgataaataaactggatatacagtgtgatcttaaaacactcagtgatgacatcaaagagagtttagagagtgaag

SEQ ID NO: 606 - DNA, 328 bp, Homo sapiens
  CDS 93..326
gactagagtcgttgggcccggcgcgacccgcagagsgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgmaaaacagactttttcattggaggagaagaagggatggcagagaagcttatcacacagactttcagccaccacaatcagctggcacagaagacccggcgggagaagagagcccggcaggaggc

SEQ ID NO: 607 - DNA, 522 bp, Homo sapiens
  CDS 279..521
attctyaattgsgccmagcttccggcctggccacccgccagcaggtctcacccggttcgcatcagtcccgggcccccggcgcccctcagtagtagcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttargscytgraatkggggraataggagscckgtgttcacgattagtttccaccacctaccaacttggaacctttacatctctccaagcctgagtttccttatctgtgagacagctgcgaataccggtttccagagagtagttaagaacccttgtgaacaccttcttcagcttccttcgacgcaaaacagactttttcattggaggagaagaagggatggcagag

SEQ ID NO: 608 - DNA, 383 bp, Homo sapiens
  CDS 105..383
cctttcggtcsaggyggcggcagggctgagccagcgacgccctccattcactctccgcgcscgttctccggstgtsctcccgttcsgctgcccgcyctgcsacsatgacggaacaggccatctccttsgccaaagacttcttggccggagatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgstgtccttctggaggggcaaccttgccaacgtcattsgctacttccccactcaagccctcaasttcgccttcaaaggata

SEQ ID NO: 609 - DNA, 419 bp, Homo sapiens
  CDS 256..417
  misc_feature 100: n=a, g, c or t
aagcgtctgcgtgtcctgtgtgtgcacgtgagcttgtccgtggtgtatgtttgtgtgcatgaccgtgtgactgtgccgtgcgtgtacaggcgggtcctgnatattsgsgccgaacscagcactccggttcgacggggctgcagtttgcagggcccggataaccgaggcagtggcccctccmgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaaagacccgagaaggtgtggtaacaaggtgtggcttca

SEQ ID NO: 610 - DNA, 416 bp, Homo sapiens
  CDS 142..414
  misc_feature 150,152,162,172: n=a, g, c or t
aagcgtgtagggctggcggcggcggcgctcgggtcacctctgggagcggagtgggggcggasgagacggaagcagctcaggagacttgaggcgtaggchgckgtccccaaggtgaccgcgccctatgtbggactcgccctaatgcctctnancctgggtttnakggaatctngcatcgggtggwgccgcagggccacatccctgtgttttgtgtaccctcttgattttrcccgtacccgtctagcagctgatgtgggtaaagctggagctgaaagggaattccgaggcctcggtgactgcctggttaagatctacaaatctgatgggattaagggcctgtaccaaggctttaacatgtctgtgcagggtattatcatctaccgagccgcctacttcggtatctatgacactgcaaa

SEQ ID NO: 611 - DNA, 459 bp, Homo sapiens
  CDS 133..459
agatggctcaggtgcttcggctgccacggcasaggttctctgctctcttttctctgctggaactgggccctagagactggggcaggcggttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggt

SEQ ID NO: 612 - DNA, 340 bp, Homo sapiens
  CDS 96..338
aaggaggagaagcgcttaaagcggcgggasggtgcggagaggggttggacccagggctgaggcaggyccccccctccctcccgcctcagtggatcatgcccagggcggcasggcggcgattgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttgggtttttgaagaggaagaggaactgcagcgc

SEQ ID NO: 613 - DNA, 513 bp, Homo sapiens
  CDS 218..511
acagttacgcgccgcacggatcatgggccgcagccgctctggggcagatctgggcacgaaagcttctctctgtcccttggcttctgkkgkggtcccagaagatatgcctcctccagtttcaaggctgcagacctgcagctggaaatgacacagaagcctcataagaagcctggccccggcgagcccctgggtgtttgggaagacatttaccgaccacatgctgatggtgggaatggaatggacaagggctggggccagccccgaatccaggcccttccagaacctcacgctgcacccagcctcctccagcctccactactccctgcagctgtttgagggcatgaaggcgttcaaaggcaaagaccagcaggtgcgcctcttccgsccctggctcaacatggaccggatgctgcgctcagccatgcgcctgtgcctgccgagtttcgacaagctggagttgctggagtgcatcccgccggctcatcgaagtggacaaggactgggtcccgatgc

SEQ ID NO: 614 - DNA, 506 bp, Homo sapiens
  CDS 187..504
atcattatttcatctgctgaaccctgctgagagccagggctggcattagtgacaagaccgtgcctcccggggctcttccttggggctctgtggcccagggcgacagtgacgggcccctctccccaggcagctccagcaccaactctgtagcagaacctgcccaggtcttgcaggtttgagggtggcatggcagcgagcacagacatggctgggctggaggagagcttccgcaagtttgccatccatggtgaccccaaggccagtgggcaagagatgaatggcaagaactgggccaagctgtgcaaggactgcaagatggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaaga

SEQ ID NO: 615 - DNA, 488 bp, Homo sapiens
  CDS 188..487
tatttttcaaatatcatgtttccctctgttgccactaccttggcctcactttaggttttcatctctaattataacaacaaaaaacagctagcatcgttatgagactagtactgatgtctacatttgaggacacatgcgcataaatcagccagttttgatacagagttgatgaataaagaccattattatgaaaacctcttttaaatataaattctattttaaacactcagataaactgagattgaggaaaaatccaagacaaattagaaagtggtgtagctacaatgtaagctgcatgcaatgtccaagttattactcagctcatgatgtccatctgtccatccatccgtccatccacccatttatccatccatccatccatccagccagccagccagccatccacaaaaagatgccctgccctggaagtaatgctatacattctactaaaatgttctgttcaccccttcgtaaaactctctgtatgc

SEQ ID NO: 616 - DNA, 481 bp, Homo sapiens
  CDS 303..479
  misc_feature 391,395: n=a, g, c or t
aggcccgacagggagcggaagaggcccaggaggctgggtgaggcgctgagacggtttggcggtgagtcctgggccaggcgcastgaaaggcccgcaacccgggaaacgtcaaaacaaacagaaggacttgggattccggagcagtcgcccctatcgctgctcctgcagttgcggacgccaccgaccccgccgccggagactgggcactgaaaggcctctaggctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttntttnggattctgctttgaggtgcaccgggcagtcaagtgtggctacttctacctggagttcgcagagactggtagcgtgaaggattttgg

SEQ ID NO: 617 - DNA, 494 bp, Homo sapiens
  CDS 148..492
atcacattctgtgttattgccatgttaactccacatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattg

SEQ ID NO: 618 - DNA, 358 bp, Homo sapiens
  CDS 121..357
agagtacaggtcgtgctgcagttagttcattgaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgabadwtgcraaaaatggagaagccaaaattacagag

SEQ ID NO: 619 - DNA, 361 bp, Homo sapiens
  CDS 121..360
agagtacaggtcgtgctgcagttagttcattgaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcac

SEQ ID NO: 620 - DNA, 309 bp, Homo sapiens
  CDS 121..309
agagtacaggtcgtgctgcagttagttcattgaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcyvaagcagttgctgaaaccaagcaagaagcagttgttgaa

SEQ ID NO: 621 - DNA, 278 bp, Homo sapiens
  CDS 123..278
gggggtgggggggcggccctgggataggggctgtggcagtacgcggggacccggctgcggtggctgcgggactgacgaatggagaggagaaaacctatgghkgstgtkawggacctgatgccatgtatgtcaaattgatatcatctgatggccatgaatttattgtaaaawgagaacatgcattaacatcaggcacgataaaagccatgttgagtggcccaggtcagtttgctgagaacgaaaccaatgaggtcaatttgacatacatggcatcaggt

SEQ ID NO: 622 - DNA, 476 bp, Homo sapiens
  CDS 214..474
tttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggttcaccatgttggccaggctggtcttgaactcctgacctt

SEQ ID NO: 623 - DNA, 412 bp, Homo sapiens
  CDS 241..411
ctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagc

SEQ ID NO: 624 - DNA, 448 bp, Homo sapiens
  CDS 50..448
agcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtacgacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagtbcaagttctctttctgatgatgat

SEQ ID NO: 625 - DNA, 552 bp, Homo sapiens
  CDS 401..550
caggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttcccctgccctcccagactgtgtggccagttgaaagtgtctggtttgtgttcatctctccctcatttctggagcagggcctgagaccctgccacatctcctatgctctgcatccacgcctcttttggacattaaa

SEQ ID NO: 626 - DNA, 463 bp, Homo sapiens
  CDS 203..463
aaaactctgaggacatgaatagtcgccaggcttggggctcttgctctcccaaggcagaggagatcgttgggtttcaaggccccgcggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaa

SEQ ID NO: 627 - DNA, 580 bp, Homo sapiens
  CDS 380..580
aggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcagacttctatgattccacagcag

SEQ ID NO: 628 - DNA, 479 bp, Homo sapiens
  CDS 282..479
  misc_feature 30: n=a, g, c or t
aacccgtttccatggctgtstgagaactdngctccccaaccgtcccgcaactgtcctgtcccagactttggcaccgtckgggtccgtcgtccccgaatgtgacagcatccccaccccggctgctgcccaggatccgccggaccccggcctcgatatgggagacctggaactgctgctgcccggggaagctgaagtgctggtgcggggtctgcgcmsttcccgctacgcgagatgggctccgaaggtggaaccagcagcatgagaacctggagaagctgaacatgcaagcsatcctcgatgccacagtcagccagggcgagcccattcaggagctgctggtcacccatgggaaggtcccaacactggtggaggagctgatcgcagtggagatgtggaagcagaaggtgttcsctgtgttctgcagggtggagggacttcaagccccagaacaccttccccatctacatagtggtgcacac

SEQ ID NO: 629 - DNA, 478 bp, Homo sapiens
  CDS 174..476
gataacgcgggtgaggcgtggagggcggcgcatggcccacctggagctgctgcttgtggaaaatttcaagtcgtggcggggccgccaggtcattggccccttccggagttcacctgcatcatcggccccaacggctctggaaaatctaatgtaatgatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatcctagggggatgctcagaatttcgctttaatgataatcttgtgagtcgttctgtttacattgcagagttggaaaagataggcataatagtcaaagcacaaaattgtttggtttttcagggaactgtagagtcaatttcagtgaagaaacccaaaga

SEQ ID NO: 630 - DNA, 607 bp, Homo sapiens
  CDS 422..607
atgatgctctgccctagaacaaacaacattctgccctcccatgatactcttctttaaaaccaacaacagtctgccttcccatgatgttctgcccaacggccaacaacagtctgccctcccatgatgctcttccctagaaccaacaacaatctcccctcccatgatgaaggaagcatcccgtgatgtctgctctacaatctgataacagccctctttcctgtgatgctatgctgtacagcctgacaacagtcttccttcccatgatgacctgccctacagcctgacaagagcctcccttctcatgatgccctgcccaacagctgacaacagttcgccctcccatgatgctgtttcccagaaccaacaacagtctgccctcccatgatgctctgccccacagccaacaacagtcttccttcccatgatgctctgccctacaaccgrcagccacacctcccttggcaccaggatttgcccccagtctgacagccttcctttccagcatgccttgccctggcctgggcagtgttgtccacacccacatgagggtggtgtcggtgctgcccacgtcccagctgtgaggtcagccagcsacagaagcagcagc

SEQ ID NO: 631 - DNA, 458 bp, Homo sapiens
  CDS 255..458
tcgaaaacgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccaca

SEQ ID NO: 632 - DNA, 502 bp, Homo sapiens
  CDS 212..502
gacaacaagatggcggcgctgcgggacggctagcggccctgcgtggggactcattggcgccccctgaggtggactttgacaggctgctggccagcctgcaggatcttagtgagctggtggtagagggtgacacccaagtgacaccagtgcccggcggggcaggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaag

SEQ ID NO: 633 - DNA, 485 bp, Homo sapiens
  CDS 326..484
aacaagatggcggcgctgcgggacggctagcggccctgcgtggaggcgaggaatccgcatctatggagatgtcscctgcatcccatgactcggagctgatggccmttcatgacgaggaagttgtgggacctggagcagcaggtgaaggcccagactgaatgagatactgtccaaggatcagaagatagcggccctagaggacctggtgcagaccctccggccacacccggccgaggcaaccctgcagcggcagggaggaactggagacgatgtgtgtgcagctgcagcggcaggtcagggagatgggagcggttcctcagtgactatggcctgcagtgggtgggcgagcccatggaccaggaggactcagagagcaagacagtctcagagcatggcgaagagggactggatgacagccaagaagttctggaagccaggggactcattggcgccccctgaggtggactttgacaggctgctggcca

SEQ ID NO: 634 - DNA, 464 bp, Homo sapiens
  CDS 13..462
agttgagtggaaatgggcaacggcgggcggacgggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaaca

SEQ ID NO: 635 - DNA, 494 bp, Homo sapiens
  CDS 292..492
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagagcatgaagccaccgggaggaaagaacaactctggacgcgccaactttatgaactgtaacactcaacgcaaaggtctgcagcttcactcctgacgtctgtaagaccatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaattctggacacagcaccattattcacaacagccaaaaagtggaaacaattcaaatgtccatcaactgatgaatggataaactgtggtat

SEQ ID NO: 636 - DNA, 480 bp, Homo sapiens
  CDS 84..479
gttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatgaccttcggaaatccctggatagattctatgaaatgtttggtcatccacagccaggctctgcaaactcactctctgcatctgtctgcagtgcctgtctcagaaatcactcaactaaga

SEQ ID NO: 637 - DNA, 450 bp, Homo sapiens
  CDS 152..448
cgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaagcactacacgctggatgcttccctgcctttgcgtctgcgaccagagtcaatggagaagctgcgctgtctc

SEQ ID NO: 638 - DNA, 344 bp, Homo sapiens
  CDS 147..344
  misc_feature 335: n=a, g, c or t
acagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagakaaaccagacggagaaasagtccacgggtgtgtanaaccgggga

SEQ ID NO: 639 - DNA, 469 bp, Homo sapiens
  CDS 202..468
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttgcctcagcctcccgagtagctgggattacaggtgtgcaccaccacgcccggctaacttttttatttttaacagggacggggtttcaccatgttggccaggctggtctcgaactcctgaccaacatggaggaacccgtctctactaaaaatacaaaattagctgggcgtggtggcgcatgct

SEQ ID NO: 640 - DNA, 426 bp, Homo sapiens
  CDS 109..426
aagaaagcaaataggataggaaaatcaggaaatgacagtgccatagaattaccccaaaatttaaggcccaaggaagatcctacaagatgctcaagtggccttcttcagatgttacaagtaggctcctgtaaacattcgggataccaaaagattaaagagaagcctcaattttgcctcttcgttgaaattgatagggataaagcctcagatctcactgagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaaacaaagacttagcaaaaaagttgaaagttttgcagttacagaacgaact

SEQ ID NO: 641 - DNA, 458 bp, Homo sapiens
  CDS 273..458
  misc_feature 398: n=a, g, c or t
aacagttccgtcagaggtgcctcctcctgcccccgcactccactcccagccatggctccccttccccaggcaagctggaacctactgtgaatgcagccttggcctcagccgcgaggcctcatcgccctccttgtggtgctggcgggcatcagtgccagctgcttctgtgccctcgtcatctggcaattggtgtcttgcgggccaagggtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccnccaccacccccgcccctaccacctgagagggctgagggcagctgggggaggggaattaaa

SEQ ID NO: 642 - DNA, 497 bp, Homo sapiens
  CDS 246..497
atgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagccwgaagtacaccggctcctccatggtgcacatccctccaggggagccagacttcgagtcttccttgtgtcaaacatgcctgggtgaacatgctttccaaagaggggttctcctcaggagaacgagt

SEQ ID NO: 643 - DNA, 272 bp, Homo sapiens
  CDS 119..271
ctaagaaaaattcttctgccttgagattctgttaatctataaccttacccccaaccccgtgctctctgaaacatgtgctgtgtcaactcagagttaaatggattaagggcggtgcaagatgtgctttgttaaacagctgcttgaaggcagcatgctccttgagagtcatcaccactccctaatctcaagtacccagggacacaaacactgcggaaggccgcaggacctctgcctaggaaagccaggtattgtccaaggtttctccccatgtg

SEQ ID NO: 644 - DNA, 353 bp, Homo sapiens
  CDS 170..352
atttttttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggakgaggaggaggaggaaaaagaaaagagtctcatcgtggaaggcaaaaaaaaaaaaaaaa

SEQ ID NO: 645 - DNA, 546 bp, Homo sapiens
  CDS 297..545
atgaggttccatgcggccaacaagagagggagatagaaaggaaagggccccagatgtggctccccttccaaatactttaagttcccagtttaacctatgtgatcctttcaatatttccaccataatgcatgggtccagtcctgttctttgggttgcacaaaataattagcacaagcatacaaaaaggcaagagtaatattcaaaatactgaagagctatggtacactaaagtgccctgggggtaagtctgtgtgtgccagcctgcagcaggtggtctcagccctggaaggaacagcatgatggacaccatggatcccttctggtttaatgcattcaaaaggactaataccatactgcaccatttgagaatgtccaagcacacagatgcagcagaagaggtgctattggaaaaaaaaggttgcacgggagtcataacactaaacagaccaaagttcctcaatgcactgactcttaatatgattcggcagatttatccacagctaaagaagttggaacaagatcctgaaactttcctgatcattataa

SEQ ID NO: 646 - DNA, 336 bp, Homo sapiens
  CDS 175..336
cacactggtaagagggccaccgggctcccaggcagtgagtcctacttcctggtagggggagccacgagtgggggtcaaaagcgagacccatctcccacagttccagttattcctagcttggcttcttccccggtctccgaagccccgagcttgtctggtggtgctgtatttcctatgtgctctcagtacccacatggcctttgtgcaggggccgagccctccaagggcagcattctactaagtgttcatccggggcgttttgaggtgaaagtggtcacaggccctcagatcactcatggcgtcgctcatcccttccggagtggtagccatattatc

SEQ ID NO: 647 - DNA, 368 bp, Homo sapiens
  CDS 124..366
atcccgctgaggagcgcgcmgcccggggaggccggagacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccc

SEQ ID NO: 648 - DNA, 483 bp, Homo sapiens
  CDS 161..481
gtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaa

SEQ ID NO: 649 - DNA, 511 bp, Homo sapiens
  CDS 166..510
aaagggaggtacgagaggcagacagccggggaacaccgagaggcagagaagctccgagaacagtgcacgggagagaaagagaggctgcgcttcctcacctactgcgagcgtgagtcagcgctgaaggcccagagcgcgctgcacgagcagaagactctgcccgggatgaaccggccgatccaggtgaagcctgcggacagcgagagccgaggagaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatsagcagatggctggccagatggg

SEQ ID NO: 650 - DNA, 489 bp, Homo sapiens
  CDS 308..487
acaagcgattctcctgcctcagcctcccaagtagctgggattacaggctctggccaccatgcccggataatttatggtttctttccaatttgaggtctctctcctgaagtggctgacacaattggagaaactggttatttaccaaggctttgactggaatggcatactttcagatacaaacagactcttttaaagaatcaaagttgacttataaagccaataaaagcttcttgggaaatttggccccatactttgtctaggcagtccctgcacagggtttctggcctatgaggctcacccatctgcaatgtcacttcctagatgggatgcaactacaaaactaatctactctcaagaactagacaggattatgactgccttcatgagtattcacagttcttcctgtaacctgttgaatatacacttagccaatctttcatcacaaccagttactattagaaatggggagcatgccttattaattaagac

SEQ ID NO: 651 - DNA, 511 bp, Homo sapiens
  CDS 120..509
tccgaccctcgacttcggagaggcagcgcggttcctctgggtgcttccgcctccccttctcctgcttctccagcctcttcggcctcctcgcccgccgcgggaacccgagaccccagtgtatgcccmmcccykrmcccssyysssrmmwkkycmmcccsgsyysgssgsssctcatgcgggacttcaagaggttgcaggaggatcctccagccggagtcagcggggctccgtccgagaacaacataatggtgtggaacgcggtcattttcgggcctgaagggaccccgtttgaggatgtctatgcagatggtagtatatgtctggacatacttcagaaccgttggagtccaacctatgatgtgtcttccattctaacatccatacakyctctgttggatgaacccaatcccaatagtccagcaaacagccaggctgctcagctgtaccaggagaacaaacgggaatatgaaaagcgtgtttctgcaatagtagaacaaagctggcgtgattg

SEQ ID NO: 652 - DNA, 489 bp, Homo sapiens
  CDS 273..488
cccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgcgaactgtttagagagtttgcgaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatc

SEQ ID NO: 653 - DNA, 519 bp, Homo sapiens
  CDS 325..519
  misc_feature 2,310..311: n=a, g, c or t
hncctccctggcccccgcctcccggactcctgaccaaatgaccccccccggcaggtgtttcgcccgtgccgggttcatgctcacaagcagacagctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggannkmmtgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaatcatcttctctgc

SEQ ID NO: 654 - DNA, 343 bp, Homo sapiens
  CDS 107..343
cattccttctttcattttccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagacagtggccccagccgggaatcaatttttttctcaatgttataacaaaatgacattgaataaaacgatgctattcaaggaaaaa

SEQ ID NO: 655 - DNA, 508 bp, Homo sapiens
  CDS 99..506
cgcgcggacccggcgagaggcggcggcgggagcggcggtgatggacgggtccgggtcgcagcccagaggcgggggggcccaccagctctgagcagatcatgaagacaggggcccttttgcttcagggtttcatccaggatcgagcagggcgaatgggggggggaggcacccgatsgtggccctggacccgagtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccgggaactgatcagaaccatcatggggctggacattggacttcctccggggagcggctgttgggctggatccaaga

SEQ ID NO: 656 - DNA, 486 bp, Homo sapiens
  CDS 244..486
cttactagattataaacttactgagaaatgagactaaaaaaaaaatcactgaatttcataatacttagcgtggcatttttctaaaagtaatttctcattgattacttgctaaagtaactaaattagcaagctggcatttagctcatttaaaccccattctggtacaaattcaccccttaagtttttctcatggtagcatcattattgcagctttacacatagaaatgttactagtttgggcacatggatttatgtagtttaaggaactctctagctcctcactttacttatgtatttatgtatgtatttaagaaatcacwvgggccgggcatggtggctcatgcctgtaatcccagcacttatgggaggccaaggtgggtggatgacctgaggtcaggagttcgagaccagcctgaccaacatggtgaaaccccgtctctactaaaaataaaaaatcagccaggtgtggtggcgcatgctataatc

SEQ ID NO: 657 - DNA, 510 bp, Homo sapiens
  CDS 51..509
ctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattac

SEQ ID NO: 658 - DNA, 553 bp, Homo sapiens
  CDS 78..551
agaaacctcatctcccactacagacctgccagggcccaggagagctcgacccacccaggcacaccatagccccagagatggctggggacacagaagtgtggaagcaaatgtttcaggagttaatgcgggaggtgaagccatggcacaggtggaccctgagaccagacaagggccttcttcccaacgtcctgaagccaggctggatgcaataccagcagtggaccttcgccaggttccagtgctcctcctgctctcgtaactgggcctctgcccaagttctggtccttttccacatgaactggagtgaggagaagtccaggggccaggtgaagatgagggtgtttacccagagatgtaagaagtgcccccaacctctgtttgaggaccctgagttcacacaagagaacatctcaaggatcctgaaaaacctggtgttccgaattctgaagaaatgctatagaggaagatttcagttgatagaggaggttcctatgatcaaggacatctctcttgaagggscacacaatagtgacactgtgaggcatgtctgcag

SEQ ID NO: 659 - DNA, 265 bp, Homo sapiens
  CDS 57..263
  misc_feature 193: n=a, g, c or t
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcmaccaacttgcgcaanawcaacagacagccctatgctgtcagtgaatttagcaggtcatcagactagtgctgagtcttgggggtactg

SEQ ID NO: 660 - DNA, 460 bp, Homo sapiens
  CDS 286..459
aattctgtaagcccatgaggagagaggaaggcctttctctccatgctccttttgcgggaactccctggcaccaaggccaggggggaaaggacagtctctgatgaggatgggtctctaggctgctctgagtgctgtccctgcactgaagaagttatagtkccctcccaggcggccccctccctgcccctcagctcagcctcaatcaagaagttccccatctttgaccactccaagtaggagaaaccggcccagggctcccttagagccgagaacagtgagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggccccatgct

SEQ ID NO: 661 - DNA, 451 bp, Homo sapiens
  CDS 197..451
ttagcaagatggcggctccctgggcgtccctgcgcctggtcgcccccatgtggaatgggcgtatcaggggcatccatcgcctgggtgcggcagtggccccagaggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaag

SEQ ID NO: 662 - DNA, 487 bp, Homo sapiens
  CDS 27..485
ccttccggttacgaaaccttagcaagatggcggctccctgggcgtccctgcgcctggtcgcccccatgtggaatgggcgtatcaggggcatccatcgcctgggtgcggcagtggccccagagggcartcagaagaagaaaaggacaatactccagttcctgaccaactatttctacgatgtggaggctctgagggattacttgctccaaagggagatgtacaaggtgcatkagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctcccacgtggacgactggtgtctcagccgcctctacccactggccgactcgttgcaggagctctcgct

SEQ ID NO: 663 - DNA, 458 bp, Homo sapiens
  CDS 308..457
atcctcckcgcccggcgcctcactcaccaagggccgcgccggggttctgcactgtcactgcgctgcggttccccgccttagggattctcacacggttccacggctccaggcccggcggcaccgcagccatcatgcgaggcggggggacttacgaaaggcggastacgcgagagcacgtccagcgaccggagsattttmatctkgcwctgggccccacaaacgatggagacagtactgcatagaatcagaatgttggagctggaaggactttgagaggtcatccgttccacccccacccatcttgcagatgaaaactgaagctaggacagtagcactggccatcttcagtcgcaagctcattcacgtcagagcaacagtatamcccaggccccacagagtgtttcccctttgctgcaggagcttatctccagccaaaatatcacttgtggctgagctgg

SEQ ID NO: 664 - DNA, 535 bp, Homo sapiens
  CDS 264..533
atgatgtttgttttcgctcaagagcttcccttccacaatctgaatgggaaccacagggagaaaggagggcatgagaaggagcagattttgactcccatcatgctccaggctgctctccctctgtttagtttgcactggtgggttgtggggaattgatgctgagaaaggaaagctttgaaaaaaatgaaaatttgaaatatgaaacaaaatgacaattttgtaagatctaaaagtatctgtttcaataatcttaactacctgaaatgtatagractaaactgrgatggcccyttaagggacctcagytacccagtggtaaagctggtaaagctgggaggattgatggaacattgctagtagccattactggagaagtaacaaccttttttcgtattctcggcaccagctggacaatgccatcgccatccccccagagcctcgaaagtctggagatgatgcaaagaccagccctgaagaggatgccatgtatgttgatgttttccatcttcaggttttacctgtctcctgttctcat

SEQ ID NO: 665 - DNA, 488 bp, Homo sapiens
  CDS 249..488
  misc_feature 423: n=a, g, c or t
ataatcttacaggatcctcactgtatatgcagtccgttgttgatggaaacatggttatacacttcaagtctggatagtcagaagtttgtgacagtgccctccagtaatgaagtggtaactaacctggaagtgctgacaasaaatgcctccatgggaagaactactgtcgacaggtcctctgtctgtatgatcttgccaaggagttgggctgttcctacacagatgttgctgcdcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccancagaggagagccagacatttcttcagctgaccactctgtgtcaagaccgcacattggtctcaaaa

SEQ ID NO: 666 - DNA, 539 bp, Homo sapiens
  CDS 324..539
agggacgcttcggccgaggataccgcaatggatcaggaagaggggctgaaggcttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaat

SEQ ID NO: 667 - DNA, 490 bp, Homo sapiens
  CDS 20..490
agaggctgtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggggaaacctgctcagatgcctcaagagaattccgtctcctctgctgcgacatagatccagtcctggtgaagcgagccgaaaaagaatgtccttttcctgatgccttgacttttatcaccctggacttcatgaatcaaaggacccggaaggttctcttgagctctttcttaagccaatttggacgttcagtt

SEQ ID NO: 668 - DNA, 498 bp, Homo sapiens
  CDS 177..497
cagagcctccagagcctccgggtctgggcggmrcwwcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtrctggctgcctgtagtgattacttctgtgccatgttcactagtgagctctcagagaaggggaaaccttatgttgacatccaaggtttgactgcctctaccatggaaattttattggactttgtgtacacagaaacggtacatgtgacagtggagaatgtacaagaactgcttc

SEQ ID NO: 669 - DNA, 540 bp, Homo sapiens
  CDS 9..539
aagatattatggctgctgccacggagcataatcgcccgagcagcggtgacaggaacctggagcgaagatgcagccccaacctctcccgagaggtgctctacgaaatctttcgctccctacacaccctggttggacagcttgacctcagagatgatgtggtgaaaattacaatcgattggaacaagctccagagcctctcggcattccagcctgcattgctctttagtgcacttgaacaacacattttatatttacagccttttttagcaaaacttcagtctccgattaaagaggagaatacaactgctgttgaagagataggaagaacagaaatggggaacaaaaatgaagtaaatgacaaattttccattggcgacctacaagaggaagaaaagcacaaagaaagtgatttaagagatgtgaaaaagacacagatccattttgatccagaagtagttcagataaaggctggaaaagcagaaattgacagacgaatatctgcatttattgaaagaaagcaagctgaaatcaatgaaaaca

SEQ ID NO: 670 - DNA, 497 bp, Homo sapiens
  CDS 280..495
aaaaaaaaagaaagtgacagttgagggttagcatcttggaccttagctgctctctttccctcacactacttagaaaagatttgcatttactgcctcccttcgttctttcacagtcgaacctctctttacttgcctcttaccacatctggtaagtcttatagattcttcccttgtaatgagaggcaaaggaaatcaccttcagaacttggaacaggatcaactctgggactcttggataaacaaaatctgttccctgaatattttcagtgaaaggtgaatatggaggtgtcctggggagtgactgcattcttcctcggccaccacaaacaggagacccagcgccccctaagggccagctttggcatctccaaaggagaagggtgcccctcaccctataaagaatctctccatattggctgggcgcggtggcttamgcctgtaatcccggsaatttttggaggggaggctgaggcaggcggatcacttgaggtgaggag

SEQ ID NO: 671 - DNA, 506 bp, Homo sapiens
  CDS 116..505
aaacacgttcaccacgctccgagctaaggcgcatgcgttccctgaaattgccgccaccggctctaccttccagtttccagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattcctccc

SEQ ID NO: 672 - DNA, 492 bp, Homo sapiens
  CDS 303..491
gcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaaagrcacggcattccmatggscacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatcctattatgggratgactctgactttgagacggtgtacagcagtgtgtcaggtgctgcagacgttcttggaga

SEQ ID NO: 673 - DNA, 465 bp, Homo sapiens
  CDS 236..463
gactgcggcgcctgagggagtcgctgacgggcacgctgactggaggctggcggacaggcgacasgacctgcggcagagtcttgctgcgacacccaggctggagtgcaatggcgstatctcggctcactgcaacctccgcttcccggattcaagcgattctcctgcctcagcctcccgaataggtgggactacaggaccagaggagcgagagcagcaagaaccacacccagcagcaatgtcagcggaagtggaaacctcagagggggtagacgagtcagaaaaaaagaactctggggccctagaaaaggagaaccaaatgagaatgtctgacctctcagagctcctgaaggaagggaccaaggaagcacacgaccgggcagaaaacacccagtttgtcaaggacttcttgaaaggcaacattaagaaggagctgtttaagctggccaccacggcactttacttcac

SEQ ID NO: 674 - DNA, 469 bp, Homo sapiens
  CDS 27..467
actaagtgttgtaagtgaaacaagatatgctgaagagcagaatcagcatgaggagcagacaccccaggagagctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcggg

SEQ ID NO: 675 - DNA, 491 bp, Homo sapiens
  CDS 279..491
catatttatttttcaaagtttccccaggaattaaaggttgcacatctaaatgtcaccacttctgtgacttttgcagataaacattagatttacctttggcaaactgcagtgtctacattatgggatttccctccccagagtcttttctctggggaagttctgaaaaattgtttcagggatactatagttcttaaatataactaacaaacatattatgaaatgctgttagtttttttctggaggctgaatattgattgctacttagtataccttttttaatgattatattgtcccaccaggatatttacacagcttcatgtgtcttcccacaaaatacacatgaattgcaaagggaatatagtaacttggcagtagagaaacttggcagataccaccctaatcaaataatcaaatctaacaccattagtaattggacaaattggcagtgtgcaccatttgatgagatgcacagaggaaaacacagcatcgct

SEQ ID NO: 676 - DNA, 429 bp, Homo sapiens
  CDS 247..429
ttttattaacttcttgtaaacgaccctactttcctgctctcacacactccttacacctgcatcccacctgatttagccactttctgcctaacctgtcagaaagggtagatagcttcccagtcacctgttgctagggaaactcaccatttcagcccggatggtgaagattccagcttgakagaccagctcgggtctgaagtgtttctctatctactgtgctgagatctctccttctcgaaccctgctatgcctttgcatacgctgttttctccacstkscacgttctcaccccttcttcttccactgcaaactcctatgcagccgtcaacscccattctcctctggaaagccttcccgatcccctttgcaacaaccaccaccaatatttattcactgagcccactttgtgccaakcattgttctakacac

SEQ ID NO: 677 - DNA, 497 bp, Homo sapiens
  CDS 95..496
acccttaggcactccggactaagatggcggcgacggccaggcggggctggggagctgcggctgttgccscgggctgcgcaggcggttctttcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcag

SEQ ID NO: 678 - DNA, 473 bp, Homo sapiens
  CDS 204..473
accaaacaccactcagagaggctctgagcacaggggccttccctgcagcaaaccgaaactgaaacaaaacaccccagaaacccatgcaagccctgggaggctgtgggctgatggatgtcctgggctcgagtcccagccctggccctgttgggggccgaacaagcctggactgacaggcttgggctctcctctcttcacctgccatgactcctgctgccagggacaccaagactcatctcctgctcttvcctcgctcctgccgggatgatgggcccctctccttccctcatacttttcaagctcatgccaggccaggtgaagaaatgagccatagagaaggacttgcccaagatcacacagcaggcagagcgggacatgaaactaagcattctggctccagagtccacgtttttaactcaacggaatactcagcaatggctgagtctacgscctgtcgtcccctcctgggtctc

SEQ ID NO: 679 - DNA, 453 bp, Homo sapiens
  CDS 209..451
gaggcaagatggagttagtgcaggtcctgaaacgcgggctgcagcagatcaccggccacgcggtctccgaggctatctacgggtttttttcaggacaaatgatgcgaaggttggtacattactgggggaagacaaatatggaaacaaatactatgaagacaacaagcaatttttwggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaagaagattcaggagtggatcccaccttcaacaccttacaagtaagacaatgaa

SEQ ID NO: 680 - DNA, 460 bp, Homo sapiens
  CDS 229..459
agtgttggactgaacgagttaaggaacctgttcaaggagggactcgtggggccgctttgattggcggttgtgcctggtgctgccgctgtgttggtgacgagaactgataacagcatctcacaacagcgtagcccsggcatcgcactttgttttttggttttaggacaccagttacttgataccgaagccttcctgattcttttgcagtgatccagatccagtttttccatgagtccgaggcgcggaacctggcttcccagatccggcgtgtacttccatcttttaccagttgccggctctttcccacccaacccgtttcctggacaagtaattctgcgctcttcttcccgsctgtcacctttatttattagttcagttgtgtgtcctagatgctgtatacccaggtgctacagatacacacagtctcctgctgtggtttctgtgcttgggagcaggatgt

SEQ ID NO: 681 - DNA, 399 bp, Homo sapiens
  CDS 13..399
agcggacccaagatggcgaccgagttggagtacgagtctgtgctgtgtgtgaagccagacgtcagcgtctaccggattcctccccgggyctccaaccgcggttacagggcctctgactggmaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactggtaagagaactgggattttgagtggaacgacagttaggaaaacaggtgaatgcacagccatgaaaagtgtttccgattgcatttak

SEQ ID NO: 682 - DNA, 508 bp, Homo sapiens
  CDS 267..506
acttaacatgttcaaaggaactaagaagtaatataggtcattggttaaccactctagatcttggtcaacacttactatttgtaggacctttgaaatacaagcagttttaaaactgggaacttgatatatattcggccctatgcactttccatcctagtccagccttcagatggagaagtgggaaatgagcttccagtgcagccacaattggtatttttggatgagcagaatcgaagagtagagtccctgggacctccttcagagccatggacaatttcagcttccctggaagagcatcagactcagtgctaaaagggtgcacccaggcagaaactcaagatggttatgttagcttctacaacttggcagtcttgatctctgggtcaaactggcactttatttttactgtcacttctcctccaggagtcaattttacagctcgatccaagccatttgctgtcttgcctgtgactaggaaggagaagtcgaccatcatcctggctgcttc

SEQ ID NO: 683 - DNA, 535 bp, Homo sapiens
  CDS 109..534
aagaaaggatgtgacgtcactgagataaccagctcggctgttagcaactctgttagcaaagctgtttgtctttctcggaaacaacagtaacgataagcctctttgaatatggaggccgctgcagacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcggatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgc

SEQ ID NO: 684 - DNA, 308 bp, Homo sapiens
  CDS 106..306
  misc_feature 5,22: n=a, g, c or t
aaganaggatgtgacgtgaganaaccagctcggctgtttagcaactctgttagcaaagctgtttgtctttctcggaaacaacagtaacgataagcctctttgaatatggaggccgctgcagacggccggctgagacccaaagcccggtggaaaaagacagcccggcgaagacccaaagcccagcccaaagacacctcaatcatgtcgagaaataacgcagatacaggcagagttcttgccttaccagagcacaagaagaagcgcaagggaaacttgcccagccgagtcccgtttaagatcctcccgcg

SEQ ID NO: 685 - DNA, 452 bp, Homo sapiens
  CDS 298..450
asatcstggaagagtggcctaggacagctcctctcctgccagagctaggcaggcgccgaagtagccgcatggcccgtcagaagaccccagggactgagagccaacctcaaaggcaccatccgtgagacaggcctgcagaccagctccggtgggaagctggctggccatcagaagaccgtccccacggctcacctgayttttgttattgactgcacccacgggaagcagctctccctggcagcaaccgcatcaccaccccaagcccccagtcccaatcgagggcttgtcaccccaccaatgaagacctacatcgtgttctgtggggaaaactggccccatctgactcgggtgacccccatggtgggggatgccttgcccaggccagggccaccctgccgctctgcagagggtctgtggctcagcttccttcccagtcagcccgctctgcccca

SEQ ID NO: 686 - DNA, 495 bp, Homo sapiens
  CDS 262..495
atctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgtctggtgtcaccaagtgtccactggtactgaggtttgctgcctgccttcttgccatgtctaacgaagtagaaacaagtgcaaccaatggtcagcccgaccaacaggccgcaccaaaagcaccctcaaaaaaaaaaaaaaagaaaggccctgaaaagacagatgaatatctcttagcaaggttcaaaggcgatggtgtaaaatatawggccaagctgattggcattgatgatgtgccagatgcmagaggggataaaatgagccaagactctatgatgaaactaaaggga

SEQ ID NO: 687 - DNA, 497 bp, Homo sapiens
  CDS 44..496
tacagaacagagaatccagtcacttatcagctcattacaacatatggtatatgaatatatatgtcgttgtctatttaaggctgatcagttgatgttcgctttgcattttgttcgaggcatgcatcctgaactttttcaagaaaatgaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcaaattcttgtagtacaggcgctaagaccggacagattgcaaagtgccatggctctttttgcatgtaaaactctgggtaagtgtgatgcttttc

SEQ ID NO: 688 - DNA, 499 bp, Homo sapiens
  CDS 264..497
attgaaggcggggaaataccgcggcgaacggtagttgctgtggtttccgttctgagctcgcagcttaggagctgaagatcgcggacttagcgttgccgcgtccgagtccggccatcagtggctgcagatccggagccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttccttttccttgtcatga

SEQ ID NO: 689 - DNA, 467 bp, Homo sapiens
  CDS 15..467
gcgccattccaaacatggcggctccactagggggtatgttttctgggcagccacccggtccccctcaggccccgccgggccttccgggccaagcttcgcttcttcaggcagctccaggcgctcctagaccttccagcrgtactttggtggacgagttggagtcatctttcgaggcttgctttgcatctctggtgagtcaggactatgtcaatggcaccgatcaggaagaaattckaaccggtgttgatcagtgtatccagaagtttctggatattgcaagacagacagaatgttttttcttacaaaaaagattgcagttatctgtccagaaaccagagcaagktatcaaagaggatgtgtcagaactaaggaatgaattacagcggaaagatgcactagtccagaagcacttgacaaagctgaggcattggcagcaggtgctggaggacatcaacgtgcagcacaaa

SEQ ID NO: 690 - DNA, 523 bp, Homo sapiens
  CDS 33..521
  misc_feature 480: n=a, g, c or t
tttccaggaagtgacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatngggagatcgacctgaaactcctcaccaaagtgctcgcgccgga

SEQ ID NO: 691 - DNA, 473 bp, Homo sapiens
  CDS 263..472
catagtactatattttaaattcaacaaaggccgttatcgcatttaacaacttactttttccacttgaatgtgtcactttatgctggtagttggttatcttaaatatgaatgaacaaatatgtattccttggtagagattaagaagagagaaaaagtgctgctaaaagattagagactcagacaaagaaaggaagaggaaaggaataaattcctactacatgttttgctagttacctatcttctcagcttagatcaaaaaggaatgtttggcgaggcgtggtggctcatgcctgtaatcccagcactttgggaagccaaggccgaagattacttgaggtcaggagttcaagaccagcctggccaacatggtgaaaccccatctctacaaacaatacaaaaaatcaatcaggtgctgtggtggcacacatttgtagtcccagctactcagaaggctgaggcaggagaatcacttg

SEQ ID NO: 692 - DNA, 503 bp, Homo sapiens
  CDS 255..503
tccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttcttagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactg

SEQ ID NO: 693 - DNA, 457 bp, Homo sapiens
  CDS 269..457
acatgttaaggaatgaagagtgtacccgtgtcggcaatggcaacgcgatcaggagtaacagcctagagttagctgcctccagtaacccgattttaatcgcccgttaaataccctttttgccttttccagaatgtcatgaaaatggaatcagaccgtatgtagccttttgaggatagaggatctcccccaccaccccaactccagtgagctttcagatgagattgtagccccagatgacaatgtccctgcttcccctttgccttccaccatgattgtgagtttcctgaggcctcgccagccatgtggaaccatggagtcttgccctgttgcccaggctggagtgcggtggtgccatctcggctcattgcaacctctgcctcccaggttcaagcgattctcctgcctcaccctcccgagtagctgggattacaggggccattatttccaatcacagaga

SEQ ID NO: 694 - DNA, 541 bp, Homo sapiens
  CDS 100..540
cttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtata

SEQ ID NO: 695 - DNA, 339 bp, Homo sapiens
  CDS 177..338
gccatcgcgcactggggctccgggcggctgggaccggcctggggtagctgcgcasaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaat

SEQ ID NO: 696 - DNA, 172 bp, Homo sapiens
  CDS 21..170
ttatttgagcgtggtggtggatgcatgtaatcccagctactcgggaggctgaggcaggagaatcgcttgaacttgggaggcagagattacagtggagccaagattgtgccactgcactgcattccagcctgggggacagagcgagactccatcacaaaaaaaaaaaaaaaaa

SEQ ID NO: 697 - DNA, 558 bp, Homo sapiens
  CDS 289..558
agagacgccggcgttactataagagcgcgcgtggcgcttccgcgctctttctcagtgaccgggtggtttgcttaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaagccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcag

SEQ ID NO: 698 - DNA, 435 bp, Homo sapiens
  CDS 104..433
attgagctgcgacccttgttcaacgccgttggcaavgcttgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaact

SEQ ID NO: 699 - DNA, 518 bp, Homo sapiens
  CDS 242..517
aagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcatag

SEQ ID NO: 700 - DNA, 387 bp, Homo sapiens
  CDS 139..387
  misc_feature 337: n=a, g, c or t
acaaaacaagggcagcttcgggaagaacacagtgaaaagtgacgcggacgggaccgagggaagcgaaatcgaggacactgatgattctcccaagcccgcagagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaawaaatctgggaaagaacagawggaacctccacctgcgaaanatgaaccacattttgctcatgtgctaaatgcctggggccatttaatccta

SEQ ID NO: 701 - DNA, 487 bp, Homo sapiens
  CDS 310..486
aaattagcagtttgaccttgggcaaagcagtttttctctcagggcttcagtttcctcttccgtacagtgcaagggatggagtagactatctttaaggtcccmttccagtgctaacatttgcagtttcaaaaccttttcccggatttccttcatacgtcttatggattmtcgcaggagccacagamtaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtg

SEQ ID NO: 702 - DNA, 480 bp, Homo sapiens
  CDS 64..480
aaggatcctctaccggcttttcgagtcagtgctgccgccgctgcccgcggtttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatg

SEQ ID NO: 703 - DNA, 496 bp, Homo sapiens
  CDS 9..494
aaaacaagatggctggggagttggaagttctgcgatctcaggaacgccgtttgaaagaaaaggttactaatatggaagtggctctggataaggcatctttgcagtttgcagaatgtcaagatataatacagcgtcaggagcaagaatcagtgcgcttaaaacttcaacacactttggatataaaagaacttcagggccctggatacacctcaaattcttcattgaaaccacgccttctccagccagcatctgttactcgttctcattctaatgtaccatcttcgcagtctacagccagcttcctgtctcatcactctacaaaagctaacacactgaaggaagatccaacaagggacctgaaacagcttctccaagagttgagaagcgtgatcaatgaggagccagctgtgtctctgagcaagacagaggaagatggaagaacatctctgggagccttagaggatagggtaagagattgcattactgaatccagccc

SEQ ID NO: 704 - DNA, 492 bp, Homo sapiens
  CDS 289..492
agaaaggcggaasagtgtcccaggcgttctcacgccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcagkccctgtggggggactctccaggaagaaggttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggcctcacgcctgaacaagaaaacatattgcata

SEQ ID NO: 705 - DNA, 479 bp, Homo sapiens
  CDS 163..477
agcccaacatggcgatgcacaacaaggcggcgccgccgmagatcccggacacccggcgggagctggcggastcgtgaagcggaacaggagctggcggaaacattggcaaatttggagcgacagatctatgcttttgagggaagctacctggaagacactcagatgtatggcaatattattcgtggctgggatcggtatctcaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaagaggaccctgaggatctggatggatctgtgcagggagtgaacctcagaaggctgcttcttct

SEQ ID NO: 706 - DNA, 672 bp, Homo sapiens
  CDS 228..671
aaaaaaggagccggcaaaagcgcctacgtggagtccagaggagcggaagtagtcatatttgactgagasccgtaaagcgcggctggctctcgttttccggataacgactacagctccgactgtcagtgccggccttcctcgtgtgagggratctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatga

SEQ ID NO: 707 - DNA, 401 bp, Homo sapiens
  CDS 147..401
tttttagtggaaagctgtagcagaggataagggtttgggaatagcgttaaaggtcatgacttatttctcagtttttatggaatttttcagtaaaaagacttgaccgtcaaagaaaaggaaactgctgttatcaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcc

SEQ ID NO: 708 - DNA, 501 bp, Homo sapiens
  CDS 44..499
  misc_feature 495: n=a, g, c or t
atcaccgcagcgggcctcgcgggtccgggagcgcggcgagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtscaactccaccagacggtccaggtagatgatgagctggagatcanggccta

SEQ ID NO: 709 - DNA, 400 bp, Homo sapiens
  CDS 213..398
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggtttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagtatttctaaaaaaaaaraaaaaaaaaaarvaaaaaaaaaaaar

SEQ ID NO: 710 - DNA, 472 bp, Homo sapiens
  CDS 28..471
ctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaaaaaaaaaaggc

SEQ ID NO: 711 - DNA, 370 bp, Homo sapiens
  CDS 211..369
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagasagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagtatttctaaaaaaaa

SEQ ID NO: 712 - DNA, 484 bp, Homo sapiens
  CDS 305..484
atcagtagctgcaccactagaaagatggcggasaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctgggtgagtgctacagcttaggggtcagctggggcaga

SEQ ID NO: 713 - DNA, 490 bp, Homo sapiens
  CDS 193..489
  misc_feature 389: n=a, g, c or t
cattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccaaggtgtgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggnacaaatctctcagccacccctggttacaggagtaccagacgtggctggacctccgagagctggaggggaagatgggagagcgatacatcacgcatkagagt

SEQ ID NO: 714 - DNA, 534 bp, Homo sapiens
  CDS 116..532
aacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtrtgtgtgcagaaaggggaggtccccaaccggggctggagacactggctggagggagagatgctgtatctggaactgactgcaagggatgcagtgttgcgarcaggtcttcaggaaggtcagatagccctgagaga

SEQ ID NO: 715 - DNA, 525 bp, Homo sapiens
  CDS 336..524
atagtggaattataagccaactgttacataaggtttacagaaagtttaaccttgttgaaggacagtgttgagcaagaactcccttcctctccaaaacaacctatttgttttgagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgcacagaatcaaaagtttctgt

SEQ ID NO: 716 - DNA, 454 bp, Homo sapiens
  CDS 178..453
ctcatttccaggtcagcccccggcctgacgcggcgttgcgtcccccgggagctgcgctaggcgaacggctgcggcgctttgtgctccagtcgctcctaacgctccctggcccggctggggcgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagac

SEQ ID NO: 717 - DNA, 452 bp, Homo sapiens
  CDS 290..451
agatataaaaaatacagcttagaaaatgtgtacattgagtgctgtaatcagaaaatacttttgtgccattgacttgtaaaaagggaatttcaatttttttgtttattgtcattttcacctaccttaatattctcaaaaggctttcatgattatgctccttttagattttaatttttgttgtcttagtcaaaaaacatgcgagggttggaaacacttgttcaagatgtgtgagacatgagcaatcaacagagcaaaaacactggtattttatgggaatatgtaataatagatgggcacttgccctgctaggtatggcagcagtcagggtctgtgggcttcagtgctgtacacagaattgacagatcctgctttaaggaaaaaagtgcccctcatctgtcgtacgacagcctggcaccattttgttaccaaacccaggtttggccatggcactt

SEQ ID NO: 718 - DNA, 495 bp, Homo sapiens
  CDS 305..493
caagataaagctcatcaatttcgtcatcagtaaaaagagggcataactgggatgtcactaactgctactgttaaaatgagcatgtattaaaatccttatggatgtccccttcatattcaacattaattagaaacctgccctatctcagtgttcttctataatcaatccccctttccagtattactaaggtaactgtaagccctgcatgcctgaactgtcctggtttacacctgtttttccagcataattgttaattgcaaccctgttcactgtctgatgaatcttggtttggacgataaattatatggtcaacctaagtattagagtccctgggataaacaatcaaggtgtcattcttatttattggtattggtttgtcacaagctgtgaaaacagtttttcttttgcttgtttcttcctgagttgtcacgaagaccttcacataaaatcactctctcccattaaagtaattattgaagccccttcagtaatgac

SEQ ID NO: 719 - DNA, 492 bp, Homo sapiens
  CDS 116..490
  misc_feature 485: n=a, g, c or t
agtgttagactgaagataaagtaagtgctgtttgggctaacaggatctcctcttgcagtctgcagcccaggacgctgattccagcagcgccttaccgcgcasccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgccctcaatacttnctattgt

SEQ ID NO: 720 - DNA, 469 bp, Homo sapiens
  CDS 97..468
aaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaa

SEQ ID NO: 721 - DNA, 485 bp, Homo sapiens
  CDS 205..483
catatgattttatggtaaaggtgtgggatccagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacac

SEQ ID NO: 722 - DNA, 560 bp, Homo sapiens
  CDS 265..558
tttttgggaattttacttcttcctccttgacctgagctggatcgcgcgggtttaacaggcgctastgggttaatacttgactaatatgaggcgttattgacacccagattgttaagttacagaactccagtcagccctgcctatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacac

SEQ ID NO: 723 - DNA, 499 bp, Homo sapiens
  CDS 315..497
actcgatcccgtggtgctccgcggcgsccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggagtgrcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgcatgttcttcatcggtttcaccgcgctcgttatcatgtgggcagaagcactatgtgtacggcccccctcccgcaaagcttttgacaaa

SEQ ID NO: 724 - DNA, 469 bp, Homo sapiens
  CDS 277..468
gtagagggcggtcgcggcgggcagtggcggcaggtgtacatttttatctttcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggagtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgcatgttcttcatcggtttcaccgcgsskcgttatcatgtggcagaagcactatgtgtacggccccctcccgcaaagctttgacaaagagtgggtgg

SEQ ID NO: 725 - DNA, 531 bp, Homo sapiens
  CDS 257..529
ctttaaatagtgcagtgagtccatgtggcagcaggccgctctggagtgtattcttttgtaatgaatcaccagttccattgtctgctatctcccctctttgtagctggaaggctgaagtctttcacctgagctgctgccagttcgctcttctgttcctgggtggttgggagaagagaagagggagggtattttatgctttaattaaagacagataagagagcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcaaggagagtaaatctacccgaaac

SEQ ID NO: 726 - DNA, 503 bp, Homo sapiens
  CDS 256..501
agattccatggaccagcccaggaacccctgtgagaacgagcctctgactccaggttatcatggattcccagcgcgggacagccagatgaggcaaatattccctctggaaagatgaggaaattgaagcacacagaggtaaagtgacttatccaaggcaacaattcaattttggcatcttctttcctgtggwtcactgaagtgcctttttgcagtccaggatccactgaccgctgagtttgagcagcccgatctgacatgatgtacctctggggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaga

SEQ ID NO: 727 - DNA, 396 bp, Homo sapiens
  CDS 157..396
gtcaaaatggcagcgcccggcgtgcgcgggtatctctgaagttggggtttaagattcttgcccgtgagagcgaacgagcctgscgtacttctgattttgaaacacctgggtctgggcttcccgggcgagcggtggaacctgtgagaagtttctacaatggtgggctcagctctcaggagaggtgcccatgcatatgtctacctggtgagtaaggcmagtmamwtctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttgtcaggaacctgcacaac

SEQ ID NO: 728 - DNA, 478 bp, Homo sapiens
  CDS 96..476
gcaaacgccggcttcccgtggctgaacaggatccaaaatggcagcgctgtcgccttagctgggagagcgagccgttgtggctgtttgggagacttatggtcaccctgaagtactgcctgcctctagtgtcgcgtccctccagtatccgatgggagcgccgtccgcaggaatgtgtctctctgatcatggtgcctcgtgtccagctctggggaagaccgagacgaaatcgagtcagctggcgttgggagagggcttatttccgcttccgcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaactgggaatcacccggagagg

SEQ ID NO: 729 - DNA, 470 bp, Homo sapiens
  CDS 243..470
aaacaacaccctttctgcatcctgttacagggaaatttgctgagccctttcctgaactgcacctggtgaacttctactcttcatcacttcctctggtgccttccctggctccctggcatgaaactgccctggtatacttttaagtatactggacgaacaagaatatgttgtttctcagcagtgtccttttaaagatctcccagaatttgccctgagtagggaattcagcctctgtagattatatggaacctgcatttgtagagactgttggctgtccagtagccagtcagattggggtgcttggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcct

SEQ ID NO: 730 - DNA, 512 bp, Homo sapiens
  CDS 132..512
gccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctcca

SEQ ID NO: 731 - DNA, 519 bp, Homo sapiens
  CDS 198..518
gatttggcacgaaaggaagtggaagamacgcggaaccatggccgctgtggttgctgtttgcggtggtctagggaggaagaagttgacacacttggtaacggctgctgtcaagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacagctttttattttacaggtctttgtgggaagaaacagaaagaaatcacaaaagcaattaagagagctcaaataatgggggtttatgccagttacatacaaggatcctggcatatctcaaggaccctaaagtttgtaacatcagatatcgggaataaattctatcacgttaccaccaaaaaaaaaaaaaaaa

SEQ ID NO: 732 - DNA, 380 bp, Homo sapiens
  CDS 136..378
atgctgcatattcatttgcagaaaatcctgaacattatattgacatagttagagaaaaggccaaaaaaaatacagagttaattcagctattggaacttcatcaacagtttkraaacatttattccatattctcagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcac

SEQ ID NO: 733 - DNA, 381 bp, Homo sapiens
  CDS 189..380
  misc_feature 141: n=a, g, c or t
acatagcaaaattgagcagaaagtacagagttcccattcattccctgcccccacacatgcataaacaaggatcagcatctccactagagtgatagatttgttacaatcaatgaactttcactgattcatcattaccccccnaaagttcataatttacattagggttcactcttggtgccatacattatatgggtttggacaaaagtataacgatatgtatccacttttgtagtattatacagagtggttgtcactgcccccaaaatctctgtgctctgcctattcatcactctctcctaatccttggcaacctggacttctccgtatttttgcttttccagactgttatgtacagtatttggaatcacacagtatgtagcy

SEQ ID NO: 734 - DNA, 280 bp, Homo sapiens
  CDS 129..278
acatagtgactgtactctaacttaatgtgtaaataagttgtaagctaatgtagatgtatggacttgtaaccaagcaactgagactcaaccaatcataggagccaaacccttagtcaatcccaaactgaatgctgccaaattatgcccaaataaggcaaatattgaactgcaccaatcagggaaactctgaatataattttctatgttctggttataaatacatctcaccactctggatgtggagtcactctgaacaatcttcgttctgggatggtgccta

SEQ ID NO: 735 - DNA, 490 bp, Homo sapiens
  CDS 341..490
acacattcgttaatcaaaatgctaacaagagaaagctaaggatagagcttcgcagaaaggccagagaggtctttttaaagcataaataagatagcgatcttcgggttaaaactttgttggctttgtcggcgggcccatccctcctaaaatccaattctatggcttaaaaagccaagacctgccttgtctatcagggcccatgcccaccgttccctggttattgttgcttagctttacgaggcagctcttctctaagacccttagctggttcctgactcggggcctctgtgatcactgttccttttgtctggaatgccccctcktcgtttaggtctcatggatgcctgccctgaccacaccaagccgtttctccccctctggctctctatctttcgttctgtttattcaaggcactttgcatctgaaattatctgcttccccgactcgctccgagaagctcaaggacctgtcttgtgttggtgctcaatat

SEQ ID NO: 736 - DNA, 497 bp, Homo sapiens
  CDS 304..495
aagatgcggaggagggtgacgcactagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgcaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtaccagaccctccaaatccctgtcctgttggaaaaacagatgatggatgtcta

SEQ ID NO: 737 - DNA, 474 bp, Homo sapiens
  CDS 310..474
atttacatgtattcttaccaatgtgtgatattttttgctaatttttttcccaacttgatggcttaggccagaktctttcaagaaaaaaagtcttattagagaagtcttcatatctcgtgaggatgaattaaaagcagaatctcaactttgctacctttaaatgtcacggagagaaaaaactgcaaaaccatgtgcamaatatccatgataaatcatctttgatctcaacataacggagactataaggagtataaagactagaagaaagagtagaaggtgatccacaatcaattcagaacctggtcttctatggtggctcacagttcctgcaccctacaatatcgtggtaaagatggtgagatatttktccctagaacgcagataactggatcaaggctactcttcctggaaacctcatgtatgccacctgcccaaccatttctatggacatattatgaagactacataggagac

SEQ ID NO: 738 - DNA, 498 bp, Homo sapiens
  CDS 311..496
aataattttacatgatcctcaatatcaactccagtttaaaaagtgttatttttaaaacatttgaaaccaagtactgtttaatttcaatcagaagatgcaaataaatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatagacaatgtatgtgttttaataaatggaattt

SEQ ID NO: 739 - DNA, 516 bp, Homo sapiens
  CDS 228..515
attttacgtggtgctgcatttccggtagcggcggcggggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcattcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctgggcagagkgaatcccagctggggttcccatgccccaggctcctgcaggaacttgctgggccagtccgtg

SEQ ID NO: 740 - DNA, 454 bp, Homo sapiens
  CDS 229..453
actcatctgggcggcggcggcaagtggggacagggcgggtggcgcatcaccggcgcgsaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggcmgcagcccgcgttcaagtaccagttcrtgagggagcccgaggacgaggaggaagacctggaggagctggaggtgctggagaggaagcccgcmgcmgggctgtmcgcggccccagtgcmcacmgcmcctgcmgcmggcgcgcccctgatggacttcggaaatgacttcgtgc

SEQ ID NO: 741 - DNA, 463 bp, Homo sapiens
  CDS 237..461
  misc_feature 20: n=a, g, c or t
actcctagctcatctrgbrnrgcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggcmgcagcccgcgttcaagtaccagttcrtgagggagcccgaggacgaggaggaagacctggaggagctggaggtgctggagaggaagcccgcmgcmgggctgtmcgcggccccagtgcmcacmgcmcctgcmgcmggcgcgcccctgatggacttcggaaatgacttcgtgcm

SEQ ID NO: 742 - DNA, 503 bp, Homo sapiens
  CDS 79..501
ammkkrmgamsrkwycmsctwgcgmscsywkssrctmgckyggsctssswkkyssttsssmymysyrkksswkcmcacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcartgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaacwrayyrkykwsyswswmmmcrrmywtkmgtctwccwsrwwsatmwwswwmmwggywrrwmraykwaaaggcaagaagatgaa

SEQ ID NO: 743 - DNA, 327 bp, Homo sapiens
  CDS 31..327
ttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagawaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattgg

SEQ ID NO: 744 - DNA, 450 bp, Homo sapiens
  CDS 89..448
aagctaggagccgcgcgagtcgtagtgtcgctgtttgcgggtctccgcgcgggaccggggcgcacggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctgggagcgaccgcagccaaccagaagcgaatcaccacaccatacatgaccaagtacgagcgagcccgcgtgctgggcacccgagcgctccagattgcgatgtgtgcccctgtgatggtggagctggaggggagacagatcctctgctcattgccatgaaggaactcaaggcccgaaagatccccatcatcattcgccgttacctgccagatgggagctatgaagactggggggtggacga

SEQ ID NO: 745 - DNA, 473 bp, Homo sapiens
  CDS 290..472
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagasatgaagccaccgggaggaaagaacaactctggacgcgccaactttatgaactgtaacactcaacgcaaaggtctgcagcttcactcctgacgtctgtaagmcatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaakhctggacacagcaccattattcacaacagccaaaaagtggaaacaattcaaatgtccatcaactgatg

SEQ ID NO: 746 - DNA, 519 bp, Homo sapiens
  CDS 217..519
gattgttacagcagagaacaacggagacattctgttttgaagaccagtggattttgactttattcagtcaactccctttaaacctctggcactaaaaccaccgcttcatatactttaagtggaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaagtgaa

SEQ ID NO: 747 - DNA, 474 bp, Homo sapiens
  CDS 91..474
acactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaa

SEQ ID NO: 748 - DNA, 473 bp, Homo sapiens
  CDS 91..471
acactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctaca

SEQ ID NO: 749 - DNA, 454 bp, Homo sapiens
  CDS 91..453
acactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatca

SEQ ID NO: 750 - DNA, 459 bp, Homo sapiens
  CDS 91..459
acactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggyctgctgccgccacttctaatcctcatcatgacaacgtcaggtatggcatttcaaatatagatacaaccattgaaggaacgtcagatgacctgactgttgtagatgcagcttcactaagacgacagataatcaaactt

SEQ ID NO: 751 - DNA, 479 bp, Homo sapiens
  CDS 91..477
acactagattttctggatttagaaagacctcctacaacccctcaaaatgaagaaatccgagcagttggcagactaaaaagagagcggtctatgagtgaaaatgctgttcgccaaaatggacagctggtcagaaaygattctcttstgacaccatcgccacaacaggctcgggtctgtcctccccatatgttacctgaagatggagctaatctttcststgctcgtggcattttgtcgsttatccagtcttctactcgtagggcataccagcagatcttggatgtgctggatgaaaatcgcagacctgtgttgsgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttct

SEQ ID NO: 752 - DNA, 377 bp, Homo sapiens
  CDS 6..377
agtggatgctttggcaagatggcggggagcggcgtccgccaagttacttctaccgccagcaccttcgtgaagcccattttcagtcgggacatgaacgaggccaagcggagggtgcgcgactctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggattttcctatc

SEQ ID NO: 753 - DNA, 182 bp, Homo sapiens
  CDS 28..180
  misc_feature 99,101..102: n=a, g, c or t
gtaccacctcctggaacccggggctgcatgcgggtggcaccactctttgaagcggtaccagagctcagctctcaccgtttgctccgaaccgagcccggnannsggaccgtgccagtttggctcgatgccccaaaactaaccaccgaggtcccattcagctgtggcagttcctcctggagctg

SEQ ID NO: 754 - DNA, 487 bp, Homo sapiens
  CDS 43..486
cgaaaagaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttg

SEQ ID NO: 755 - DNA, 499 bp, Homo sapiens
  CDS 236..499
agttagcgctgatgcaactatcgttgctgttgccaccgcctccccactgacggggcgtgcacctggggggtacttgcagtttccaggggcaacaagcatctctctaccaccctctcctgcgcccctgagagaggctggctccaagcttgatatagaagactatcatatgaaccagaaagggtaactgaaaccaaagaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacagtatctaggcccacatgcaatatgactttgcaactcatcccatcagaggatggaaactatttcttcacccccttgaacctgggctggctttgtaatttgttttggccaatagaa

SEQ ID NO: 756 - DNA, 307 bp, Homo sapiens
  CDS 6..305
ttgtgatgctgaagaaggatgtagatgctgcctacatgaacaaggtggagctggaggccaaggttgatgcactgatggatgagattaacttcatgaagatgttctdtgatgcggastgtcccagatgcagacgcatgtctctgacacctcagtggtcctctccatggacaacaaccgcaacctggacctggatagcatcatcgctgaggtcaaggcccagtatgaggagattgccaamcgcagccggacagaagccgagtcctggtatcagaccaagtatgaggagctgcagcagacagctggccgg

SEQ ID NO: 757 - DNA, 494 bp, Homo sapiens
  CDS 36..494
gctaggagttcctagtaaagtggcgggacgcagctatggagccgcagaggagagaaacgcaggttgctgcgtggttaaaaaaaatatttggagatcatcctattccacagtatgaggtgaacccacggaccacagagattttacatcacctttcasaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaa

SEQ ID NO: 758 - DNA, 392 bp, Homo sapiens
  CDS 136..390
cgaagatggccaattagaagcagctgcagtctgtggcaatcatgaagcggaatgaaaggggcaagtgataatagcaccttcaactgaaatatccaggttctcacattgtgactgattaggcaaacaactcaacccatggataatgaagaaaagcagggtgggatgatggcccacccaagagtggcacagagccaaaggactccccacccccggccaagggaagaagtgagttattgtgtgaccccacctgggaaaccacgcttctcccaggaagcaacctgtggaccaggagatctcatgaacccactctaccagagccttgggtctgatacacagagctgtgcagagtcttggcagagcagccactcaggcacacacagaaacccaggact

SEQ ID NO: 759 - DNA, 368 bp, Homo sapiens
  CDS 211..366
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagasagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagtatttctaaaaaa

SEQ ID NO: 760 - DNA, 467 bp, Homo sapiens
  CDS 68..466
  misc_feature 393,425: n=a, g, c or t
ataggagttctcaggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggyttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagnggagagaacacgaatcmagttcataagatggngccacactcgtatcttccaagtgcmaagtgagatgacagagg

SEQ ID NO: 761 - DNA, 352 bp, Homo sapiens
  CDS 100..351
aacaagaacttgaaatgtggttagtgtgactgaggaactgtgtttaaattttaatttcagtagccacatgtggtaatggctactttataggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagcttccttgattctctctcagccagcacagctcaggccagttc

SEQ ID NO: 762 - DNA, 326 bp, Homo sapiens
  CDS 75..326
agcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccamgggcacctaccacggggacagcgacctgcagctggaacgcatcaacgtgtactacaatkargccaccggcggcaagtacgtgccccgcgccgtgctcrtkgatctggagcccggcaccatggactccgtgcgctcrrggcccttcgggcagaty

SEQ ID NO: 763 - DNA, 386 bp, Homo sapiens
  CDS 36..386
tcggagagagggctgtggtaaaagccgtccggaaaatggcmgccgccgccgccgccgcgccgagcggaggaggaggaggaggcgaggaggagagactgctccataaaaatacagactcaccagttcctgctttgatgtgrsatgtgactccccagaatacaccttgcttctgtagascagctccaacaggattccatggtagctgggatgttagggctcagagtctcgctgtctcccaggctggagtgcggtggtgtgatctcggctcactgcagcctccgccttccgggttcgggcgattctcctgcctcagcctcccaaatagctgggattacaggacccaggagggagaagcagctgccaggggaagtctcttcgtaggcggr

SEQ ID NO: 764 - DNA, 472 bp, Homo sapiens
  CDS 303..470
  misc_feature 237: n=a, g, c or t
cttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctagacccctaccctctaggctgtgctgctcctggacttcatccctctccattctcattgcctacaatctctgtncccagaaccccctccacttcccaccccagccctccagacatgcacttaccttgactttaccccacatgtttggggcactggggctccctcaccccttgggtggtttgcaatctgaagacttctccagccacacaggcacatgcacaggcacggtgctgtctgcatattgccaggtggggagagagccaggrmccctcagctgtctgccaccatctatgtgcctcccttacccccc

SEQ ID NO: 765 - DNA, 457 bp, Homo sapiens
  CDS 141..455
caactccctaattccagaccccagcctcctaaatctattctgggcttcccaccccactgaacttacccaattccttctttcagtcttaagttttcccattctagacccctaccctctaggctgtgctgctcctggacttcatgcctctccattctcattgcctacaatctctgtgccccagaaccccctccacttcccaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggsctccccccttcttagccccatttamcccgtttgtggaargcactgctcgctctgttttgtcag

SEQ ID NO: 766 - DNA, 492 bp, Homo sapiens
  CDS 149..490
tcggtgagtggagtcggacagtggggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggagagcaccatatccttttgctgttgaaaatcaa

SEQ ID NO: 767 - DNA, 520 bp, Homo sapiens
  CDS 159..518
gcgcmkctttagtcgcgggccgactggtgtttatccttgtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtaga

SEQ ID NO: 768 - DNA, 544 bp, Homo sapiens
  CDS 263..544
agaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggtt

SEQ ID NO: 769 - DNA, 538 bp, Homo sapiens
  CDS 68..538
gacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcattt

SEQ ID NO: 770 - DNA, 477 bp, Homo sapiens
  CDS 138..476
cagaaattataacaaactgtctctcaaactacagtgcaatcaaactagaactcaggattaagaaactcactcaaaaccactcaactacatggaaactgaacaacctgctcctgaatgactactgggtacataacaaaatgaaggcagaaataaggatgttctttgaaaccaatgatagcaaagacacaatatacaagaatctctgggacacattcaaagcagtgtgtagagtgaaatttatagcattaaatgcccacaagagaaagcaggaaagatccaaaattgacaccctaacatcacagttaaaagaactagaaaagcaagagcaaacacattcaaaagctagcagaaggcaagaagtaactaaaatcagagtagaactgaaggaaatagagacacaaaaaacccttcaaaaaattaatgaatccaggagctggttttctgaaaggatcaacaaaattgatagaccgctagcaa

SEQ ID NO: 771 - DNA, 506 bp, Homo sapiens
  CDS 330..506
aaaacttgggactgcgctggggccgcgtgtggcacctcaggggggcggcccccggctcaagaggagggggaggagaaggaggaagaggaggaagtgagcccgaagatccgctctgagctgtttgtccagctgtttctattcgcacccggagcagtacagccagaagggggccgagccgaagtggctggctttaggcgctaatttccaactcttttcctcacagcttgtcttttccaggcaccctggagtsccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaac

SEQ ID NO: 772 - DNA, 376 bp, Homo sapiens
  CDS 151..375
aagttcgtcggggcctttccggccggtaccagtccgagctctggtccccacggtcatcacgctttgctttctcagccaagatctcggggctcagggcggaaacgcagcggatatgtattttcttccggggttggtggcgctcggcttttcatgacctgcaggaraagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttcccc

SEQ ID NO: 773 - DNA, 499 bp, Homo sapiens
  CDS 153..497
cccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggastgcaggaggtgcagatcacagaggagaagccactgttgccaggacagacgcctgaggsgccaagactcactctgtggagacaccatacggctctgtcactttcactgtctatggcacccccaaacccaaacgcccagcgatccttacctaccacgatgtggactcaactataaatcttgcttccagccactgtttcagttcgaggacatgcaggaaatcattcagaactttgtgcgggttcatgtggatgcccctggaatggagagggagcccctgtgttccctttggatatcagtacccatctctggaccagcttgcagacatgatcccttgcgtcc

SEQ ID NO: 774 - DNA, 498 bp, Homo sapiens
  CDS 342..497
gaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctctcccattgtcttttctggcttctccaggttccctcga

SEQ ID NO: 775 - DNA, 498 bp, Homo sapiens
  CDS 192..497
aggcagttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgatctttttgagctttatcctgaatttcttctggtgtttaaag

SEQ ID NO: 776 - DNA, 487 bp, Homo sapiens
  CDS 255..485
caggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctg

SEQ ID NO: 777 - DNA, 748 bp, Homo sapiens
  CDS 99..746
ctgcgctagttgtgacgcatactatagcgctgttttcctgcactgataaacgaaaagcaatccaccaggtctcggcagctaactttccggcactacttatgcccgagcgtgtcgctcccagtgcgcaagtgcagcaggtggctgcacgggggggcgcgggaggaggaggaggaggaggaggaggctggggtggggccggcggcaagtgctgtgatgcggttccggggaggggccgtcgggtagaggctgaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgmcatcggctcccagctgtctcctgaacagggaagctcaggcattgagatgctggagacagacacattcaaattgcactgctaccagacactgacaggggatcaaagtttgtg

SEQ ID NO: 778 - DNA, 589 bp, Homo sapiens
  CDS 91..588
gttagcggatacggcggccgcagggcgagtcaagggcctttgccgccttggcccggctctacgttccctgttctcgcctgcagctccgccatggctcctaaaggcagctccaaacagcagtctgaggaggacctgctcctgcagaatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactaca

SEQ ID NO: 779 - DNA, 471 bp, Homo sapiens
  CDS 78..470
ggatctcaaacagtcgggaagaagcaccgtggctgctattatctgctctccgctcctgacccctcccaggactcgtgatgccaaggccgctgcgagcgstacgaagagtcgtggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagactctgcacaaaactgtaccagggcaataaacaacaaacagttatttggtagagtgataaaagcaagcattgctattgacaatggaagagcagctgagttcatccgaa

SEQ ID NO: 780 - DNA, 704 bp, Homo sapiens
  CDS 131..703
  misc_feature 119: n=a, g, c or t
aatttgcgcggcgaggagcggagcggcaggaacccaataagctgcttcgcctcggagctgaagcccgtactcaagatggcggctccgggcgggcgtggccagtgactagaaggcgaggngccgcgggaccatggcggcggcggcggacgagcggagtccagaggacgaagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggragagattcaaatgaacgacagttcaaacctgagttgtgaacaggagaaaccaaaccacttggaaatagaagattctg

SEQ ID NO: 781 - DNA, 502 bp, Homo sapiens
  CDS 196..501
attttgcatttccaccagcaatatatgatagttcgtttatttcacatctttgacagcatttagtgttgtcagggttttttttgtttgttttagacattttagtagtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaat

SEQ ID NO: 782 - DNA, 487 bp, Homo sapiens
  CDS 312..485
ccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttavaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaa

SEQ ID NO: 783 - DNA, 516 bp, Homo sapiens
  CDS 352..516
aaagggccctgacaagaggatgggactgcagttgtggctgccagggccccggccagggtgaaaacaaggaacattccagagaagatcacaaggatgcgaataaaatcggagctgcacagggatctttgggctgttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaaggaagaatgaggaagcctgggacagtgcaggaggggagagcactggtggtagagaggagtgatgacaagggtctccgccaaaagggaaatggaggggttaaagaagctgctggggagggtttaaaaacaatgtgttctcactcg

SEQ ID NO: 784 - DNA, 468 bp, Homo sapiens
  CDS 291..467
  misc_feature 410: n=a, g, c or t
aaccatattcttgatccctgtaacatttattggcgtttcgcgtaggtctctgataaatgtttgacgtctttgtgtgtcttcacactttgttatcctgaaactgtgtcatgtagacataaatggtcacagtttgtcttaaaagtctttaggaaaaggtgatactagcacttgggctagaaggtcgtgcagagcagaggaagaaaaaggcccactgctgtctacaaatgaatgggaagatttaagatctttcaaagcaagttgagtctagacccttgcccaagttttgtaacatgattttgtctctttccccccttttcatgcagattatccatggagttagcatgcagatagcatggagtttgtctgatagaagttgggctctggtggaagtacggaaattgaatggtcanggaaagatagaatgcaggtttcttagggagtctctattaggtttccagcctgccttcc

SEQ ID NO: 785 - DNA, 515 bp, Homo sapiens
  CDS 351..515
agtgttctaaagtgtagttactgaatatagtttcaccaggaagctactttgaagaaacctatcagagtagagggccttcattctgcttctggccttactctcacttgccttgggatctttatcaagtctgttgaatatctttgcactttagtgtctatatctgtaaagtggaaaatttttgtgtgtggttttttaaatatctcttaaatcctgataaacagctaaacagtatcaaaaggcagctaaattgtataaaaaaatacctgcaaaaaccatacaaatgcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggytttgcagatttaccag

SEQ ID NO: 786 - DNA, 516 bp, Homo sapiens
  CDS 248..514
actgctcccacgtgttctttcccatctggcggccgcggctcctgtccagaccctgaccctccctcccaaggctcaaccgtcccccaacaaccgccagccttgtactgatgtcggctgcgagacctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatt

SEQ ID NO: 787 - DNA, 476 bp, Homo sapiens
  CDS 76..474
accgacgggcgcacccaggtaggggggcggctgagcggcagtgcgaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgcgcgtgccccagcggaaggwggtatccggtgccggaaat

SEQ ID NO: 788 - DNA, 618 bp, Homo sapiens
  CDS 306..617
atcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatgtggaggaacatgaggctgtttgtgtcaacaggagcgctgtggaagaagaggacaccgagaaccctctgaaagtcagtcctcctagttcagagcagaacgatgacacccagcaggtctcaccctgccttcccagccccgatatctgga

SEQ ID NO: 789 - DNA, 378 bp, Homo sapiens
  CDS 212..376
  misc_feature 295,302,307: n=a, g, c or t
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagaaccaaatngagaatnggctngacctctcggagctccttgaaggaagggaccaaggaagcacacgaccgggcagtatttctaaaaaaaaaar

SEQ ID NO: 790 - DNA, 494 bp, Homo sapiens
  CDS 53..493
acaaaccgaaccgtgaatctttgcggtttctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaaaaaaaaaaa

SEQ ID NO: 791 - DNA, 464 bp, Homo sapiens
  CDS 273..464
  misc_feature 19,178,186..187: n=a, g, c or t
acttacttagggcgggabncgagggcgcsggtggctttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgcnatcccttnntgctcctcagactgggcgcttctgagggaggaagaaaaggagaaatacgcagaaatggctcgagaatggagggccgctcagggaaatggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgt

SEQ ID NO: 792 - DNA, 484 bp, Homo sapiens
  CDS 206..484
aggataaggcagctcctggaagctccaccaggacccacgtccaccagccctccagccccagcaccccaccctgcgagatgcttggtcctgtgggcattgaggccgtgctggaccagctgaagatcaaggctatgaagatggggtttgagttcaacatcatggtggtgggtgagtgagagggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgg

SEQ ID NO: 793 - DNA, 492 bp, Homo sapiens
  CDS 244..492
atttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcatttttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcttcagtgtgtttggaatcctggtct

SEQ ID NO: 794 - DNA, 453 bp, Homo sapiens
  CDS 24..452
ctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaraaaaaaaaaaaaa

SEQ ID NO: 795 - DNA, 547 bp, Homo sapiens
  CDS 352..546
agctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaagaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgccactctcaatgc

SEQ ID NO: 796 - DNA, 489 bp, Homo sapiens
  CDS 113..487
cattgtttccattgaatacaggctagttccaaaggtttattttcctgagcaaattcatgatgttgtacgggccacaaagtatttcctgaagccagaagtcttacagaagtatatggttgatccaggcagratttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgt

SEQ ID NO: 797 - DNA, 497 bp, Homo sapiens
  CDS 182..496
gagccacacggcgcgacaagatggcggataaggagaagaagaaaaaggagagcatcttggacttgtccaagtacatcgacaagacgatccgggtaaagttccagggaggccgcgaascagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcagacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcagaaaaaaaa

SEQ ID NO: 798 - DNA, 478 bp, Homo sapiens
  CDS 279..476
atatatacaaaggagactaaggaacagataaggggaaaaaaatcaggagtcattcacagaagccacatgctaaagatgaagtgggaaggaaaatgcctatcaaatggagcaaaaagatcaatataagggtagaacaccagagaatttttatctggagaaataaatgggagacaattaagtggaagaaatatggggagggacagatacaaggaagtatgtgtgaagtggaaatcaggaggtgagatggaggacaaggaagaagcagagttaaaagcagcatgaagaagttaaaacctggactcactgaccctgtgttaaaatttagtgctaaatgtaagcaacaacactggagcattgttattttatcaagacacctgaacatagcaaaattaattttgttcatttttattaacataggacatactaaccaaatattatcatttaataaaatcaacgttacaaagaaactcactagcaa

SEQ ID NO: 799 - DNA, 453 bp, Homo sapiens
  CDS 24..452
ctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaaaaaaaaaaaa

SEQ ID NO: 800 - DNA, 577 bp, Homo sapiens
  CDS 124..576
aattgcctcggtgatgtcgtgggttcaagcagcctccttgatccagggccctggagacaaaggggacgtgtttgacgaagaagcagacgagtcgctcctggcrcaggggaatggcagagtaacatgcaaagacgagtcaaagaaggttatagagatggaatagatgctggcaaagcagttactcttcaacagggcttcaatcaaggttataagraaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagacaca

SEQ ID NO: 801 - DNA, 194 bp, Homo sapiens
  CDS 20..193
agagtttcaaaaggagatcatgaggcgtccaccttgcagtcatgatgtggaacctgctgacttctatttatttcctcgtattaaaaattctgcaaacggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaad

SEQ ID NO: 802 - DNA, 444 bp, Homo sapiens
  CDS 191..442
ttcagattttgaaaagaaaacaagtaatcgttctgagattgaaacccagacagaggggagcacagagaaagagaatgatgaagagaaaggcccggagactgttggaagcgaagtgkaagcactgaacctccaggtgacatctctgtttaaggagcttcaagaggctcatacaaaactcagcgambdctaaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaact

SEQ ID NO: 803 - DNA, 466 bp, Homo sapiens
  CDS 233..466
gagagagatgagccgcggcgatgagcccggaaaagcagcaccgggtagaggatgaagttgactccgttctcctttcagcgtccaagatcctaaattcttcggagggggtgaaggaaagtggctgcagtgacacagaatatggctgcatagcagaatcaggaaratcaaatccaaccacaatcagsattggaarkkcsttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggacttgcctacagagaatcaagaagaaaacctttctatggagaaaagtcatcattttgaggattccaagacacttcattcagtggaagaaaaattaagtggt

SEQ ID NO: 804 - DNA, 448 bp, Homo sapiens
  CDS 21..446
gagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggacttgcctacagagaatcaagaagaaaacctttctatggagaaaagtcatcattttgaggattccargacacttcatttcagtgg

SEQ ID NO: 805 - DNA, 484 bp, Homo sapiens
  CDS 271..483
agaagagggacatatttcaaactttctggctatcattttgaagaactacaggattcctaaggcagtcagtccaaagaataaatgatctgaaaaggtggatattttatcaaactttaaaaaatagcataaaaggaaaacaaaaggggtgctgctattgtgacaactgaaaaaatatagactctgacaaatgtagactctcctaaaaggataaactataaagatatttttaaatactcatcatatttctttgtatgtatagttttaagtagcatggtactgttaaggtactgttctctgactccagacagagaacgaagaaatcctctacgagccccatgkgttcacagaagtctatcaatcactctgtcagtcttccggatcataattcaagttgccttccccaattttgttggatatatcagatctactccagctccatgggatgatcagtgtgcttttttcctatttttaaagacagcaaagt

SEQ ID NO: 806 - DNA, 510 bp, Homo sapiens
  CDS 59..508
tctgccgggttccgggaaaaggagctcctgctgccactgctcttccggagcctgcagcatggggcccctgccgcgcaccgtggagctcttctatgacgtgctktccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaaca

SEQ ID NO: 807 - DNA, 474 bp, Homo sapiens
  CDS 280..474
aaacctacccacctacactatcaatcaagtgtgaagactaaaaaaagcatttctgacatgaggttttaaatttttacttcttaagcaagcttttttagaaagctacttaaatatgttcttcaccaaaatcaggacataaagagggaggcatgctttctaggaaaaagaactcaacactacaaacatgcaagtcctaggatgattgtcatacaccatgccaaaacaagaaatcaagacagaggctaagagagagaaattctcaatttaaaacaaagaaaaatgtgcttgaaaaggccactaattgatcgaggttgtggagtcaccggagctggcaaatcccccattaaaaatccagtgtatccaaatcatgagcagcatcttgtgaccctagaagaaataaatgataccaccttgaacacaaatataatcatcttgaacttttatataaatttctacagcaattctgttattaaa

SEQ ID NO: 808 - DNA, 491 bp, Homo sapiens
  CDS 225..491
aatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcagccggtcgcctgctgaccctccttcgccacaggctcgtagcggaggcagcagcgaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatgga

SEQ ID NO: 809 - DNA, 376 bp, Homo sapiens
  CDS 131..376
agagaaggcccggaggctctgcgttctgtagtggcgctrcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaaggggaagaagacaagaaaattaatgaagaactggagtctcaatatcagcaaagtatggacagtaaattatcaggaagaatatcggcgacattgtggactt

SEQ ID NO: 810 - DNA, 389 bp, Homo sapiens
  CDS 104..388
ctttcggtccaggcggcggcagggctgagccagcgacgccctccattcactctccgcgcccgttctccggctgtcctcccgttccgctgcccgccctgccaccatgacggaacaggccatctccttcgccaaagacttcttggccggasatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttcccmactcaagccctcaacttcgccttcaagggataaggtaca

SEQ ID NO: 811 - DNA, 520 bp, Homo sapiens
  CDS 252..518
atcccggcgggcaccgtgcgccgcggsagtgaggcgtcgtccgtactggaggctagctcttgtcgcggccgsgcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagtgagtccattcttgcacaccgagaaaatatgcgacagatgataagaagtttttctgaascctttkgaagagacttgcycagtwwycyygaaakgkwaraagggagrgcycataatcgtagaggacataatgatggtgaagattctttgactcatacagatgtcagctctttccagacaatggaccaaatggtgtcaaatatgagaaactatatgcagaaattagaaagaaacttcggtcaactttcagtggatccaaatggacattcattttgttcttcctcagttatgacttattc

SEQ ID NO: 812 - DNA, 258 bp, Homo sapiens
  CDS 92..256
aasggtaataacagacttcatcccggtatggtcttattttcaaataattcaatacatacaaaactaccaatactattttaaaaaaggaacaatgggcctggcacggtggctcacacctgtaatcccaacactttgggaggccgaggagggtggatcasgagatcaggagtttgagacsagcctggccaatatgggggaaatttggaaaaagacacacaaacccagacaccaacatctggaaacctgggagaaagccat

SEQ ID NO: 813 - DNA, 191 bp, Homo sapiens
  CDS 12..191
acacaatcatcatggcrgcggccggggccccggatggcatggaggaacctggcatggacacggaggccgagactgtggctactgaggctcccgcgcggcccgtcaactgcctggaggctgaagccgcggcgggggcdgcggccgakgactccggcgccgcacgargcagcctgcagccggccccggcccag

SEQ ID NO: 814 - DNA, 484 bp, Homo sapiens
  CDS 223..483
tctttgcaatgaatcttgctgctgctcactctttgggtccacgctgcgtttacactgtgtttatgagctgtaacactcaccacaaaggtctgcagcttcactcctgaagccagcaaagaccacgaacccaccaggaagaaggaacaactccagacacgcagccttaagagctgtaacactcactgccaaggtcttcagcttcactcctgagccagccagaccatgaacccaccagaaggaaaaaactcggaacacatcccaacatcagaaggaacaaactctggacatgccgcctttaagaactgtaacaacgcaagggtccgcggctttattcttgaagtcagtaagaccaagaacccaattccggacacgtttggaccgcccacaagggcaagacttcatgaggttctggtgaccaagcatgctcatcgctgtcctgggactgctccaagtgcaattcaaagatgtttgttacaaatgaaga

SEQ ID NO: 815 - DNA, 543 bp, Homo sapiens
  CDS 209..541
attctcaaagctatgacgttcagcaaggtatgtgatggcttttaaggagcacgggaagatcacatcctgctgtattccgggttagtttgagccccataaatagcagcacagccggagctggagccggcgccasggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtg

SEQ ID NO: 816 - DNA, 480 bp, Homo sapiens
  CDS 269..478
scataaaattaatagatgtttttcagaaaatccattattaagagtagaggaatgaggagaaatattcgttctaaagagaatcaaaaccacaatgagagattgtcttacccccgttagaatgacagttaccaaaagacagtaacaaatgctggacgagaatgcagaggcaaaggaacgtttaaacactgttagtgggaatgtagacttgtacaaccgttatggagaagagtatggaggttcctgaacaaactaaaaatagaactaccatatgattcagcagtcccactactgggtatatatccaaaagaaaatccatatatggagacatctgcacctgccatgctcgttccagcactattcacagtacccaagattggaatcaacctgtgtctatcagcaaatgaacataaaatgtggtatacataccccgtggaatactatttggccattaaaaaaacaaaattctgttattctcagcaa

SEQ ID NO: 817 - DNA, 507 bp, Homo sapiens
  CDS 298..507
acttttttcctgcctctgattccgggctgtcatggcgacccccaacaatctgacccccaccaactgcagctggtggcccatctccgcgctggagagcgatgcgccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgacgggtgctgcagtaccgggagctgctggacgcactgcccatggatgcctacacgcatg

SEQ ID NO: 818 - DNA, 526 bp, Homo sapiens
  CDS 263..526
cttattgctggcggcctgaggagcccakttcttattgctggcggcctgaggagcccatcatggcgacgcccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcac

SEQ ID NO: 819 - DNA, 526 bp, Homo sapiens
  CDS 263..526
acccggaagccgcggttcctaccaaccgttcttattgctggcggcctgaggagcccatcatggcgacgcccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcac

SEQ ID NO: 820 - DNA, 332 bp, Homo sapiens
  CDS 89..331
atatccgggttcccgccgcctccaccgccaccgcctcagccgcctcgcacatttagtcttgccgggagtggtgtgattcccgaccaagatggcggccgtggggcgagtcggctccttcggttcttctccgccgggaattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggraagaacgtgctactgctgggtgaagatggagctggaaaaac

SEQ ID NO: 821 - DNA, 409 bp, Homo sapiens
  CDS 36..407
acttagagcgccgaacagctctgggbcaaaggaccatgagagggccggagccgggtccccaaccgacgatggagggagacgtgctggacacactggaggcgctggggtataaaggaccattgttagaagagcaagcccttacaaaggcggcagagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaaggaggactgtttgaaacttctattatttttaagtacagaacttca

SEQ ID NO: 822 - DNA, 376 bp, Homo sapiens
  CDS 212..376
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagascagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagtatttctaaaaaaaaaaaam

SEQ ID NO: 823 - DNA, 536 bp, Homo sapiens
  CDS 376..534
catgtcactgaatgctatttgaaactgtcatttccttgtatattagggggatctgctagactcttatgtcattgtattttggaaatgggtatatgtccttattattggttaataatcatatttatttttaatgaaaattaaattatgaaaataatgcacttaactaggtgagttttaggttgtcgattgatgtgataattcactcttcccgaaaaattggcaaggtaatggtctgaatcggacaatccttttgtttttacattgatgttttctatatttattttgtacctggaaaaatatttttacaatttattttgattttatatgtgtagaaaaatgtactgaacaatgttgacatgcttatttttgtaagagatgggtacttcttgttccccttggatttcggaagcaaagcaatgggaccctacgcttcagagtcttaatggggtggggcagtgtccattgaggtgtcctgtcgggaatgacaagtccagggcagattatgaggcaggcatcctttggagttcttctctcag

SEQ ID NO: 824 - DNA, 351 bp, Homo sapiens
  CDS 78..350
  misc_feature 172..173: n=a, g, c or t
agtcacagccgggagtagcggggtggaacgagattcctgtggccgggccccttcgctgggccccgctttcacccaggatggcgagctcctgccctccaccctcttgccgctgtatggggcgcctcgtccccgcggctccagcctccctcgtcggcagyasactkgscctccnnctcctgcgccctgaggttgacttcgtcgtctttcggggttgccttgcctttcggcctttctggggttcggggattatgacgtttgacctgaaagacagcagggatttcggccgggacccctgggcccgggctcgtccagcactgggctctcacccggatcctcatggctttgccctgg

SEQ ID NO: 825 - DNA, 326 bp, Homo sapiens
  CDS 44..325
atctaggggctgctgggaagatggcggactcggtggctagccgatgaggaggccgcggggggaaccggcccccggggcccgagaccgactggagggagcgacctgcgcagggcccgggggagtcatggtctccatcacccaactccatgcttcgagtcctgctctctgctcagacctcccctgctcggctgtctggcctgctgctgatccctccagtacagccctgctgtttggggcccagcaaatggggggaccggcctgttggaggaggccccagtgcaggtcctgtgcaaggactgcagcggcttctggaacaggcgaagagc

SEQ ID NO: 826 - DNA, 466 bp, Homo sapiens
  CDS 313..465
  misc_feature 430: n=a, g, c or t
agtgacgtcgtgggctgcagcgcaagcacccaacgcagttgcacgccagggcctgtactgaccacctccacgtgccactggggctgtaaggaggaatggcggccgtgggagcctgcttggccggctgaggcagagcaccgtgaaggccaccggacctgcactccgccgcctgcacacatcctcctggcgagctgacagcagcagggcctcactcactcgtgtgcaccgccagcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagckcagtgatnacttgcatgtggagcgctaccgacagttctggacca

SEQ ID NO: 827 - DNA, 420 bp, Homo sapiens
  CDS 218..418
aataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttyccgtttccagcccccaatctcagagcggascgacatagagcagggaaccggcatggccaaagccgcggcgatcggcatcgacctgggcaccacctactcctgcgtgggggtgttccaacacggcaaggtggagatcatcgccaacgaccagggcaaccgcaccasccccagctacgtggccttcacggacaccgagcggctcatcggggatgcggccaagaaccaggtggcgctgaacccgcagaacaccgtgtt

SEQ ID NO: 828 - DNA, 316 bp, Homo sapiens
  CDS 58..315
gtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgca

SEQ ID NO: 829 - DNA, 482 bp, Homo sapiens
  CDS 331..480
aaaaaatcctgcaaaagcactgtgcagcaaccacctgggcctacctccatgtaactgccataggacttcggaaatgaaggggaacatgaagctatgctgacacttgtgctctgaataacagctgatctgacctggtttctctctgtgacctgacattccttctaggctcactctcacacctggatgctttgaaaccaactgtcaaccgccagcaagaacttaagatgtcacaagctgaggaaactgaggatcgggcacattaaagcacttccccactgtcactcagccagttacaggcagagcaagatttgaacaaagtgkgtctaactcatgttctccccagaatgccaacatgcctatttgtgtattgaaagtcaatgtaagaatttctctgactactgcwggcccatcttttatgaggctcccaagagaagtttcatacaatggatcaagaatcagaataaagtcagacttctcaagtg

SEQ ID NO: 830 - DNA, 501 bp, Homo sapiens
  CDS 340..501
cawttcacattccatttggatgcctcttgagtgactccaggcctwctccagctctaaaacattaagatcaggccctacgctacagctggccagtgtgtaattcttctgtttctatgctgttaggtcaaatagatcttcaatagttacttgattgttattacttttttctgaagtgggtgttttatcaatgttttaggatacagtgagtctgcttctcccctttggagttaggaaggttgtaggaatatacactgtagagcatatgggagctttatcccctccttttttccccgctacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtccccagg

SEQ ID NO: 831 - DNA, 227 bp, Homo sapiens
  CDS 75..227
atatagccagccgcggctgcmcttgcgcttcccgagctggcggggtccgtggtgcgggatcgagattgcgggctatggcgccgaagtttttcgtcagtactgggatatccccgatggcaccgattgccaccgcaaagcctacagcaccaccagtattgccagcgtcgcysctaggaccgccgctgcctacagagtcacactcaatcctccgggcaccttccttgaag

SEQ ID NO: 832 - DNA, 494 bp, Homo sapiens
  CDS 265..492
aattgtctgagtggggtggctagagccaggagtcctctatggtgatctggtctctttggggagaacagaaaggatctgggtcttgggggtacactgtccagggatgctctgctctgggccaggcatggggtggaaagtgggaggctcctatggaccctcttgggcctggggatggagcctctggggcagggatgctggggtcttccttggtactcatgtcaggagccctcctgacctctctgctctcccacccccaccccaaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaasagggagatggtggcgctgcggctggagcacca

SEQ ID NO: 833 - DNA, 497 bp, Homo sapiens
  CDS 304..495
agatgcgaggsggcggtcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcagcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcagtcgatcgaggagtgcaagcaggtgattctggagctgcccgagcagtcggagaagcagaaggatgccgtggtgcgactcatccacctccggctgaagctccaggagctgaagga

SEQ ID NO: 834 - DNA, 650 bp, Homo sapiens
  CDS 489..650
  misc_feature 426: n=a, g, c or t
cactccttctaccaacaccccgccccctgcaggctctctccgagagaccaagtccttttgctctccatccccggaagacccggctgaaaatccggaaaaagaatcgggaaacgccaggaggcatattgcgcttgcacacggaggggccggaagtcgaggcgggagtgactctgcttccgtttctggttttgctctagtgtttgggtttcttcgcggctgctcaagatgaaccgactcttcgggaaagcgaaacccaaggctccgcgcccadhctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgangttttaaagcaaaagaggatgtatgagcagcagcggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggattttacaagaccagctagaggatatgatggaagatgc

SEQ ID NO: 835 - DNA, 259 bp, Homo sapiens
  CDS 21..257
acaacttagagtcaagagggatggcctctcgaaacagtgggggtgacctggaggatcttagcattccaggcacaatcctagcctcgcctgggagaactgccactcagatgagggtcttgggcctggtgctccaggakgagggaakagggtgsccctggagagacgtggsgctcccattttacatcctccagatagctctggggcsacgctcctgtgctccaactccattgagtcctgcatgcagctcggtgttccscgg

SEQ ID NO: 836 - DNA, 486 bp, Homo sapiens
  CDS 195..485
ggacatgttgacgtcgtccgagagtcttaaaatcctgctgtggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttg

SEQ ID NO: 837 - DNA, 301 bp, Homo sapiens
  CDS 149..301
cttttcaacttttggctttttggataataccatgaatatgcatgtgtcttagttcatatttgttgctctaaaggaacacctgaggctgggtaatttataaagaaaagagatttatttggctcgtggttctgcagagtgtacaagaacaatggtgccagcatttgcttctagtgaggacctcagattgcttctccttatggtggaaagcaaacgggatcagatgagtgacagttcatttagattctttgtattcttcttcgtctatatttgtcagtttgctgtacatgtactccaagctgca

SEQ ID NO: 838 - DNA, 225 bp, Homo sapiens
  CDS 2..223
  misc_feature 128,171: n=a, g, c or t
aatgtgtggctcacagttctggaagacggaggtccgaggtcgawkgcccagcagcttcggtgtctggtgcggaaccgccttccagctgatgcaggagactgaggcacaaagaggaggtgcctcactanggccggcttgggtttatagtgtgccctcggaaagctctggaanaattgagtctacgtttcggctcaagctgcagccagaagcagccatgggaaccca

SEQ ID NO: 839 - DNA, 537 bp, Homo sapiens
  CDS 164..535
  misc_feature 21: n=a, g, c or t
gggtaaatgttcgcggaassncaaagacgacacggccttgtgggatggcggagtttaaggagaagcctgaggccccgactgagcagctggatgtcgcgtgcggccaggaaaacttgccggtgggcgcgtggcccccgggggcgcgccggcgcccttccagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactga

SEQ ID NO: 840 - DNA, 510 bp, Homo sapiens
  CDS 54..509
aattgcaactgtgatccacccttctgaagtaagtgattctgtgaggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgcc

SEQ ID NO: 841 - DNA, 344 bp, Homo sapiens
  CDS 61..342
actgcacacggcgagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgagcagagr

SEQ ID NO: 842 - DNA, 513 bp, Homo sapiens
  CDS 105..512
gaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggc

SEQ ID NO: 843 - DNA, 536 bp, Homo sapiens
  CDS 80..535
atcacatgaccacttcccggaagcgcasagacccgctcaacttcatcctgggttgaggcggaggagaacttccagaattatggcgaagtccgggctgaggcaggacccgcagagcacagctgcagccactgtgctaaagcgggcagtagaactagattcggaktcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaraatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggag

SEQ ID NO: 844 - DNA, 526 bp, Homo sapiens
  CDS 286..525
atcacatgaccacttcccggaagcgcasagacccgctcaacttcatcctgggttgaggcggaggagaacttccagaattatggcgaagtccgggctgaggcaggacccgcagagcacagctgcagccactgtgctaaagcgggcagtagaactagattcgggattcgcgggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagawvgrgaatatcacaagcaaattaaaatagaagagaatgsaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaa

SEQ ID NO: 845 - DNA, 459 bp, Homo sapiens
  CDS 52..459
gacgaggaggaggaggagggaagtgagatggcggaaaggaaaactgcttaaatgatttttaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaa

SEQ ID NO: 846 - DNA, 503 bp, Homo sapiens
  CDS 315..503
tcttttcttttaaccttgcctatcatgtttcgagtcagaatttaaatactgtgcagtttaagctacaatacgcttggcctataacttggttccaggcatttatatttatgtcacttttgtctacttattatactaacaaggtggaaaaagcaatcccagtctctccaaaagacaagatgtgaaatggagaagtatctgacacctcagcttcctccagttcctataattccagagcataaaaagtatagacgagacagtgcctcagtcgtagacagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgctgcccctcctccggccccgacccaggccctccctgagttcaccagtatattcagctcacaccagacgc

SEQ ID NO: 847 - DNA, 471 bp, Homo sapiens
  CDS 35..469
gttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattctatccaatggccactcgccgcagacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatscatcgagacccagagtaaagccatgacaatgctcaccat

SEQ ID NO: 848 - DNA, 484 bp, Homo sapiens
  CDS 41..484
ttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggt

SEQ ID NO: 849 - DNA, 518 bp, Homo sapiens
  CDS 258..518
agtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaattt

SEQ ID NO: 850 - DNA, 475 bp, Homo sapiens
  CDS 275..475
agaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgagkacccattctcacctctgagggactcctgtcctaggactaaggtggagcctgggccatggtacagctggctcctgcggcascatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttcgacagattcaggagccaagggtggcagtcacagagatgttcacacaaaggaa

SEQ ID NO: 851 - DNA, 492 bp, Homo sapiens
  CDS 116..490
aagcggttgtgcttgctgaggctgcacttgctgacactgcagctgcgacgcggctaagaggcgcagagsraggagtcgggatttggtcgcgagcggcgacgagcatttgtgcagaatgtcatcagatgakgagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaagggagccttctcacccagtcatggattttttcagttcacatctttt

SEQ ID NO: 852 - DNA, 474 bp, Homo sapiens
  CDS 324..473
aaggttctcccacccacggtgtacctgagggtaaccaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaag

SEQ ID NO: 853 - DNA, 546 bp, Homo sapiens
  CDS 244..546
acagcgagtaagtcacagaggggatttgaagccaggctcagagcccaggatttgaccagtgtctctgtgcccactcaagggaggaagagtatcctgagtaagagggaagctgcatgtggatcacggggaagttgctctgccctcacatcagctcctcatgtgtacagctccagatgggtgggtgttgtcggagaatttgctcataggaagctacagttccttctccacagtctccccttctagatgctgatctttccagatgacaggcttcctaaaaaccaaccactgactgaaccgtgtgaatggcacgtcatcaccacagtcccctctgagcacatcgggcagggtcgctgctgtggggccttatatccaggttcccagtgccggaagctttcctgtgctgggggacctataaagccccagtctctcagtattgcctcaaatgctgctcatggaagatccaaatccggtttatttactctgaggacactgaggccggcatggatgctcaccacaactcggctacagcagccaagtggaggggct

SEQ ID NO: 854 - DNA, 499 bp, Homo sapiens
  CDS 126..497
attactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcawkrttccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgttgggaatggtagaaaacaaactcccaggaccgccctgtt

SEQ ID NO: 855 - DNA, 484 bp, Homo sapiens
  CDS 175..483
ctccctccaggcctaaatgaataaaggcatgacactgagattgaaggctagttctacttcagaaccacagagacatgagcaccagcaagtttgaggttggataaggatcttcagaactcctcagcttcagatggtcaagcactgcttcctcccttcttcaacggcatctctagcatgtatacttcccttaaatccaccttcgtggcttttgctgatggaagaggcacaacagagtccatgccttcacctcctctggccaactctaatcatgaatctcctgtgaatcagctgggaaacatgcagaatatgagattggggccctcattcatactaactggaattttccttggcaatggtagaacagaagcttctccattctttacagatgaatttgctttaagtaagatcttcccagagtacaaaagaaatttattcggaaaatttcaaactaatatcctttgcaaggtgagctacacctctgaga

SEQ ID NO: 856 - DNA, 473 bp, Homo sapiens
  CDS 139..471
ctttctggttggctgaaggggccctgatgtcacaattctagggtttctccactccgaatgatcgtgtctctagccaaaaatatttattgacctggttggtctcttggcttcctctctttgtccaacgtagaagagacaatggaacccctctaccaggctgggtccattctcatgacggtgaataccctacaggggaaaaaaatgatagagagtggcctccagtctggagacttttccctgtcccagtcatggccctcctgcctcccaccacccgctgacttggagatcctgcagcagaaggtggccggggtgcaacgggaactggaggactttaagaaagargcattgaagtccattcattaccttgaagacgccttctgcgagatgaatggagccctggtgcaacaggaggagcaggcggctcgcgtgaggcagcggctaagggaggaggaggaccgtggcatcgtgcgcaa

SEQ ID NO: 857 - DNA, 502 bp, Homo sapiens
  CDS 261..500
agaaatcctagggagcatatagtccgtggctaaaacatgtcccagctccttggatggaatggcagtaaaggttctgtggctctttactgacctaactccttggattttcctcattcagtcccactgcaagcgtgtgggaggacttaaaaaaatgctattcacatgtgaaggaatctaaatacgatgattatatgaagcgatctctaagtcattttattttataattctttcagacaaaaatctacgtaccatcagaaactatgtctctgcagatggtaacagtcagtaataacatagccttaattcagccakgcttctcactgatgaattttgatggacaagttttcttctttggacaaaaaggctggcccaaaagatcctgccccactggagttttccatctggatgtaaagcataaccatgtcaaactgaagcctacaattttctctaaggattctgctacctccctcctcttcgctacccagccacttgcacattcaaa

SEQ ID NO: 858 - DNA, 514 bp, Homo sapiens
  CDS 176..514
  misc_feature 479: n=a, g, c or t
aaaaaccctgagcggtctctgaggacctggtgagcaggctggagtacaatggcacgatctcagctcactgcaacctctgccttctgggctcaagcgattctcctgcttcagccttctgagtagctgtggactacagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttgggtttgtctgctgccctccatgggcctgaagaatggnaactgatggttcaggattcagcagagattcctggg

SEQ ID NO: 859 - DNA, 481 bp, Homo sapiens
  CDS 228..479
aaggaagtgcttttgaatgaggtactgagggccaaggtgttggaagttcctaattctttcctcggttaactgtgaactctgcgtattgggaaggcctggcctcagtcatcaggccaggagaggtactggacgccgcgcacgcactcgtctgccagcgaggcccaaaggggaagcctagcggastcagtgtggcagctgctggcctctgggcgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaat

SEQ ID NO: 860 - DNA, 508 bp, Homo sapiens
  CDS 273..506
attttcattggctatcagcttcaaggaagttccattatttctggtaccatcagagaaagacgccattaccagcagttccaggacacctaaccaaaggctggtgtcaagactgtgctaatgacctccaggtcctaagtctcttgttgcctggtgacaaagtttcacagttgaggaggagaagctgggactagcaggtttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcaccttgacttgagcaagatgggaattaccaccttccccaagtgtattctgcgccttagtgacatggacgagctggaccttagccggaatcttatcaggaagatccctgactccatctccaagttccagaacctccggttgcatga

SEQ ID NO: 861 - DNA, 535 bp, Homo sapiens
  CDS 348..533
gagcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccagggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgct

SEQ ID NO: 862 - DNA, 504 bp, Homo sapiens
  CDS 31..504
agcgcccgcgssggcgtccccggcccaaccatggcgtcctccgcggccggctgcgtggtgatcgttggcagtggagtcattgggcgaastggggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaa

SEQ ID NO: 863 - DNA, 403 bp, Homo sapiens
  CDS 17..403
  misc_feature 137: n=a, g, c or t
cttctgggaagggagaatggcggcgcccgggctgcggctgggagcgggaagactctttgaaatgcctgcggtgctararcgrckgrgccgctataatagcacgtcccaagcttttgctgaggtgctgcggctgccgndgcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtg

SEQ ID NO: 864 - DNA, 483 bp, Homo sapiens
  CDS 171..482
aggtgggaggaaaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggacgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtg

SEQ ID NO: 865 - DNA, 557 bp, Homo sapiens
  CDS 156..557
atagtgagcggcagacagaggggtggccagtttgttgttttacctaaaaggtgttttccacatggagtgggactgagaggcacaggtggctgaggggacccgcctgggacgtgaggcgcaggtgtgctcggccccttcatctgtcagctgcagcaatggaatacgtgctggaagtgaagaactctccgcggcacctcctgaagcaattcacagtgtgtgacgttcctctgtatgacatttgtgactacaacgtctccagggaccgatgccaggagctcgggtgctgsyttttavgaaaggsgtttgsytamargaaagcggttcccatttacatccacgtgttctctgccttgattgtgatcaaagctggggccttcgtcatcaccatcatctacagagtcattcaggagagcaggaaagaaaaggcaatccctgtggatgtcgcgctgccacagaagtccagcgaaaaggcggagttggcctcatccagcagcaagttagggctgaagctgcgagtcctgggcctcaaagtgctgggcctcgatgagagtgacgag

SEQ ID NO: 866 - DNA, 537 bp, Homo sapiens
  CDS 388..537
aatagtgagcggcagacagaggggtggccagtttgttgttttacctaaaaggtgttttccacatggagtgggactgagaggcacaggtggctgaggggacccgcctgggacgtgaggcgcaggtgtgctcggccccttcatctgtcagctgcagcaatggaatacgtgctggaagtgaagaactctccgcggcacctcctgaagcaattcacaggagtgacttttttaattaaggaaaaatatttatcagcaatgaagaagttccaccttccctttccccacccgggcaactgacccggagcagacactcaccactgggactggaaggaaccaccggtgtgggatgtggcttctcccacaggtgccgttaatgtgcatagatgggggatgacagtgactgatggtcaggaaaaggaagattctggaagtttgcacctcccccgggagcaggagatgccaccttccatggctcaggtttacctgctacttgaatgtttttttctcaatggaaaaaaaaaaamcaaaaaaaaaaaaaaw

SEQ ID NO: 867 - DNA, 496 bp, Homo sapiens
  CDS 288..494
attttttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaagggcagcatta

SEQ ID NO: 868 - DNA, 491 bp, Homo sapiens
  CDS 288..491
attttttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagca

SEQ ID NO: 869 - DNA, 353 bp, Homo sapiens
  CDS 85..351
ataacgattttggaatcctatgtgaagcattttgctatcagtgcagccttttcagccaatgagaggcctcgtcaccatcacgctatgccacatgccagcatgaacgtgccttatatcccagcagaaaagaatattgacctttgtaaggagatggtggatggattaagaataacctttgattacactctcccgttggttttactctatccctatgaacaagctcagtataaaaaggtgactgcatctaaggtttttcttgcaattaaggaaagtgccacaaatactaataggagccatgagaakctctctcccagcttacgtttgttgaatccatccatgccgcaktctacaga

SEQ ID NO: 870 - DNA, 516 bp, Homo sapiens
  CDS 279..515
ggggcagggacctcgccggcgcagttgtcgggctgggactgcgcgggtgctgcggtccccattcctaattcaaaggctgctgtctaactcccagtgagaaatgaggaaaaacaaattgcaaaagatgattagagactatactttatagagaactctgcatatttaccaggttttgcaaaaaaaaatttggtaaggtacaatatataaaatagtgagacttgacgtgccttttaagagaagaaagatgcgtgaagactgtcctgcacttggtsattcatatggtttttctccagcagaaactttcttgtgcaggcaggcctcggttgtccaaacgatgcacatttcataggactttcggaaaagccttccaccagctactgcagaaaatggattctgtgactgtaaaaaccaatggccgggcgcagtggctcacgcctgtcatcccagcactttgggaggctgaggagggcggatcacgaggtcaggaggtcgagatcatcctagctatctctacta

SEQ ID NO: 871 - DNA, 467 bp, Homo sapiens
  CDS 305..466
aggcccagagccgtcggggaggggtgctgctaccaggtcctgggcagacagggctccttgtgcagtgcagcattctagctgttgggatagaggctcactgtggggaagacagagccacctgggcctgcagatgctggaaagtctgttcacagggaccttcagctccagaacaggacttctcataccgaggtaagcaaggcagctcgccaggagaagcggtttcaggactataatgagaggtgcactttccatcaccaggcgcgggagtttgctgtgaacttgcgaaaccgggtgtctgccatccatgaagtgcccccgcccggatccttcaccttcctcaatgatgcctgccagggactggagcaggctcggaagcttctacagccaggacgcagagtacatggatgtggtggagcagcagacagagaacctggagctgcacaccaatgccctgcagatcctcctgg

SEQ ID NO: 872 - DNA, 348 bp, Homo sapiens
  CDS 154..348
aaggctgagactccagtgacccggcggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtg

SEQ ID NO: 873 - DNA, 542 bp, Homo sapiens
  CDS 387..542
atgctgggaaggcgtccgcgcggcgccattttgtcttgtcggctcctgtgtgtaggagggatttcggcctgagagcgggccgaggagattggcgacggtgtcscgtgttttcgttggcgggtgcctgggctggtgggaacagccgcccgaagaagcaccatgatttcggccgcgcagttgttggatgagttaatgggccgggaccgaaacctagccccggacgagaagcgcasaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggccaacaggcaaaaaaaaaaaaaaaa

SEQ ID NO: 874 - DNA, 490 bp, Homo sapiens
  CDS 133..489
attttgtcttgtcggctcctgtgtgtaggagggatttcggcctgagagcgggccgaggagattggcgacggtgtcscgtrttttcgttggcgggtgcctgggctggtgggaacagccgcccgaagaagcaccatgatttcggccgcgcagttgttggatgagttaatgggccgggaccgaaacctagccccggacgagaagcgcasaacgtgcggtgggaccacgagagcgtttgtaaatattatctctgtggtttttgtcctgcggaattgttcacaaatacacgttctgatcttggtccgtgtgaaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctgggggccgct

SEQ ID NO: 875 - DNA, 369 bp, Homo sapiens
  CDS 211..369
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagasagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagtatttctaaaaaaa

SEQ ID NO: 876 - DNA, 550 bp, Homo sapiens
  CDS 314..550
actcagcgcgcgagtctctgaaaggcctaacgtccattttcaatcctgcgggtcttgcgaaggaaaacctgaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaccctccagcaagtttaaaaataattaggtccaactcagaggaagtggagtttctcctgttgcacaaaaatgatgtctaacagctccagtgaaatcgatgtghhrccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaa

SEQ ID NO: 877 - DNA, 246 bp, Homo sapiens
  CDS 56..244
agcaacctgctctggttcccttccacgctgtggaagctttgttcttttggtcttcatgataaatcttgctgctgctcamtcgkttgggtccgtgccacctttaagagctgtaacactcaccgcgaaggtctgcaacttcactcctggggccagcaagaccacgaatgcaccgagaggaatgaacaactctggacacaccatctttaagahrcgtaatactcaccgcaaggtctgcaacttcattct

SEQ ID NO: 878 - DNA, 473 bp, Homo sapiens
  CDS 312..473
tacaagttgctctagttcatttattttatagaattattgtataaagatttcacagtatattcattctccttatttgcaaatacaagttgcttacagtttttcactattacagaattactacaataaatattcttgaacatgttgcattatggaaatgtttcaatggtggggtgacagggtagtgaattttgctccctaagcaaatgtccagatacatttttggttgtcacaatttggggaggaaggtgttaatgttaatgacatccattggatagagcccagggatgctgctgaacagcctgtaagcctgtatgcacagaatggcttctcacgtttccccagcaaagtycataatgacagtagtgctgaasgtgagaaacctgactttggagaaaaatagctggctaataaattatgcccaccatcaaactttaaccaaattactctccgaagtgttagacattttggctctt

SEQ ID NO: 879 - DNA, 486 bp, Homo sapiens
  CDS 234..485
aaaaaattttttttttctttcaagtggagtggagactctttagcttgcggttgctctcagaaaccacatctctactcgtgaaccaggagtttggggatggcaaggagaaggccagtgttgattctgasagcaatcttctggctctcattcgagatgtcttacttccccagtatgagcasattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaa

SEQ ID NO: 880 - DNA, 464 bp, Homo sapiens
  CDS 83..463
acctgggataacggcggcgagcggacggctgcatttacggggtctcccggaggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaata

SEQ ID NO: 881 - DNA, 711 bp, Homo sapiens
  CDS 394..711
gcttttttccaaacatccgggcttctcctttttgtgttccggccgatcccacctctcctcgaccctggacgtctaccttccggagcccacatcttgcccactccgcgcgcggggctagcgcgggtttcagcgacgggagccctcaagggacatggcaactacagcggcgccggcgggcggcgccggaaatggagctggcccggaatggggagggttcgaagaaaacatccagggcggaggctcagctgtgattgacatggagaacatggatgatacctcaggctctagcttcgaggatatgggtgagctgcatagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaasaggkctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacaaaa

SEQ ID NO: 882 - DNA, 489 bp, Homo sapiens
  CDS 220..489
atttttaggatcaaggctttaaggaatctttattgagcatttttccctctcggagctgagacaaatggctgatgagtgaaatcttgagaatgttcacagcttttctctttcattctgttgcagcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaacaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgawaaatcaagatgacagcagccttctg

SEQ ID NO: 883 - DNA, 542 bp, Homo sapiens
  CDS 90..542
gatgtggagtagggccgagcgcggaacgarrggggctgctggggtgtttgtckcagcgggttttcctcggcggtttgcggastgctaggatggagcaggttgcggagggagcaagggtgaccgcagtccctgtgtcagctgccgacagcactgargagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcactggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaag

SEQ ID NO: 884 - DNA, 348 bp, Homo sapiens
  CDS 170..346
  misc_feature 261..263: n=a, g, c or t
caaacagaattaccagatamgccaaaaatactgcttctaggtatacgccctaaagaactaaaaacaggtgttcaaataaaaactcgtatacaaatgtttatagcawcattatttataatagctaaaaagtgggaaaaaaacaattgaccatcaatggatagatggataaatgatattattcaatcataaaaaagaattaagtggccgggcacagtggctcatgcctgtaatcccagctacgtgggaggctgakgchgagknnnacttgaacctgggaggtggaggttgcagtgaactgagattgcgccactccactccagcctgggcaacagagactcggtgtcaaar

SEQ ID NO: 885 - DNA, 484 bp, Homo sapiens
  CDS 232..483
aatattctagaggccgcggggacgcctggtgggtagggctgcagctccggagcctacgggagtgtgaccctctcgcctcctggcgggaagctcttgaggagatattttcttttctaaacactaagaaatttgaggatggtggggcaaaacgactaactcccactttcctgtgactctgtagccggaaaaactgtcaaaatctgtggataaatttgtgagacaagaagaagaatggcatccagaataaatacaaatttcactttgattcccaaccagaaacttagacgtagtaatcgtcaaaccagctgttattccaagacccttggctcaggctttcaacccatatcaacatttggaaattttaaagccttaccattggaaatattccagataattttaaaatatttgtcagtgaaggatatcagcatgctaagcatggtgtccaaaacagtcagccaacacattattaattatatctcaacct

SEQ ID NO: 886 - DNA, 499 bp, Homo sapiens
  CDS 261..497
acctaaaggtatgagaagctgggtcatgtagtctagctttttgcctgggaagaagaggaaaatatatttagacgaacaaccagaaatctatttctattctctggaagagcttgtataaggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcakaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacatt

SEQ ID NO: 887 - DNA, 455 bp, Homo sapiens
  CDS 231..455
cctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaccaacagtgggagaagttactctcaatcaccttcctgccc

SEQ ID NO: 888 - DNA, 452 bp, Homo sapiens
  CDS 117..452
agttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagkgtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtc

SEQ ID NO: 889 - DNA, 489 bp, Homo sapiens
  CDS 158..487
  misc_feature 32,43: n=a, g, c or t
agttggggagcgcagatccgaagcagcgctgngagcgtaagtncgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaagg

SEQ ID NO: 890 - DNA, 525 bp, Homo sapiens
  CDS 163..525
agtggtagcgcggggactggctgggaagcggtcggtcgagtgtggcctgtgtggactcgcatcttgcccgaagccgggcggaggagagctcaagctaagggtgatcggcccatgacctaaacctccagacaaaataaaacggaaaatttgctagaatcaagaatgatggatccatgttcagttggagtccagcttcgtactacaaatgagtgccataaaacctactatactcgtcacacaggttttaagactttgcaagaattgtcatcaaataatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctdwswvctaaatttggaagacagcttgtacctggttggaagctttgtccaaaatgcacacag

SEQ ID NO: 891 - DNA, 408 bp, Homo sapiens
  CDS 88..408
agtacttccgttctccagcgctgggcaccgcggccggagctgtgggctggcagcatgggtgccaggcagtgctgagagcagtggggcatggctgcagccctgcaggtcctgccccgcttggcccgagcccccttgcatccactcctctggcggggctcagtggcccgtctggccagcagcatggccttggcagagcaggccaggcagctgtttgagagtgctgtaggtgcagtgctgccgggccccatgctgcaccgggcactatccttggaccctggtggcagacagctgaaggtgcgggaccggaactttcagctgaggcaaaacctctacctggtgggctttggcaaggctgtgctgggtatggcagctgcagctgaggaactactgggccagcatcttgtgcar

SEQ ID NO: 892 - DNA, 517 bp, Homo sapiens
  CDS 304..516
attggttagaactcagtcatatggcttcacctaaaggtttttttaattacttgacctattttcttgctgctggtgctgtcactttgggaattggtttctttgctttggcatcagctttgtggttcctgatttgcaaacgaaggccgggtgccgtggctcacacctataatcccagcactttgggaggccaaagcggacggatcacctggggtcaggagtttgagactagcctggccaaaatgagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcgcagtgttacatt

SEQ ID NO: 893 - DNA, 479 bp, Homo sapiens
  CDS 125..478
  misc_feature 277,335: n=a, g, c or t
taagagaacttcttacgctgtagctgaatgagagaaatattccattccaaacctctgatggaaactggccaagtcagcgtgtgagaggaagaaggaagtgctggctcctcattttccttccaccatgattggaagcttcctgaggcctcaccagaagcagatgctgccatgcttcctgtacagcctgcagaaccaaaaagtttgcctacccttgcaccggaagcaggagggaaagagatggkcttgttggaaaccaggaaaggagaaattgacaganctgcagggagcaaaccctttscaccttcacccaggactgasatcatgtcatacaaaanccctgtgttgttcagaggaccagaggggctggagtggagtgaagtggtgtgatctcggcttactgcaacctctgcctcccaggttcaagcgattctmctgcctcagcctcctgagtagctgggatcacagacgcctgccatcat

SEQ ID NO: 894 - DNA, 548 bp, Homo sapiens
  CDS 140..547
atttttttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatc

SEQ ID NO: 895 - DNA, 499 bp, Homo sapiens
  CDS 224..499
agatgatttgagtaaactccatctcccatgtggtgttgcaggcctcgtatctactaaactctccttattacaagtcaggaagaaccccttaggcagttactttactatactgaaatataggaagaaaatcaatcattttcagagctgaacaaactaaatgtttaccataacagatcctcaatttagggaatatctaaaataaatatacctcagaagagagactatggtcccagctggaaaatttaaaatgcaagaagaaatgctggagtgcagtagtgcagtcacagctgagtgcagcctccacctcccagggctcaagcaatcctgccacctcagtctaccaagtagctggaactacagacctgaaccaccacacccagctaattttttattttttgtaaagatggggtctcactgtgttgccctggctgacctcaaactcctgaacccaagcaatcctttcamcamcttggcctcccaaagtgttaggattagagga

SEQ ID NO: 896 - DNA, 323 bp, Homo sapiens
  CDS 24..323
acttggtctcctgctttcgcgacatggccttcaattttggggctccctcgggcacctccggtaccgctgcagccaccgsggyycccgsgtgvgtttggaggatttgggacaacatctacaactgcaggttctgcgttcacttttctgccccaactaacacaggcactactggactctttggtggtactcagaacaaaggttttggatttggtactggttttggcacaacaacgggaactagtactggtttaggtactggtttgggaactggactgggatttggaggatttaatacacaacagcagcagcagcaaactacatta

SEQ ID NO: 897 - DNA, 467 bp, Homo sapiens
  CDS 165..467
  misc_feature 459: n=a, g, c or t
agtctcccacactcctcscaaggacaggtcctctctggaaccttcacaaacctgatttctggtcctccccaaccagctccctgtccctgcttctgggckctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagyaacaaaacatcagcaggatgcggaaggtcccgatagtaaaccatctccmtcacatccatgtagccatcygtccatcaacctgtatctcaggaacaaatgtasgtasattcattttaagcatgcatggtacatttacaaaaattaacctgacttattttgttccagcaaatctcaatatatttgagagcaatcaaatcacacagcatgttnctgatcat

SEQ ID NO: 898 - DNA, 453 bp, Homo sapiens
  CDS 208..453
actaccgccgatggtgggcgagaccaagtgcgaggggaggacaggcgaasgcgcgcctggggccgcgctctccacacttagccggcgctgcctcacgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggcccmacaaattctagcagtgccaagaagaaggataaaagagttcaaggtggaagagtgattgagtcccggtatctgcagtatgaaaagaagacaacccaaaagcagatagcagtggggtcagaaagggtgacctgcagtccacgttgctggaagggcatggcacagctccacctgacctggatctctctgctattaatgaca

SEQ ID NO: 899 - DNA, 497 bp, Homo sapiens
  CDS 116..496
  misc_feature 47,490: n=a, g, c or t
accggcatcggctgacactgctgcctccagctagttatttcgtcctnttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaackaacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaacccagaagcagctgctctccgggagcttgaagaagaaactggctacaaaggggacattgcccganatgttct

SEQ ID NO: 900 - DNA, 422 bp, Homo sapiens
  CDS 69..422
garsttgcmagtwrcsgggcggcagagctggagtgaagggagctagtgtttaggtagcagtcaccattatgctcaaagcggtgatcctggttggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcatgctgatgtctgcy

SEQ ID NO: 901 - DNA, 359 bp, Homo sapiens
  CDS 69..359
aggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctamcgacctgatgagcccctcacccagttcctagaagccgcccagcaggagtttaaccttccagtcaggtacctgcaggaatttgcccccctaggcacagggggtggtctttaccat

SEQ ID NO: 902 - DNA, 498 bp, Homo sapiens
  CDS 68..496
atttcaacttccgtgattaacatcccgactgatcatcactagcatcacaccgacaacattaactaacatggcggctaagaaccctgattccctcgtcggcgaagggccttttcatgcccgcatcaacacagcccagcctgcagcaaacaattggcataagccaggcaacgagcagggcaacgatgccgtaccagagtatcacgccgagactttccctccgggaactgcaccagcagagaatacattccaccccaatcccgacagcaactacacaactgaagccctaaacatgcctgccctagacatgccagggtcgacttcaaaggatgtccacaactctattgataacttgcacggcaaaccattgatcggccaagagaaccgtgagatcagaggtgttcatcctggaaagagaaagaaggagcgcagtgtcctggagggcgtcggtgcaagcacgacttactccgtgtttgataaggtgagggatacggttgctga

SEQ ID NO: 903 - DNA, 363 bp, Homo sapiens
  CDS 31..363
atattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggsaacacacccagctgtttagacaaagcttaaatgaccatgaagaaaattgtttggagata

SEQ ID NO: 904 - DNA, 539 bp, Homo sapiens
  CDS 42..539
atgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgtgatgaatactttgctggtggcttacactcatcttttgatgatctttgtggaaactcaggatgtggaaatcaggaaaggaagttggaaggatccattaatgacattaaaagtgatgtgtgtatttcttcacttgtattgaagcaatatattcattcatmacat

SEQ ID NO: 905 - DNA, 369 bp, Homo sapiens
  CDS 213..368
attgtccactaaggtctggcaggtctgatttgctcttttycaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagtatttctaaaaa

SEQ ID NO: 906 - DNA, 485 bp, Homo sapiens
  CDS 24..485
aacgaaccgggaatttcagggacatgggggacagagaggaatgtctctctaccccccaaccccccatgtctgtggtgaagtcgatcgaattagtgctgcccgaggatagaatctacctggctggctccagcataaaagggcaggtgatcttaaccctgaacagcaccctggtggaccccatagtgaaggtggagctcgtgggaaggggttacgtcgaatggagtgaagaagccggggcatcctgtgattatagcagaaatgttatttgcaacaacaaggcagactacgtgcataagacaaagacattcccagtggaggataattggttaagtgcaggcagccacacctttgacttccatttcaacttacctcccaggcttccttctaccttcaccagcaaatttggccatgtcttctatttcgtacaagcttcctgcatggacggaacacattttagccaagaagaggatgtacttattggttca

SEQ ID NO: 907 - DNA, 464 bp, Homo sapiens
  CDS 271..462
agctgctgggaggaaaacggcttgctaatctccacgcccagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcgtgccaaaaggaaacccagttggttgataagatagtgcaggacctggatgccaa

SEQ ID NO: 908 - DNA, 469 bp, Homo sapiens
  CDS 242..469
gccctttacagacatgctataaggcccccagcccagtcactccgcagtgcctctctcttcctccccatggactatacacaggccctgcttgtcctggaggaaagtttggacgtcattatatagatcaggagactgaagtactgaaaggttaaatgacttgccaaagaatgagatctttttttctaacattttacataatatcctcagagaagatcacgccctggtgactagagctgtggccatgaaggtggaaaatttcaaaacaagtgaaatacaggaactctttgacatatttacttacagcaaggaagcgtctatggcccggatgctttcttgtttcttgaatgagcatttatttgtcagtgcactcaagtcatatttgaagacattttcctactcaagcgctgagcaagatgatctatggaggcattttcaaatggccatagatgaccagagtacagttattttg

SEQ ID NO: 909 - DNA, 707 bp, Homo sapiens
  CDS 147..707
cttttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgcgacgagtcgggcagatctt

SEQ ID NO: 910 - DNA, 604 bp, Homo sapiens
  CDS 147..602
cttttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggcttctctgttccgcttccttctcttaaatcgcatgtgctggctgggcatggtggctcacgcctgtaatcccagcactttgggaggccgaggtggatggatcgc

SEQ ID NO: 911 - DNA, 452 bp, Homo sapiens
  CDS 270..452
ttttttctgttgccgggcgcaatggcggatacgctggagtcctcgctggaggacccactgcggastttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcacsggggccgtggggctcatggctgctaccctcggggctgatgttgtagtcaccgatcttgaggaattgcaagacttgctgaagatgaatattaatatgaacaagcatcttgtcactggttctgttcaagccaaggtactgaaatggggggaagaaatagaaggctttccttctccacccgacttcatactgatggccgac

SEQ ID NO: 912 - DNA, 173 bp, Homo sapiens
  CDS 7..171
acaaacatgaacctcatcaggactchggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgar

SEQ ID NO: 913 - DNA, 413 bp, Homo sapiens
  CDS 157..411
ctttcggagggtggtgagctagtaagtgtggttttagctgtagtagccagattgggcggccgggagtggtgggggtgccgggtggaaggctctgggcggggtctcaggaccctccttttcttggcggggatcgggcttgtggtgccgctccccgtaatgtacggaggaagagggaaagggctctggccccctcggcgtcatgtcttcggtgctggcggcttcccatccgctggttctatcctcaaacgccgggacaccgggaatctcggagaaggacaaccgagatccagctggctcctccatcggggtgctcacactttctcatttgatttcaggtctgcggacgctgtataccctcctccacttcccgctgcagccaataaaggccgttcctaccawaaaaaaaaaaaaaa

SEQ ID NO: 914 - DNA, 402 bp, Homo sapiens
  CDS 77..400
gagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaaaagtgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccawttt

SEQ ID NO: 915 - DNA, 245 bp, Homo sapiens
  CDS 55..243
agtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaacaargtacttcaagaagcacgagaagcggatgtcgaaggacgaggagcgtgcggtcaaggacgagctgctggcgagaa

SEQ ID NO: 916 - DNA, 492 bp, Homo sapiens
  CDS 285..491
ttcatttttctagcctactccagtagggtcagttcacgtagattctggtgcatctgcaataactcgagaaagccacacacatagggatcggccatcacaacagcagcctcttcgaaatcaggtatgtgttgatcctccattctttcagacactacccttcttcttggctaatattaaaacccaaattcttcagcttctccgctttagtgtatgtactgaaaataaagatcaaatgcttgccatttcttacaggtgtggtatgactttcaagcaaccctcagggcatgtatagttgcactgagatgtggccaggtgccctatatgaagcatccagtctaaagagtcagcctggccaagtgcagtggctcatgcctgtaatccaagcactttgggaggccaaggcaggtagatcacttgagccaggagttcaagaccggcctgggcaagatggtgaaacctgtctctacataaaatacaaaaaattagttgggc

SEQ ID NO: 917 - DNA, 274 bp, Homo sapiens
  CDS 75..272
atacacttcttggctgtgtgcgctcagcaggacgtgggaggctccggcttcaagacactcatccaagaggaaggatggccagtatcttktctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaasacaacaactgcatggccgagtgc

SEQ ID NO: 918 - DNA, 462 bp, Homo sapiens
  CDS 46..462
acttttgggcaggcgtcacgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaagcggag

SEQ ID NO: 919 - DNA, 517 bp, Homo sapiens
  CDS 46..516
acttttgggcaggcgtcacgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgtttgcc

SEQ ID NO: 920 - DNA, 356 bp, Homo sapiens
  CDS 178..354
  misc_feature 209: n=a, g, c or t
agcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagargaatgaacmactctgggacamaccatcctttaanaaccgtaatactcaccgcarggtctgcaacttcattcttgaagtcagtgaggccaagaacccatcaattccgtacacattttggtgactttgaagagactgtcacctatcaccaagtggtgagactattgccaagcagtgagactat

SEQ ID NO: 921 - DNA, 526 bp, Homo sapiens
  CDS 79..525
tttttttccctgctgccggccgcgaccgcaacccgctagccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttgggctgtttctactactgaatgaatctttgaaaaagc

SEQ ID NO: 922 - DNA, 478 bp, Homo sapiens
  CDS 83..478
agagacgctttccctgctgccggccgcgaccgcaacccgctagccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgc

SEQ ID NO: 923 - DNA, 474 bp, Homo sapiens
  CDS 31..474
acctaaagttggggggtgatctctgaggagatggatcggtacctgctgctggtgatctggggggaaggaaaattcccgtcggcggccagtatggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgaggtcttgctgtgtcacccg

SEQ ID NO: 924 - DNA, 434 bp, Homo sapiens
  CDS 252..434
gtgtgcttactgcagcttcgtctgtgcccattacatatctgaatcacgaggcatttaggacgggaatgaaaagaagatcgggggggtgttttaaaaaccaggttctcctcttagcttgaccattcaggagctgagggacctgggcaagtccctccacctctctgggcctctgcatgtaaaggggcgtttgggctaaatgatttgtaaacctctgttcttccaagattctcccctctcagggaactgaaaagatgagagtgtttctgtttaacagcactacaaaaagcctaattgtgacaacaagcgcctctaccctagtgaggaggaaagatttttcagagcttcagcaatctgatttttttttaaagataaaactgattttctcgatcgactctcttcagtctaacccaataaatacgcattgcaatcatttt

SEQ ID NO: 925 - DNA, 900 bp, Homo sapiens
  CDS 725..898
aacaacaacaaccacaaactccgaccgtcctttccaggccctttccctctataaacctgccgttttctgtctcccaagtcatcccagtttagaactgctccaggaaataatgaatgaacagaaagagcctagtttgtttatttatttacaatccactagtctaatctagtttagatccagcggcaatttttggggtgccaaggaggaaagaaggagatggcagtgcggggacagggcagagctgggccaaaggaagccacacccagttcttgccctgccctgcccgacacaggcaacgtgaccccaagcgacascagctgatgcttgcttctccgagcccggcggtcagcagccggaagtagcccgcccggggggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggastgctgcccgtcctgccacctctctgctctgttcttgtctctgccttcattcccgaatcgatctggtaggagtggcatcgcctgagcccgggacgcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttag

SEQ ID NO: 926 - DNA, 522 bp, Homo sapiens
  CDS 130..522
aaaaccgaccaaactggagttagctaccggactgtcccgcgagcgaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggmaaaactgtatctgggaggcaattacattgctgtcatagaaggtttagaaggattaggagaactaagagagcttcatgttgagaatcagaggcttccccttggg

SEQ ID NO: 927 - DNA, 358 bp, Homo sapiens
  CDS 113..358
agttttgaactttataaaagggtcctgtcacccaaagagctgggggacctctaagtttctgagctggtccttagcagttctttctgctcctctccccaacaacttgaggcccatgggccttcttggtccccctccagggcagggtgtctggcagatgcagtctttcatgtctaggtggggctggagctgggacgctagcagctctcctgtaccttctggaccctgctgtctccaggccgacatccagccactgggcctccttccctgcagaaatacacgctttgagaagagtaaaaaaaaaaaaaaaaaaaaaaaaaaaaaaaaaaaaaaaaaaaaaaaaaaaaaaaaaaaaaaaaar

SEQ ID NO: 928 - DNA, 512 bp, Homo sapiens
  CDS 303..512
  misc_feature 346,482: n=a, g, c or t
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgtactttcagtggagatggggttttgccatgttggccaggctgttctcgaactcctganctcgggtgatccaactgtctcggcctcccaaggtgctgggattacaggcgtgaccaytgtgcctagcctgagccascacgccggcctaatttttaaattttttgtagagacagggtctcattakgttgcccagggntggtgtcaagctcccaggtctcaagtgatc

SEQ ID NO: 929 - DNA, 547 bp, Homo sapiens
  CDS 166..546
gtggctgttgcggatggggcgtaggtgggcggtgtgcccacrgctrcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttc

SEQ ID NO: 930 - DNA, 486 bp, Homo sapiens
  CDS 222..485
acaccgatcgcccgcsgccatgggctcctcgcaaagcgtcgagatcccgggcgggggcacgagggctaccacgttctgcgggtacaagaaaattccccaggacacagagctggtttggagcctttctttgattttattgtttctattaatggttcaagattaaataaagacaatgacactcttaaggatctgctgaaasaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcatccttatcgaaacacatg

SEQ ID NO: 931 - DNA, 458 bp, Homo sapiens
  CDS 112..456
  misc_feature 421: n=a, g, c or t
gtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaantcagccagatgctgcctctcaacttaatgtggatgct

SEQ ID NO: 932 - DNA, 529 bp, Homo sapiens
  CDS 54..527
acttagtctcgggccgccatggcagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtgga

SEQ ID NO: 933 - DNA, 501 bp, Homo sapiens
  CDS 205..501
atcttgtcttgttcccgaagaagtagaagcatcgaaagcgttggagaggtgttaccggaacgcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaa

SEQ ID NO: 934 - DNA, 340 bp, Homo sapiens
  CDS 31..339
aaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccasscggcggctgaaccggggcctgcggcggaagcagcactccctgctgaagcgcctgcgcaaggccaagaaggaggsgccgccatggagaagccggaagtggtgaagacgcacctgcgggacatgatcatcctacccgagatggtggggcagcatggtgggcgtctacaacggcaaagacctttcaaac

SEQ ID NO: 935 - DNA, 404 bp, Homo sapiens
  CDS 76..402
acaggccctagcagggaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtg

SEQ ID NO: 936 - DNA, 504 bp, Homo sapiens
  CDS 108..503
atacaaaagatgtagtagggaaaaggagcgacastggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcccgacatgatgaagctaatcattgagtatgcatacacccggaccgtgcctatcacaccggacaatgtggagaaactgcttgctgctgcagaccagtttaacatcatgggtatcgtcaggggttgctgcgagttcctca

SEQ ID NO: 937 - DNA, 602 bp, Homo sapiens
  CDS 274..600
cattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaaatctgatgactcatatctgcaaagaacagaccgtttccaggtatatactaactatgggtggatgatatgctgcaggaaatcatcagcgtgttt

SEQ ID NO: 938 - DNA, 495 bp, Homo sapiens
  CDS 140..493
agtttctccagcttgcctggtgcgtgctggtgtctcgccgcttggtcctctcctgttcttcggcccccggttgccagattgcttttcttccaggcctcaaccagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaa

SEQ ID NO: 939 - DNA, 521 bp, Homo sapiens
  CDS 228..521
agcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccat

SEQ ID NO: 940 - DNA, 539 bp, Homo sapiens
  CDS 228..539
agcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgcttcttccatacatcacgtggatatg

SEQ ID NO: 941 - DNA, 557 bp, Homo sapiens
  CDS 224..556
gaccaaactggagttagctaccggactgtcccgcgagcggctgtactttgcattttgaagagtctaagaatacattccatatcttcaaatattttattgtgggcaatttataataacatagcctgggtaatgccaatgtaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtt

SEQ ID NO: 942 - DNA, 479 bp, Homo sapiens
  CDS 37..477
gaggagttgctggagtgtaagaggaaaagaagtgtgatggccaagagttcacagaggaagcaacgtgactgtgtaaaccaatgcaaatcaaagcctggcttgagcacctcaatccctttgagaatgtccagttacacattcaagaggccagtaacgagaattacaccccatcctggcaatgaggtcagataccatcaatgggaggagagcttkgagaagcctcaacaggtctgctggcagaggagactgcagggactccaggcttacagcagtgcaggagaactttcaagcactttggatcttgccaataccttgcaaaaacttgtccctagttacacaggtggatctctgctggaggatcttgccagtggtctggagcactcctgccccatgccccaccttgcmtgctcttcagatgcggtggagataattcctgcagagggagtgggtatctcgcagctcctctgcaaacaatttct

SEQ ID NO: 943 - DNA, 476 bp, Homo sapiens
  CDS 217..474
ttctcattgtgcgctgctctttggtctcctttagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccaccttggcagcgacttctccctggtcatggagagttccccaagagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagccccagtccttccggtgccatcgggggcctgctggagcaatttgcccgtggtgttggactccggagcatcagcagcaat

SEQ ID NO: 944 - DNA, 529 bp, Homo sapiens
  CDS 38..529
acccgctcccgccgcgcgcgaatcgcggtcgcgagccatggaggaggaggcatcgtccccggggctcggctgcagcaagccgcacctggagaagctgaccctgggcatcacgcgcatcctagaatcttccccaggtgtgactgaagtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctgggattcatgcaatggcagtgggaaagtttgccttgtctacaaaagtgggaa

SEQ ID NO: 945 - DNA, 605 bp, Homo sapiens
  CDS 213..605
aagatagatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgacttt

SEQ ID NO: 946 - DNA, 488 bp, Homo sapiens
  CDS 219..488
atgttttaggtacaccctcctaactgcttaacctatcaacaattttatatactggctgtggaagggcccctcccagtgtcttcaagagtttatgcaagcaaatacctgaaaacctaaggaaaatgatgggaaactgaacttcagatacttatcaaaaagaagatgaaggtagggattgagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggrctattatagcagcagacgcttggtgattgaattagaagaactgaacctgccagactcctgtttcctcaag

SEQ ID NO: 947 - DNA, 285 bp, Homo sapiens
  CDS 94..285
agctacgccggscgcctggctttgagasaacgtgattctccgcagctggtcgcctacscgtgatgttctgcccacgtcgagacctgagctgaaatggcagacgatctcggagacgagtggtgggagaaccagcsgactggagmaggmagsagcssagaagcatcagatggtgaaggagaagsagasacagaagtgatgcagcaggagayagttccagttcctgtacsttsagagaaaaccaaacagcctaaagaatgttttttgatayaaccaaaggaaagaaaa

SEQ ID NO: 948 - DNA, 345 bp, Homo sapiens
  CDS 43..345
agaccggatgtctgtcacagtcatcaaggggtcttgtctgtaatgccaggaggtgtagcacgagatgggaaggtgggggacacactgaagcgaggaaatcctagagggagggccagcctggaggggcgcaaataccgtckybcccaggccccgccccaccccggcagccagagccctgcaagcagtgggggctttctacataagaggcatccacgctgtgctgctctgaacattgagagaatgttaggctgggcgtggtacaggctatgcktaatcccagcactttgggaggccgaggtgggaggattgcttgagcccaggagttcaagacgagcctgggcaagc

SEQ ID NO: 949 - DNA, 557 bp, Homo sapiens
  CDS 238..555
atagcgtgtctacttcacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcag

SEQ ID NO: 950 - DNA, 353 bp, Homo sapiens
  CDS 64..351
aaaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtkggtggaaggagaagtggaggcgtggagcccggaggcccakgatcccgacgg

SEQ ID NO: 951 - DNA, 515 bp, Homo sapiens
  CDS 213..515
atatattcttttagggaagcaagcgcttcacctgggtggccgggatcgaacccgcgaagggctgaaggcggagggcaacgacgctgtggaactctgtttccctgcagagcctacgtggtgggcggcaggccgaccgccctgggggccctgcacctctgggatttatagcaacatcgccagcttctcagctgtcaccgacagaattgacagaaatgcggaatgatctctttaataaagagaaagccaggcagttatcattaactccacgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatatttg

SEQ ID NO: 952 - DNA, 508 bp, Homo sapiens
  CDS 141..506
attggcttctctcccagtttccaccacactccccatctgggtaacctaagcaggttactcgcccctgtgaggaggttctcttctctgtacaatggaaatggttatccacacctatctctcagggaggctctgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaa

SEQ ID NO: 953 - DNA, 466 bp, Homo sapiens
  CDS 195..464
tttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcasagggccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagc

SEQ ID NO: 954 - DNA, 476 bp, Homo sapiens
  CDS 99..476
cgtttgtgtctaaacggaggctcggccacaacgccactggattggtggtagggcggggcgggccacagtctccagcctgaagcgkaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatc

SEQ ID NO: 955 - DNA, 506 bp, Homo sapiens
  CDS 149..505
agccatttccaactagctggcgggggcggaagatggcgacgccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagrgttagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagagatatacttaatgggcaaagagaatgagattaaaggagttgcagcaagttatcagcagcaga

SEQ ID NO: 956 - DNA, 440 bp, Homo sapiens
  CDS 202..438
atttttttttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcasaggrccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactct

SEQ ID NO: 957 - DNA, 628 bp, Homo sapiens
  CDS 395..628
atgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgrggttccgggaaggggctaggccggcttgaaaagagattatgactgtaccttttaactytgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggaggtgcacccagtcctgcagttcaaagcctggcaagactcaccatcatcttcctcctcctcatactgctaatgagaatcagcagctgtgtttctacagtgataatctgcgtatgcatgttcgtgatgttccaatcaccaaaaaggctattgattttaggattcctgagtacctacaaaagctacttaaacatcca

SEQ ID NO: 958 - DNA, 525 bp, Homo sapiens
  CDS 183..524
agagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggraaggcctcattgtccgtggggcaaaaaatactttctcttcaggatctgatctgaatgctgtga

SEQ ID NO: 959 - DNA, 497 bp, Homo sapiens
  CDS 209..496
atgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaagagagtaacatccccaagtcctcagcaaaacccatccagcccaagctggcaatatt

SEQ ID NO: 960 - DNA, 502 bp, Homo sapiens
  CDS 195..500
aaacggcggtcgtgccccgccgctgctgtcacccccggccgctgctgccctccccgccgaggttctactgctctccttcttaagaagggtgggaggcactcggtctctccccacacctctcgcctgaggccaggcccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcaccaggacctcatccagtggggggccgattattttgaggccctgtcccgtggagagacgcctccggtgagagagcggtctgagcgagtcgctttgtgtamttgggcagagctaacacctgagctgttaaagatcctgsattctsaggttgctggcagactgatcatccgtgcagaggagctggcccagatgtggaaagtggtgaatcttcccaaacagatctg

SEQ ID NO: 961 - DNA, 525 bp, Homo sapiens
  CDS 188..523
aaaagccaggagggttcgaattgcaacggcagctgccggggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtct

SEQ ID NO: 962 - DNA, 444 bp, Homo sapiens
  CDS 70..444
  misc_feature 52: n=a, g, c or t
cagaaacttccacgargkccctgatttcatcttcttcctccttgcagctcanaccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggcsktcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgcttctaccggggatccgtgtacccctcgcagccagccggtgactgctggtaccacatcccgt

SEQ ID NO: 963 - DNA, 334 bp, Homo sapiens
  CDS 122..334
agcgggataaccttgaggctgaggcagtggctccttgcacagcagctgcacgcgccgtggctccggatctcttcgtctttgcagcgtaccgagtcggtcagcgccggagacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtg

SEQ ID NO: 964 - DNA, 457 bp, Homo sapiens
  CDS 184..456
agctcagtgttgtgtgtccgttgcgtgtttggtgtccattgctctgtccggttttctccgcgaggctccaagtgactccgccattgcctccatggccctgcgacctgcaggtactggaaggtccattgggaagatgtcgggacaccrsagaagacaagaaccaattctgttagcctatcgaaaatgcaagatgcagttctttcatgggaacacttattagaacttaagaataatcattgtgaacaacttacagtaaatattaaacaaatggaaaatatggttggtgtactacaaaaggagctatgtgaagcaaaagaaacacaattacagttagagcatgaaaaaggkcaatgggaacaagaacgctacagtttgagatggagctgtctagttgaaggaaaacaagctcagggactttcactgattctacatcataatgaccttaaaagaagaagak

SEQ ID NO: 965 - DNA, 498 bp, Homo sapiens
  CDS 288..497
ttgtttgttttatgagacagggtcttgctctgtcacccaggctggagtgcagtggtgcaatcagagtttactgcaggcttgacttcccaagctcaagtgatcctcccagcctctcaaatagctgggaccacaggcacctgccaccctatcctgctaatttttgtattttttgtaaagatggggttttgccatgttgcctaggctgatctcaaactcctaggtgcaagtgatccctcatctttggccctaagtgctgatattaaagtgctgatataaaagccgacaagatgttatactcagaaaaagctgaagacgccaccaagaaactaatagaactgataaacaaattcagcaaagttgcagaatacagagtcagcatacaaaaatcagtagcatttccatatacccaaagtgaacaatctaaaaaagaaatcaagaaagcaatcccatttatcatagctacaaagggtataaaatacctaggaatcaatttaacca

SEQ ID NO: 966 - DNA, 311 bp, Homo sapiens
  CDS 128..310
attttcattgcttcccctgtccttcctttagctgtaactccggcgggcgtgttgggtgtgtcgttttaggctctgtgacccaggagcaagacgcaataagcgggtgcagtggaggtagaaacgggaaatgcagtaccctttccggaagctactccgcccctcgacagagtcttgctgtgtcgcccaagctagagtgcagtggtgtcatctcggctcatcacaacgtctgcctcccaggttcaagcaattatctcacttcagcctcctgagcaacaaagcaagactctgtcccaaaaaaaaaaaaaaaaagg

SEQ ID NO: 967 - DNA, 182 bp, Homo sapiens
  CDS 13..180
tatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaaatttcaat

SEQ ID NO: 968 - DNA, 549 bp, Homo sapiens
  CDS 215..547
  misc_feature 544: n=a, g, c or t
aacgaaagatggcggcgccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcancctgg

SEQ ID NO: 969 - DNA, 495 bp, Homo sapiens
  CDS 230..493
aaccgccgcagcccactcgtttgtgctttgcgccttcctcctccgcgccttggagccggatccggccccggaaacccgacctgcagacgcggtacctctactgcgtagaggccgtagctggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttcagcaaagatatcagttatcttatttcaaata

SEQ ID NO: 970 - DNA, 459 bp, Homo sapiens
  CDS 247..459
  misc_feature 362: n=a, g, c or t
acaaagcctccaagaaatatgggactaggtgaaaagaccaaatctacatttgattggtgtacctgaaagtgaggggaaaatggaaccaagttggaaaacactcttcaggatattatccaggagaacttcaccaatctagcaaggcaggccaacattcaaattcaggaaatacagagaaggtgacaaagatactccttgagaagagcaaccccaagacaaataatcatcagattccccaaggttgaaatgaaggaaaaaatgttaagggcagccagggagaaaggtcaggttacccacaaagggaagcccatcagactaacagcagatctctcggcagaaaccctacaagctagaaaagagtnayggccaatactcaatgttcttaaagaaaagaattttcaacctagaatttcatatccagccaaactaagcttcataagcgaaggagaaataaaagcy

SEQ ID NO: 971 - DNA, 492 bp, Homo sapiens
  CDS 248..490
aaaacgggatggggagctggaccagattatgagcttacagaaagcctggcctacattttactctttttggatttcttcctcatcaagagactgctgcggtgcctgtcatatggggtctcattatgtcagccaggctggtcttgaactcctggcctcaagcaattcttctgccttggcctctcaaagtgctgggattacaggcatgagccactgtgcccagcacagaaggtgacagcggcatggacatatgccccaggctttcctgctggggtccatccatgagcctgcaggtgccctcatggagccccagccctgccctggaagcttggctgagagcttcctggaggaggagcttcggctcaatgctgagctkagccagctgcagttttcggagcctgtgggcatcatctacaatcccgtggagtatgcatgggagccacatcgcaactacgtgactcgctactgccagggccccaaggaagtactcttcct

SEQ ID NO: 972 - DNA, 471 bp, Homo sapiens
  CDS 131..469
aaacgggatggggagctggaccagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctacccagggccccaaggaagtactcttcctgggcatgaaccctggaccttttggcatggccagactggggtgccctttggggaagtaagcatggtccgggactggttgggcattgtggggctgtgctg

SEQ ID NO: 973 - DNA, 472 bp, Homo sapiens
  CDS 214..471
aagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcgggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaa

SEQ ID NO: 974 - DNA, 282 bp, Homo sapiens
  CDS 83..280
ctttttctccytcctagagcctggttgcagccacttgtgcgatcccggaccttgccgcggccgcctggstcctttccgcgccatgagccgcagttcacggtcacctcgctgccccccgcagcccgccagaagccctgacccagagtcccgccggcattcggtcgcagacccgccacctcccgggggaagacgtcaaaggggtcytctccctggctctgaggccctcgggtctggaaggaacaaggcgaatcgggcttgtagtggccccagcgaggggaggag

SEQ ID NO: 975 - DNA, 322 bp, Homo sapiens
  CDS 171..320
agtggttcggccgcggcgaccccactccggcggcgcgtcccccgagcttggtacggctcagcccgtctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctmgggggtcgcggccgycctccgcggcccctcgtggtgcgcgccgtccgctcgcgctcctggcctgccagcccyccgaggcccgcagcctycgcggatccggg

SEQ ID NO: 976 - DNA, 479 bp, Homo sapiens
  CDS 101..478
tataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgtctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaaatctcttgtacggcta

SEQ ID NO: 977 - DNA, 514 bp, Homo sapiens
  CDS 281..514
atgctcgccagaatacccctcgttaaaggcaaggcggcttctggctcttccgcagctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcasgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgca

SEQ ID NO: 978 - DNA, 493 bp, Homo sapiens
  CDS 278..493
gtgtcttttaggaggtggcagggcctccggttgggcgtttaactaggaagtggcggasaagttggtggggcctggttcaagataagaaccccgacttaggagggggaggaacgagaggctggaattggggcggaggggtggaggatgcaggagcctcggggaggagctggttttttgcacgcaggagactacaaggagatgatgagaggatgaagatgggcctggtttcatccgatccctgtcctaccgcctccctgttcttgcagcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggca

SEQ ID NO: 979 - DNA, 459 bp, Homo sapiens
  CDS 67..459
  misc_feature 167: n=a, g, c or t
aggcacctctgcacgtcctgccccgccggaagtggaggccgcgggctctgagcggcccctgcccggatggcaacagtagttctaggaggagacaccatgggccctgagcgtatcttccccaatcagactgaggaactgggacatcagggcccttcagaaggcactgnggattggagcagtgaggagcctgaggaagagcaggaggaaacggggtcgggcccagctggctactcctaccagcccctgaaccaagatcctgaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaagc

SEQ ID NO: 980 - DNA, 481 bp, Homo sapiens
  CDS 254..481
agatacccccggagctccagccgcgcgatcgcttcccgccgctctgcccctaaacttctgccgtagctccctttcaagccagcgaattattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaaagagcagagctgacatctgataaagacatgtaccttgacaacagctccattgaagaagcttcaggagtgtatcctattgatgacgatgactacgcttctgcgtctggctcgggaactgatgaggatgtagagagtccagagctgacaacatctcgaccacttccaaagatactgttgactagtgctgctccaaaagtggaaaccacgacgctgaatatacagaacaagatacctgctcagacaaagtcacctgaa

SEQ ID NO: 981 - DNA, 503 bp, Homo sapiens
  CDS 350..502
attatttgggattttgttcttaggtggttgaagttcataggtgtggattgtattactagaaaagatttagtaaatgaaaaatgaaacaaatatgtaaataaaggaagacaagtagagccatatgttgcctaatttatgagaatgtataatgtatttattattattaacacacttctgaagcactcagtttyaacataaaattgattaaatctgatacctattttggtaaggaatatacatacagagacaagtacctagaaatcagtattgtttgtcctgcattatttagatgttgctgggtwmttaatgaacacaagaaaatatgatctagtctgggaatcatgagcaaatgacaggtgttaacgccattcatattwctgatgcaatctgtatgttcacagatattgatgatgtcatgagtgaatgtatacacaggagtgaatgtattcagttatttgasgaaggtaaagcagtgtttcttgactttggctctattgacattt

SEQ ID NO: 982 - DNA, 388 bp, Homo sapiens
  CDS 119..388
  misc_feature 360: n=a, g, c or t
attcagaagactgtccacccgtcctcagccccctctcttcgtgggctatctactcagttgatccctccctcgctggcttggctctgastcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggscaggcaactcggcrnmccgvcaccatcgtggtgcccagcacaa

SEQ ID NO: 983 - DNA, 414 bp, Homo sapiens
  CDS 131..412
ccgcccgccgtcccccgcttggcttccagcgccgcttgcgctccggagcgctggctctgctggcgctgagaratggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatct

SEQ ID NO: 984 - DNA, 540 bp, Homo sapiens
  CDS 71..538
cgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaat

SEQ ID NO: 985 - DNA, 482 bp, Homo sapiens
  CDS 227..481
ctttgttttagagcgtttagtaacattccttatgccactggagttgctgacttacttatgatggccacagttagttgtccacggacttctaatgcaagaagttgcctttcctcagacctgtgctatatatcattagagcggtaatagctggccacttactgggttctcctggaaagaggctttaacagactgtgaacctgtaacmctccatatccagctgtccattatgccttacatcaccctcaaggttcagtatggctaccaaggtctctttgctacaggatggggccaaatctgggccatctgtatattctacttgcaggagaggatggccttctctgtcctcaatttcttgccatgttttggcactggagaaagacaccacttttccagaccccttggctacccaggaaactcgctggaattaatggagttatttgcaatgagattttgtacacttcacagatggaattgccatcatc

SEQ ID NO: 986 - DNA, 488 bp, Homo sapiens
  CDS 290..487
  misc_feature 324,329,331..332: n=a, g, c or t
aaatcatttgggwcccgtcagtattgtggaagctttgttcttttgctttttgcagtaaatgttggtgctggtcactctttgggtctgtgctgcctttatgagctgtaacactcaccacaaaggtctgcagcttcactcctgaagtcagcgagagcatgaagccaccgggaggaaagaacaactctggacgcgccaactttatgaactgtaacactcaacgcaaaggtctgcagcttcactcctgacgtctgtaagaccatgaacccaccagaaggaagcaagtctggagatgtccgaacatcagaaggaacaaactccagatangccgndnnkgagaactgtaacactcactgccagggtccgcggcttcattcttgaagtgagcaagaccaagagctcaccaattctggacacagcaccattattcacaacagccaaaaagtggaaacaattcaaatgtccatcaactgatgaatggataaactgtg

SEQ ID NO: 987 - DNA, 429 bp, Homo sapiens
  CDS 32..427
gaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcargaagctga

SEQ ID NO: 988 - DNA, 492 bp, Homo sapiens
  CDS 185..490
agagcgcgcgcccggggtgcgaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaattttt

SEQ ID NO: 989 - DNA, 509 bp, Homo sapiens
  CDS 206..508
attacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgg

SEQ ID NO: 990 - DNA, 459 bp, Homo sapiens
  CDS 150..458
  misc_feature 44: n=a, g, c or t
tttttctcctgtgcgaatcccagcttgcctcagaagcgtcgcgnagaaggggccacctcaggtgaagcgcgcttgtggaggagttgtggaggacgcctgtcgacgaccagtaactggtcctcggccattgcgtcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagta

SEQ ID NO: 991 - DNA, 551 bp, Homo sapiens
  CDS 214..549
aattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaagttccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagtt

SEQ ID NO: 992 - DNA, 549 bp, Homo sapiens
  CDS 94..549
cttttcggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcgcacctcatccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaagagaggaaaaawctatgttggctgtccggagtacacatggcttagaagtt

SEQ ID NO: 993 - DNA, 565 bp, Homo sapiens
  CDS 208..564
acttcgtacttgaaaatatcgaatgagtgttttaaggcagttttacttggaagttgacagaacaagataagttagacatcagtacattttactgttatgttgaaattaaaataactatttacttgtatacataaaattaagattttaaatgaaagcaaattttgaataaatgtaggtttcagtgagttaaaacattacttttcctaaatgacagaaaataagaatactctgtttaatactttctctcttcctttttctttcccttcaggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgt

SEQ ID NO: 994 - DNA, 533 bp, Homo sapiens
  CDS 85..531
agaggtgattttctgagtgtgactcctctgttcctggcaccctgtcatccttrgccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgc

SEQ ID NO: 995 - DNA, 229 bp, Homo sapiens
  CDS 72..227
tctgagtaaagcaaggtgtaatttttgtttttgagtgttaagaaaaaatttccattcgaaaatctaggctgatggaattaaatagagatgaagtaaacattatggcaacatctatacctctatatagaaaaatattaatatgcattaatctatatatagataagccttttttccattgctcttatagtcttatattttggaatcaaccctgtagaactaaaggtaccca

SEQ ID NO: 996 - DNA, 418 bp, Homo sapiens
  CDS 229..417
  misc_feature 131: n=a, g, c or t
attttgtatctcccctttcatggaacacaaagcacgttttgcataacttctagatacatgtacttctattttgaatgacctgatatatcttttttctttacaattctcaacctcagcatatgtaagtggmnctcagaaggcaacattccctgaacatactcttccaccagaatctcctctacagatttttgctgccccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacac

SEQ ID NO: 997 - DNA, 220 bp, Homo sapiens
  CDS 54..218
  misc_feature 188: n=a, g, c or t
ctttttccgctcggstgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggsccggcaagccaargcgcgccgnatcgccccgcgccccgcgtcgggtsccatccg

SEQ ID NO: 998 - DNA, 476 bp, Homo sapiens
  CDS 307..474
cttttcctctcccaggtgcgcttccctgcttgatctgtgtaccctgctctttctccttcattccgcagcctcctttgccctgtgacctgcaggtactggacggtccctagagaggataccgggacgctcctgaagccgcgagatggatgggtcttccatgatactgaagggagagccacatgttgatgcccaggaccagctgcctccttggtctgaaaggcctgatcgaggccaggattggctatgagagctgggaaatgggaccatctttgaagccatgggagagggtgagagccaccatcactcatgttcttgaatgggaactgcctggagaccctgaagaagaaggagcctgaaggaggaaggaggaggctgagccatcccgggaacatgggctggatgaggccaagccaggagacgacaccaccagatagaagtcaccattcaggatttggacttttctgtggagatcctgg

SEQ ID NO: 999 - DNA, 357 bp, Homo sapiens
  CDS 139..357
atataaacccgcgcgcccgccaggcgctgcggccgtcccgggccgtgactcctcctttcccccgccccgcctccgttcggagagccggcgggcsggcggcctctcggccaggaagcgcctcttggacgcgtgtgaccgatgcccagattgcacgaccacttctggagctgctcctgtgcgcacagcgcgaggcgccgaggccccccgcgagcmagcgccgcggggctggcggccaaggttggggagatgatcaacgtttccgtgtccgggccctccctgctggcggcccacggtgccccggacgctgaccccgcgcccaggggccgcartgctgcgatgagcggscccgagcccggs

SEQ ID NO: 1000 - DNA, 319 bp, Homo sapiens
  CDS 38..319
aggatatttcctggttagtggctgccgggtaatcacgatgcatccatcttcctcggcgtcgcagccctcagtagccagaaggcagtctccttccctggggggcaaaagccccgagcccagcctgcccgttgccccgctcccgcggtggatgaacctcaacccttcccaggctccttcctggmcccarggtcccaggacccccgaraccctggggtrcggcgccactgargcccagaccgggggaaggagaccctgtmactcgggadcggascctgthccgggarcgcacggaaatdcctcctccacgctcccaaggttc

SEQ ID NO: 1001 - DNA, 490 bp, Homo sapiens
  CDS 29..490
acgcgaggstgcggcgcacgattgaagaatgtcccggattccactggggaaggtcctcctgaggaatgtcatccggcacagagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtct

SEQ ID NO: 1002 - DNA, 584 bp, Homo sapiens
  CDS 128..583
attttccgggaagatggcggcgcacaagtcaggtccggcacatgtttccgcggrgccccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccgaaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtcaagtccccaaagattcttactgatgagatgctgctccaagcctgtga

SEQ ID NO: 1003 - DNA, 520 bp, Homo sapiens
  CDS 188..520
ggttctataaatggcggtttccccagctcgctcttgcctgctgctacgtgagacgtgtacgcttctgtttcaccttccgctgtgattctaagtttcctgaagccggctaccctgcttcctgttaagcctgtggaactctagtggacatctgaaaccctaaaacatctcatctgtgcaaaaaagaggaatgagccaggtcgggagagtgagaagctcgcaccacttcgaaagcgtctgcctggatgctgaagttcgggttgttcttgtagctctggatcacgcaggacttcacaccttgtcctccgcactcaatgagagcctgaggccgatccacagagaggagctgcaccttcttcatttcccgaactccccagaagagaacctgaggaaaagaccagcagagccatcaccacagatccacggaggagccccacacctgccctggctctgtgtggaaaagtcagacctgctccctgagaaccacgctgtgttcctccaggaaagaactgcacagcttttt

SEQ ID NO: 1004 - DNA, 490 bp, Homo sapiens
  CDS 218..490
atccgttttggaagaccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgat

SEQ ID NO: 1005 - DNA, 452 bp, Homo sapiens
  CDS 196..450
  misc_feature 423,445: n=a, g, c or t
agagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggagaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaatakgcatattgagcacaatgaagcnagagatgatgtagaaaggtttntagggca

SEQ ID NO: 1006 - DNA, 474 bp, Homo sapiens
  CDS 217..474
gtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggagaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccaaaaaccagggagacgaaggagacgctggggagggagagaactaatgtttctcgtgctttgtgatctgttcagtgtcactctgtaccctcaacatatatcccttgtgcgacaaaaaaaaaaaaaaaaa

SEQ ID NO: 1007 - DNA, 460 bp, Homo sapiens
  CDS 201..458
  misc_feature 456: n=a, g, c or t
agagctacgcagccttcggtgcagtcgtcactcgtgtctcgctaccagctccccgctgccctgsgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggscctssctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattnggga

SEQ ID NO: 1008 - DNA, 443 bp, Homo sapiens
  CDS 201..443
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggattgagagaagagaa

SEQ ID NO: 1009 - DNA, 425 bp, Homo sapiens
  CDS 185..424
ggtgcagtcgtcactcgtgtctcgctaccagstccccgstgccctgcgctcggcgggctggcatccggcccgggggaaagcggaamcagcccttctgcaggtctgcggggccaagtgtcmcggcggcgcacctcgtggcgagaatcgggagaaggaggagactaaaaggataggcccagragtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttagggagcccatcctgcagtatagatgggatatgatgcataggcttggagaaccacaggcaaggatgagagaagaga

SEQ ID NO: 1010 - DNA, 508 bp, Homo sapiens
  CDS 168..506
  misc_feature 482: n=a, g, c or t
gtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctncgggcagtcagcactgacccccctca

SEQ ID NO: 1011 - DNA, 468 bp, Homo sapiens
  CDS 201..467
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtga

SEQ ID NO: 1012 - DNA, 429 bp, Homo sapiens
  CDS 201..428
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctsmstttggatgctggtgaatactgtgtgcctagaggaaatcgtaggcggttcsgsgttaggcagcccatcctgcagtatagatgggatatgatgcatargcttggagaccacaggcaaggat

SEQ ID NO: 1013 - DNA, 494 bp, Homo sapiens
  CDS 172..492
  misc_feature 35: n=a, g, c or t
actcgtgtctcgctaccagctccccgctgccctgngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagt

SEQ ID NO: 1014 - DNA, 533 bp, Homo sapiens
  CDS 201..533
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgac

SEQ ID NO: 1015 - DNA, 429 bp, Homo sapiens
  CDS 201..428
agagctacgcagccttcggtgcagtcgtcactcgtgtctcgctaccagctccccgctgccctgsgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaagga

SEQ ID NO: 1016 - DNA, 413 bp, Homo sapiens
  CDS 159..413
aaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggsggttccgcgttaggcagcccatcctgcagtatagatgggatatgatgcataggcttggagaaccacaggcaaggatgagagaagagaatatggaaaggatt

SEQ ID NO: 1017 - DNA, 430 bp, Homo sapiens
  CDS 159..428
aaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagaca

SEQ ID NO: 1018 - DNA, 509 bp, Homo sapiens
  CDS 176..508
actcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacc

SEQ ID NO: 1019 - DNA, 516 bp, Homo sapiens
  CDS 159..515
aaccagctccccgctgccctgcgctcggygggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatg

SEQ ID NO: 1020 - DNA, 507 bp, Homo sapiens
  CDS 201..506
agagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtc

SEQ ID NO: 1021 - DNA, 411 bp, Homo sapiens
  CDS 207..410
agctgcagagctacgcagccttcggtgcagtcgtcactcgtgtctcgctaccagctccccgctgccctgcgctcggsgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcata

SEQ ID NO: 1022 - DNA, 487 bp, Homo sapiens
  CDS 172..486
  misc_feature 34..35: n=a, g, c or t
actcgtgtctcgctaccagctcsccgstgccctnngctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgc

SEQ ID NO: 1023 - DNA, 480 bp, Homo sapiens
  CDS 171..479
  misc_feature 426: n=a, g, c or t
actcgtgtctcgctaccagctccccgctgccctgcgctcggcgggctggcatccggcccggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctcsctttggatgctggtgaatactgtgtgcctagaggaaatcgtaggcggttccgcgttaggcagcccatcctgcagtatagatgggatatgatgcataggcttggagaaccacaggcaaggatgagagaagagaatatcgaaaggattngggaggaggtgagacagctgatggaaaagctgacggaaaagcagttgagtcata

SEQ ID NO: 1024 - DNA, 443 bp, Homo sapiens
  CDS 169..441
  misc_feature 437: n=a, g, c or t
agtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtganacagct

SEQ ID NO: 1025 - DNA, 440 bp, Homo sapiens
  CDS 201..440
  misc_feature 71: n=a, g, c or t
agagctacgcagccttcggtgcagtcgtcactcgtgtctcgctaccagctccccgctgccctgcgctcggngggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagag

SEQ ID NO: 1026 - DNA, 464 bp, Homo sapiens
  CDS 173..463
  misc_feature 418: n=a, g, c or t
actcactcgtgtctcgctaccagctccccgctgccctgcgctcggcgggctggcatccccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctcsctttggatgctggtgaatactgtgtgcctagaggaaatcgtaggcggttccgcgttaggcagcccatcctgcagtatagatgggatatgatgcataggcttggagaaccacaggcaaggatgagagaagagaatatngaaaggatttgggaggaggtgagacagctgatggaaaagctgaggg

SEQ ID NO: 1027 - DNA, 524 bp, Homo sapiens
  CDS 159..524
  misc_feature 85,464: n=a, g, c or t
aaccagctccccgctgccctgcgctcggcgggctggcatccggcccgggggaaagcggaccagcccttctgcaggtctgcggggnmaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgavnvatagtctgcgggcagtcagcactgacccccctcaccatgaccatcatgatgagttttgc

SEQ ID NO: 1028 - DNA, 381 bp, Homo sapiens
  CDS 211..381
  misc_feature 35,249,262: n=a, g, c or t
actcgtgtctcgctaccagctcsccgstgcsctgngstcggsgggctggcatccggcccgggggaaagcggaccagcccttctgsaggtctgcggggccaagtgtcccggcggsgcacctcgtggcgagaatcgggagaaggaggagactacaaggataggcscaggagtaatagarwccaaagagaaacgagsagtaaacagtctcagcatggaaaatgccaaccaagaaratgaagaaaaggagcangttgctaataaangggagcccttggcmctccctttggatgctggtgaatactgtgtgcctagaggaaatcgtaggcggttccgcgttaggcagcccatcctgcagtatagatgggatatgatgcataggctt

SEQ ID NO: 1029 - DNA, 479 bp, Homo sapiens
  CDS 172..477
actcgtgtctcgctaccagctccccgstgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggatcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatcggaaaggattcgggaggaggtgagacagctgatggaaaagctgagggaaaagcagttgagtc

SEQ ID NO: 1030 - DNA, 474 bp, Homo sapiens
  CDS 130..474
cttttctttggccctgtgacacgtagcaacggggctggttcagggtctgaaacagagtttgggggttgtttgggattagtgaagctactgcctttgccgccagcgcasctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagcmatacaccgggcagatttaccagccaactcaggcatatactccagcttcacctcagcctttctatggaaacaactttgaggatgagccacctttattagaagagttaggtatcaattttgaccacatctggcaaaaaacactaacagtatttaacatccgttta

SEQ ID NO: 1031 - DNA, 556 bp, Homo sapiens
  CDS 129..554
agttctttggccctgtgacacgtagcaacggggctggttcagggtctgaaacagagtttgggggttgtttgggattagtgaagctactgcctttgccgccagcgcasctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagcacattgctactg

SEQ ID NO: 1032 - DNA, 537 bp, Homo sapiens
  CDS 376..537
  misc_feature 257: n=a, g, c or t
tggcttcctgtttccagggtgacgtagatttttttccttcgccagtctcaccgtacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggnttattgtatcaatcaccatcctttataccaggatttgcatatccttcaagatgcctgaagacaatcggaggggtatacaagcaagcgaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaataca

SEQ ID NO: 1033 - DNA, 425 bp, Homo sapiens
  CDS 140..424
agagaaggcattgtttcaattattaaaagtgtgggggcagtgggcggaacaaacgcgccgactacagaggctggacgaagcttagcggtggcgcgcgtgcsacgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcamgcaagagatgaccatgggaa

SEQ ID NO: 1034 - DNA, 462 bp, Homo sapiens
  CDS 134..460
  misc_feature 118: n=a, g, c or t
ttttttcctcggattcccggatgtggttgccaaaacaaaggggatttggtgatggaggctttgttagaaggaatacaaaatcgagggcatggtgggggatttttgacatcttgcgamngaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggatttcagaggaaataccaaaaatcacagggaagatcggtctga

SEQ ID NO: 1035 - DNA, 455 bp, Homo sapiens
  CDS 97..453
ccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaa

SEQ ID NO: 1036 - DNA, 447 bp, Homo sapiens
  CDS 260..445
agccaatccctaaaataacggtggttgaaagggcattccgtgactgcgggcactatcctcttctcgcccctcaccaggcctcacctactttacagcgttttgcagttcgcacgcagctttccctccccttaccttcccacgcctgcctttccccccagactctggctgcggaggtaaaaggtttcccttgtgtaattaaggagtgagtttcgggctgctgggggtaaggagctgccaggatcagtgctgtgtccgtcacatgcaggaggagggtgaagtcccagccagcgctttccagaaggcaccagagcccttgggcccggcggaccagtccgagctgggcccagagcagccggaggccgaagttggagagagctcggacgaggagccggtggagtccavggcccarcggctgcggcgcaccggattgcagaaggtacagagcct

SEQ ID NO: 1037 - DNA, 450 bp, Homo sapiens
  CDS 289..450
acatttcagctgaaggcccagcctggggaaaggctcaggcagggtgttggacaccccctgaggactaagctcatggatgcaggggctgtgggccctctggacaccccctgaggactgagcttgtggctgcagaggccgtgggcctctgctttgtggggctgggctgagtagggtgagggaagccctggcgtctgcagaccctcctgtactgatgacctgtaccacctgctctgtctccatggcgactcgaggaggaggaggctgggcctgcatcacctccatttttgcatgcatgagaacttgagtgctgtggtcagccctgacagctcggatctttccggtgaggagtacatgttggaaacacgtatttcatgttctcaggagaccatttccctcctgctcaatcccaaggctgttcatgtacccagcaaggatttattgtgtcttcaa

SEQ ID NO: 1038 - DNA, 453 bp, Homo sapiens
  CDS 178..453
agaaatccccatggtggccagagtgtcaggtctcatcgtgacgctcttgtcctcctccttcccaggtgggcctttgcagaacgggcagccctcagcagagatccaagaagaagtggccttgaccagcttgggctccggcccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggaggaggttggagatgtttgggaagctgaaccacgccaacgtgtgcggctcctggggctgtgcgggagstgagcccactacatggtgctggaatatgtggatctgggag

SEQ ID NO: 1039 - DNA, 291 bp, Homo sapiens
  CDS 133..291
aagagcgtcctagcagtgtcactgcgtgggttggtttgtgtagagaggcgtgasgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctggtcsctrgtcatgcgcasgcccggragstctamctctcggccaaggtggas

SEQ ID NO: 1040 - DNA, 520 bp, Homo sapiens
  CDS 53..520
tttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacacactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctc

SEQ ID NO: 1041 - DNA, 454 bp, Homo sapiens
  CDS 250..453
attccctggatcccattcgtggcccactcccacgatctaccgctagatataccagcgcccccgtgatccgagtcgaattccttcttctgaggaaccaagaattgtggttgctgaagacccatccggattcactgccagtgacttggacaccttccactgctaacactattaactcggacaccttccactgctaacacaataacactgggttattgtgtttatttggagaatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaakaggagcccctacttcacaacagcaagctggacaaagttcctggggtacaar

SEQ ID NO: 1042 - DNA, 479 bp, Homo sapiens
  CDS 44..478
ctttttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctaaccttgggggagatcgaggtcatgattgcagagcccagctgcaggggtaagggccttggcactgaggccgttctcgcgatgctgtcttacggagtgaccacgctaggtctgaccaagtttgaggctaaaattgggc

SEQ ID NO: 1043 - DNA, 532 bp, Homo sapiens
  CDS 363..530
tcgtctcgttggttccggagtcgctgcggcggtgggaaatgctggcgcgcgcggcggggcactggggcccttttgctgaggggctctctactggcttctggccgcgctccgccgcgcctcctctggattgccccgaaacaccgtggtactgttcgtgccgcagcaggaggcctgggtggtggagcgaatgggccgattccaccggatcctggagcctggtttgaacatcctcatccctgtgttasaccggatccggatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccggggaacggagtccctgaatgccagcattgtggatgccatcaccaagctgctgac

SEQ ID NO: 1044 - DNA, 516 bp, Homo sapiens
  CDS 327..515
ttctgggaggacgaactcaccgaggcgagaagtgtaacattctctcsacccagcttataaaaggattctttactgtgccagcacggggattggatccgaagaaactggctactggggtttggcccccgagtggccgtccctgtggagatgcaccccattcttgggccccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttc

SEQ ID NO: 1045 - DNA, 471 bp, Homo sapiens
  CDS 82..471
aatctcctgcgtgattcctctgccctcagtcatacccagttgaggggctcaccccacgggttctacccgctggagggggccatgttccctgctcccgcccttcctcctcaccagtccttgcctcggtatcagcccccaggtggggagctctgctgctgcctggaccaggtcctacttccctctcctcgggatgtaggaaagggagggccagccctagagctcacccaccccccacagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggac

SEQ ID NO: 1046 - DNA, 356 bp, Homo sapiens
  CDS 82..354
aatctcctgcgtgattcctctgccctcagtcatacccagttgaggggctcaccccacgggttctacccgctggagggggccatgttccctgctcccgcccttcctcctcaccagtccttgcctcggtatcagcccccaggtggggagctctgctgctgcctggaccaggtcctacttccctctcctcgggatgtaggaaagggagggccagccctagagctcacccaccccccacagcaagcctgtgtactccgctctggccaccttgcttctcgcctccatcacctacccgcctggtgtgggccacttcctagcttctcggctgtccatgaagcagcatctggactcgtstgttc

SEQ ID NO: 1047 - DNA, 177 bp, Homo sapiens
  CDS 24..176
gcaaccctctcaggtcaccttccatgctgtggtggctttgttctttccctctttgcaataaatattgctgctgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1048 - DNA, 496 bp, Homo sapiens
  CDS 78..494
cctgtcccgcagcgtcccgccagccagctccttgcacccttcgcggccgaggcgctccctggtgctccccgcgcascatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatgkcaagaaagagtggaagcacttcttgtcggacactggaatggcttgccgctcaggaaagtattacttttacgacaactactttgacctgccaggagctcttctgtgtgc

SEQ ID NO: 1049 - DNA, 470 bp, Homo sapiens
  CDS 94..468
attgaagaggaggaggaggttgagaaaaggtttctcccatcagtttttatctaattcattcttttgagaggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaa

SEQ ID NO: 1050 - DNA, 531 bp, Homo sapiens
  CDS 229..531
gattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttaggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaactcctgttcacaaagaaaaacgagaagcggcgaagaaaaaacaaaaaaaaaaaaaaaa

SEQ ID NO: 1051 - DNA, 516 bp, Homo sapiens
  CDS 363..515
gggaagacacctggctggtctgaagcggctcatgaggctgagtgtacagtggctgccagaccaagagagctggactgcagtggatgagagctcctggcccagctcagactaacatacttggacatctctgatcctttctcgtttccaactaacaagctctgctgtgtgactgcaattctctgcctgtgcatgaatgtatgcctttggattcgctctggaagagtaacccttgtgggttacgaccacaaaaaggaacgcataatgattgtgctctgtcttctccatacctctagctgcaggctaggcatcgaaaaccaatgaaatcaggcagctctcctcagcccagaaattaagatgtcggaatgttaacagagacccacagacggaacaacaacaacacttgttcattgttggaaagagaacactgcctttatgctccttggataaacaaacactgtgcgtctgtcaggtggtggtggcctggatgttgtaagtacacaatcaagcatcatctac

SEQ ID NO: 1052 - DNA, 274 bp, Homo sapiens
  CDS 13..273
attgtcctgcccatggcttcccatctcaggaccctctctggccgctatcatcccagcagtggagttcagcccactactctgaaccagccgcagtggctgcgatgggacggaagccatgaatggtgccggccctggccccgccgcagccgccccggtcccagtcccggtcccggtcccggactggcggcagttctkcrarctgcatgcgcaggcggccgccgtggactttrcgcacaagttctgccgtttcctgcgggacaacccagcttacgam

SEQ ID NO: 1053 - DNA, 515 bp, Homo sapiens
  CDS 171..515
agctgccgctgagccgccggacggacgctcgtcttcgcccgccatggccgagagcgactgggacacggtgacggtgctgcgcaagaagggccctacggccgcccaggcaaatccaagcaggctatcttagcggcacagagacgaggagaagatgtggagacttccaagaaatggcctgctggcagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagaccggacgggccatacccaataaccaggtgcttggcaaaatcgagcgggccattggctcaagctccggggaaaggacattggaaagcccatcgagaaggggcctagggcgaaatgaacacaaagcctcgaaatcagtgcgctcc

SEQ ID NO: 1054 - DNA, 457 bp, Homo sapiens
  CDS 268..456
aggttaggtttccttcacagtgtcctgatttggtctaagaccgcaagacctctcccagcctcaccctaaattggttctgagctggtctcaaaggggcccgccctgaccttaaaggtatatgggcaaaggtggtattcaaccaactcttaagtatttccgggttagacctcagtgggtacacttgctgaaggaccagttggctgctgaggctgcggcgcggctggaggccaggctcgtgtgcatcagcttttgctgcagaacaaggacatgctccagcacatctccctgctggtcaagcagktgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggscgggctt

SEQ ID NO: 1055 - DNA, 242 bp, Homo sapiens
  CDS 21..242
agggaagaggctgtcgggaaatggcggccgcggccgggctggggcttcagcgggaggcagcagaggggaagtggtcagcgtggcgaatgacggaagaaactcgcattgtctactggatcaaggacagacagctcaccaaccgtgacagcaccatactggaacttcaaaaagttctgaaaacatgttggttcgtttgttggagtatttttcaacttaaattccttttcctttttttttttttt

SEQ ID NO: 1056 - DNA, 486 bp, Homo sapiens
  CDS 98..484
gcttccgggtcgaagggcttgcttccggagagcgggaaggctaaaacgcggtastaaactgcagccaactttggttgtgtgtggaaaaggctttagcatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggtaatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagcccacagtata

SEQ ID NO: 1057 - DNA, 422 bp, Homo sapiens
  CDS 219..422
tkttctcattccctcgtctccaccgggaaggggagagcctgcgggtggtgtatcaggcaggttcccctacatctttggcacccaacacggtctcctcgaacccaggtgaagttacacctgagcgtggtcgttgtgaagaacggtctgtccaggaactcccgagaacgtgtggtcggccttgcggtaagcttgtgcactcggagcattccagggacaccatgggacaatccaaaagtaaacattctgcatatttacattttattaagctcctcttaaagagggcaggaattaaggctagcacagaaaatttgattactctgtttccaacagtagagcaatattgtccttggtttcctgaacatggtaccatggacttcaaagattgggaacaggtgggaattgccttaaaacaagtttgtaag

SEQ ID NO: 1058 - DNA, 450 bp, Homo sapiens
  CDS 59..448
ccacctgtgatgctcagagagaaaccatgagccctgaaaaacaccatattgttttgtgatgtcacctctggaatgttctgagtgttttggtgaccaacttctgcataggacctatacctggcaactcacattgcactcaaggccaaattatacaagaaaaagagataccagatctgaaagcctagaaattccaatcagtgtggttctacctcagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttcca

SEQ ID NO: 1059 - DNA, 567 bp, Homo sapiens
  CDS 366..566
ttttaaacagtgatgttttttattaacctatttcatccattcaaagacaggcctttctccacaccacattttcctctaaaatcatgataacacttttaaattgatggtgtcttccagtgtgtatcagccagatggcagtgtgttacagttccaggaaaactcgttcacatcttccgtaagatcaagaaggctctggcatcagataagatcaaatgttgtctttctgttttaaatatgtgccgcaaagagatttgcttacaatctattgagaaagctaaaacagagcagacattgtcctgttgcggggtagatgaatagcctaagaatagtttagacaaattctgaaaacgaatttaccttagaagatgttcatgttagatctggtaaaagtaacatgttatttttctgtcaagccctttttgtacttgccgtttattacatattttagatttattttttattttcgaaacatccaaaaaggaatgctaattagtgaaatggaagaatttccatttcaacaccttagggaaaaaaaaactgacttgacatacctaagaaaaggccaag

SEQ ID NO: 1060 - DNA, 452 bp, Homo sapiens
  CDS 13..450
  misc_feature 20: n=a, g, c or t
agtacggcaaatatggcggnkcttgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataat

SEQ ID NO: 1061 - DNA, 418 bp, Homo sapiens
  CDS 95..418
gggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtgccagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaac

SEQ ID NO: 1062 - DNA, 402 bp, Homo sapiens
  CDS 98..400
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggggctgataacatccggaaatactggagccgctactaccaaggatctcaaggggtaatatttgtattagacagtgcctcttcagaggatgatttagaagctgctagaaatga

SEQ ID NO: 1063 - DNA, 468 bp, Homo sapiens
  CDS 98..466
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgaagctgc

SEQ ID NO: 1064 - DNA, 557 bp, Homo sapiens
  CDS 100..555
gctgtawgctggctttttcaggagctgctcgctcgcagccagagacgctgctttttattttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtaca

SEQ ID NO: 1065 - DNA, 486 bp, Homo sapiens
  CDS 145..486
acacccagttcccacgtgaacacgcggagtccagccttggagatgcagcttttgtcttgctgaaaccttccagttaaatttctccatcaatttttcaaatagtattattagctgagggactaaaatctgcctggcgttcttctgatgacaaaggaaacacagcacattcacaaacatctgaagccaactgcaaggcacccgtcactcagcgagaaaagcagaaaggtgccaattcagatggctgagctacttcgcctgggtcccgacctgtatcaccacagggtcacagaaatggaaccttctccgtcacacctcctgatggcagtcagctgtgacccgctgaatccaggacatcatgcattccagtttcatttgcgagaacatttccaggtccggctgaagcctagtggctccagcagaggtctcaacccctttggratgctcagtgggagacagaatcaagggccaatgatccatgacctagtc

SEQ ID NO: 1066 - DNA, 315 bp, Homo sapiens
  CDS 97..315
gctgktgctgctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattc

SEQ ID NO: 1067 - DNA, 483 bp, Homo sapiens
  CDS 98..481
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctccttcagc

SEQ ID NO: 1068 - DNA, 379 bp, Homo sapiens
  CDS 98..379
gctgtkgctggctttttcaggagctgctcgctcgcagccagagacgctgctttttttttccgggttcggagccgttccggatgctttaggctgccggatgtctgatctccgaataactgaggcgtttctgtacrkggattatctgtgttttagagcactttgctgcaagggaccaccacctgcacgaccagaatatgacctggtttgcataggcctcacaggttctggmaaaaccagtctgttgtccaadstctgcagtgaaagccccgataacgtcgtgtcgaccacaggttttagtattaaagcagtgccattccagaatgccatcttgaatgtaaaagaacttggaggggctgataacatccggaaatactggagc

SEQ ID NO: 1069 - DNA, 506 bp, Homo sapiens
  CDS 98..505
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatggcaactttacc

SEQ ID NO: 1070 - DNA, 493 bp, Homo sapiens
  CDS 98..493
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatcccacagtt

SEQ ID NO: 1071 - DNA, 529 bp, Homo sapiens
  CDS 362..529
aaacggcagcctcaaccgcctggcagcggcggtttcttctcttcgtgaaaatcgtgatctcatctctccgtccatgggcgaaaaaacagccatcaccaggccattcacgctttgtgcttttgttaggagagcccaggcagccctgcagcccacatctagggtacaaacggaacggcggcgttttccttgtatcatttagaggaaatttttgagctgaacagtattttttttctccctctctctctctctgaaatattgctgagatttaaaggatgacgaagacaacagattcatagctgggtcttgctgttttcctgacgctgaccacagcggatctagtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgccaa

SEQ ID NO: 1072 - DNA, 396 bp, Homo sapiens
  CDS 180..395
  misc_feature 9: n=a, g, c or t
agcgadgtntcctcagagtggaggcgggattcttaggggagagctcctcagcaattggttacatttgacggctttagtccagggacccagacgctactggataaggggtgaaatttgaggtcatatcccgggagagaggaagaagtgtcgtgagtcaccgaacccgaagagaggaaaagatgtggaggcagcggtctatggcctcttccagctccggacgggggatggggacgctctgggcaatacgggcctcagttattgtcccactgtcctttcaacccttaaccaacccagttggaggccgcctggaagaatgtagccttggaactagggcctggaattggggctcctaccggttgtgtgggcttgggcagtcacttaaccttcccgcatgct

SEQ ID NO: 1073 - DNA, 327 bp, Homo sapiens
  CDS 118..327
aaaaaacggaaaggttcggaatttgcctctgcgccgtctttttttgcctgttacctgtgacgtccttgcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgtt

SEQ ID NO: 1074 - DNA, 564 bp, Homo sapiens
  CDS 140..562
agttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggc

SEQ ID NO: 1075 - DNA, 492 bp, Homo sapiens
  CDS 239..490
agacgattggtcgggccacgccagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgagaaagtcatgagaaggagcg

SEQ ID NO: 1076 - DNA, 480 bp, Homo sapiens
  CDS 96..479
aacccaagcgggagagcccggggatttgcggccgccgccatgccgtcgtccccgctgcggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggagg

SEQ ID NO: 1077 - DNA, 521 bp, Homo sapiens
  CDS 346..519
atcatttaagccttcgttggacacactttctgactggcagctgaacataagctcattgatgtcttcacagtctccagctgaggcacaccttggccagagggaatcttccagtcctcagacagggcttgcctttgactggcccctgctgcttatgcccttwgtgaatcacaagcggtacctcttagtgtactctgccttcactcctaaacgcatgtggcaggcatgtaatgctgctattaggcgcatgggctctggactcgaataggactgagttctaaccttggrtccaccacttactcatgcagaggtctcagctcttacaatgccagtgaacaccattgggagatgattagatgtcacctacaaggarragaagataatttatcattagatattgctaaactggaaaaacatgtttttgagacatctaaggttcatctcaccctgttgcctggagatgatattcttgctggagctgctgatggcctttctaataccaatcctttaaagtggattaaaac

SEQ ID NO: 1078 - DNA, 480 bp, Homo sapiens
  CDS 250..480
atatagctctctctaacctgggattcctgggctcaagcagtcctcttgccttagtctcctaagtggctaggaaggactacgggcctgtcccaccacacctggctaattttttcatttttgtgtgtgggcgtgggggcagtcttgccaggctggtctggaactcctggcctcaagtgatcctcctccgtcaagatatgaacaggagtacagctgtgtagtaaagatgccttctggtgaatttgcacgtatatgccgagatctcagccatattggagatgctgttgtaatttcctgtgcaaaagacggakgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttcttttacaaaagccactccactctcttcaac

SEQ ID NO: 1079 - DNA, 538 bp, Homo sapiens
  CDS 308..538
atgatcagtagctgcaccactagaaagatggcggasaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcattttccaggagatctcatggttctt

SEQ ID NO: 1080 - DNA, 509 bp, Homo sapiens
  CDS 286..507
atactccaggcgggccggggcgcgtcaatatggcggcgcagggctcaccctcgagctctccgtcagacgactctaccacctcggggtctctgccagaactgccgccgacctccaccgcgacttcgaggtcgcccccagagtcggaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaagaatacaaactggcccttttacaatgctatggaagatatcttcagcagttcaatac

SEQ ID NO: 1081 - DNA, 444 bp, Homo sapiens
  CDS 262..444
aaatagtctccatcggccattttgtgcgagawgccgcagcgccgcctcttctctcgcgccctcgcctcttcctccgcctcctccttcgcctcttcctgcctcctcccggcttccgccgccgccactccagcctaatcccaaccccagggcgaasgttttcttatttatttccgttttctcgccactacagcctcctgacaaggtgatccgggcgggccccgcaggaattttatcccctcaccggcctcacactagtatcgcatgtccactatccagaacctccaatctttcggtaagatcccgtcgccgccgcctccctcccttgcccggcgcgcatctcggccttttgcccgcctggccaccgcccctaggggccccctttctgcccttcccgcacccctagtgggggctttgtctcggcgcccagaaaatggcgacggggcc

SEQ ID NO: 1082 - DNA, 480 bp, Homo sapiens
  CDS 131..478
acaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatcta

SEQ ID NO: 1083 - DNA, 490 bp, Homo sapiens
  CDS 216..488
actgcggtccggtcctggcgcccgcgcagaaccagctgtctgagctgcccrggcrgcgggggagcagcgagcgggcttcmgcgagccgsagaggcacaggcctgtccygggtcccsgcagtctgcgcgtctgttgttcccagcgctctksgaggcctrmaaaggargagcaacctgtccagamtcccygcagacaggaaaargagaaatctcgacatggaaaaaccctacaataaaaatgaaggaaacctggaaaacgagggaaagccagaagatgaagtagagcctgatgatgaaggaaagtcagacgaggaagaaaagccagacgyggaggggaagacagaatgcgarggaaagmgaraggmtgagggagagccaggtgatgagggacaactggaagatragggaagccaggaaaagcagggcaggtccgaagtgagggcaagccacaaggcgagggcaagccagcctcccaggcaaagcagagagcc

SEQ ID NO: 1084 - DNA, 418 bp, Homo sapiens
  CDS 193..417
agaatcagctgtctgagctgcccaggcggcgggggagcagcgagcgggcttcagcggccgcaggaggcacaggcctgtcctgggtccccgcaggtctgcgcgtctgttgttcccagcgctctgagaggcctgaaaaggaagagcaacctgtccagaatccccgcagaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaaaaaaaaaaaaaa

SEQ ID NO: 1085 - DNA, 491 bp, Homo sapiens
  CDS 189..491
agaatcagctgtctgagctgcccaggcggcgggggagcagcgagcgggcttcagcgagccgcagaggcacaggcctgtcctgggtccccgcagtctgcgcgtctgttgttcccagcgctcttggaggcctgcaaaggaagagcaacctgtccagactccccgcagacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgarggaaagcgaaaggctgagggagagccaggtgatgagggacaactggaagataagggaagccaggaaaagcagggcargtccgaagtgagggcaagccacaaggcgagggcaagccagcctcccaggcaaagcagagggccagccgcgggccgccgaaaagcgcccggc

SEQ ID NO: 1086 - DNA, 415 bp, Homo sapiens
  CDS 192..413
agaatcagctgtctgagctgcccaggcggcgggggagcagcgagcgggcttcagcgagccgcagaggcacaggcctgtcctgggtccccgcagtctgcgcgtctgttgttcccagcgctctgagaggcctgaaaaggaagagcaacctgtccagaatccccgcagaaaggaaaagraggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcggcaaaggcaaaaggagaaggaaa

SEQ ID NO: 1087 - DNA, 482 bp, Homo sapiens
  CDS 211..480
cctaatcgaaaaagatgtaggcaccggtccgagtgcctgccctctgtccccgcggctgggtctcgtctgctccggttcctgggctcctaattcttggtccagcttcttccaggtctgcgcgtctgttgttcccagcgctctgcgaasctgaaaaggaggagcaacctgtccagaatccccgcagacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagaga

SEQ ID NO: 1088 - DNA, 254 bp, Homo sapiens
  CDS 69..254
aaagataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcctgscgcccgktkggatttcgctgagcggcacgkctacatcttgaaggctggccggkcgtaccacaaatataaggcaaagaggaactgctggccacgagtacgg

SEQ ID NO: 1089 - DNA, 582 bp, Homo sapiens
  CDS 153..581
aaaaaccctataaaggcgtcgatcggccggacaggcggcagcggcggctcctgcagcggtggtcggctgttgggtgtggagtttcccagcgcccctcgggtccgaccctttgagcgttctgctccggcgccactacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaatcc

SEQ ID NO: 1090 - DNA, 346 bp, Homo sapiens
  CDS 98..346
agtcggtctccagcggcgtccagattctgacaaagccagagaccgtggaccggagagaagtgcggaaacgaccaaagaggccgggcgaccactggagatggctgtgtccgagcccgaggccagcgccgcggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaaaaaaaaaaaaag

SEQ ID NO: 1091 - DNA, 625 bp, Homo sapiens
  CDS 344..625
agttattttcgcctgccatagtgtacaccagtcttgaaacttgttactgtcgtagagcaaccaaaaatttgagaataccgaattgtattccctacccgtccccaggatgtcccattttgaaaatatggagccctgcgattctggattggctcataagaatgttaaatctaaaaagactgatcgtatccgtcatgcacctaatcacctgagacttttacctttacccagaaaggaataaaagaggtcagatgatgacagctgtgtccttaacaaccaggccccaggaagtcagtggcttttgaggaacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacagg

SEQ ID NO: 1092 - DNA, 484 bp, Homo sapiens
  CDS 252..482
atttttaggggcggggcgagcttgcctgccagaagctcctctcccagcctgcgagcatttccaggctcttgtttcccatcagcctctgggtccaaactaaccacaggtctctgggtccttttccggtgtccttaaggttcttggactctgcctgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgtt

SEQ ID NO: 1093 - DNA, 495 bp, Homo sapiens
  CDS 221..493
tggatcggcgagtggcgcccaccatctctgcttgctgaaaastgcagaggccgccagagcccacgcacctgagacttttacctttacccagaaaggaataaaagaggtcagatgatgacagctgtgtccttaacaaccaggccccaggaacttgtcgtttcaggaatcagtggcttttgaggacgtggctgtgtacttcactacgaaggaatgggccatcatggtgcctgccgagagggccttgtacarggatgtgatgctggagaactatgargctgtggcctttgtagtgccacccacttccaaaccagctttggtctctcatctkgagcaagggaaaragtcctgtttcacccagccacagggagtcctaagcaggaatgactkgagagcaggctggataggatacttggaactaagaagatatacttacttagctaaagcagtgttacgtagaatagtatcaaaaatttttcgaaatcgtcaatgctggga

SEQ ID NO: 1094 - DNA, 513 bp, Homo sapiens
  CDS 141..512
tttttgtcgcgcgaggttttggtttgtraggatcggcgagtggcgcccaccatctctgcttgctgaaaagctgcagaggccgccagagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctggggaagac

SEQ ID NO: 1095 - DNA, 519 bp, Homo sapiens
  CDS 337..519
acttaacaaggtggtttgagccaagtatgtgtcttgcgggtctttgcgaaagtgaaccagttattaggggcgcctaacgacctggggggtcaactaaggggccaaatactaccaggaacatatctgtaaccagagacgattgtagatttctgcagcaaggaagcccacattccatggtgatcatggggtgacttgactgtggcacgtttcaggcaggattcctccttcattcaaactgcatcacccaggagtctgcaaattccccaaagtaggaggaaaaatgaccacattcaagattaccaagactgtgggaatacttataacctgctcttggtcatgataaagagaagcaaagtacttgtattctgttcaaagattatggaggaggcagtgaccttcaaggatgtggctgtggtcttcactgaggaggagctggggctgctggaccctgcccagaggaagctgtaccgagatgtgatgctggagaacttcaggaacctgctctcagtggggcatcaa

SEQ ID NO: 1096 - DNA, 439 bp, Homo sapiens
  CDS 56..439
  misc_feature 53: n=a, g, c or t
actttcctttccgctcggctgttttcctgcgcaggagccgcaggccgtagagnccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccmcgmkcacacmrygtcarrgkychawscggmccatmktgmggwgccccacggttcggtaccamacgaaggtgcgckccggcmgcggcttcagcctggaggagctcagggtggccggcattcacaagaaggtggcccggaccatcggcatttctgtggatccgaggaggcggaacaagtccacggagtccctgcargccaacgtgcagcggctgaargagtascgctccaaactcatcctcttc

SEQ ID NO: 1097 - DNA, 550 bp, Homo sapiens
  CDS 190..549
acggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagct

SEQ ID NO: 1098 - DNA, 517 bp, Homo sapiens
  CDS 272..517
aaacttgttcgggtatccttccccagtgtggaagctttagttcttttgctctttgcaatgaatcttgctgctgctcactctttgggtccacgctgcgtttacactgtgtttatgagctgtaacactcaccacaaaggtctgcagcttcactcctgaagccagcaaagaccacgaacccaccaggaagaaggaacaactccagacacgcagccttaagagctgtaacactcactgccaaggtcttcagcttcactcctgagccagccagaccatgaacccaccagaaggaaaaaactcggaacacatcccaacatcagaaggaacaaactctggacatgccgcctttaagaactgtaacaacgcaagggtccgcggctttattcttgaagtcagtaagaccaagaacccaattccggacacgtttggacccagatggaaaggcagctcaacatctgagaagccagtcttactccctgcaggcaacagctgcttccagaaaacagccctattacttcac

SEQ ID NO: 1099 - DNA, 485 bp, Homo sapiens
  CDS 104..484
tccgcccccgcgcgtagtcggcgccaaaatcaaacgcgtcctggcctgtcccgcccctctccccaagcgcgggcccggccagcggaasccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacgataaaactatctggaatgcaggaagagcgaa

SEQ ID NO: 1100 - DNA, 465 bp, Homo sapiens
  CDS 191..463
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtaaacagattctcctctgtgctgtgtggacattgccatcccatgcaacaacaagggagctcactcagtgggtttgatgtggtagatgccggctcgggaagttttgcgcatsgtgacaccatttcccatgaacacccctgggaggtcatgcctcagctctgcttctacagagatcctgaagagattgaaaaagaagagcaggctgctgctgaaaaggcagtgaccaaggaggaatttcagggtgaatg

SEQ ID NO: 1101 - DNA, 482 bp, Homo sapiens
  CDS 303..482
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtamacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattgaaaaagaagagcaggctgctgctgaaaaggcagtgaccaaggaggaatttcagggtgaatggactgctccagctcct

SEQ ID NO: 1102 - DNA, 235 bp, Homo sapiens
  CDS 10..234
ctttctagcatgttgccctttttcaaccacatttgtgtttcaggtgtagagaggagagagagtgaacagggagcgggtcttttgtctgtttattamccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactc

SEQ ID NO: 1103 - DNA, 251 bp, Homo sapiens
  CDS 84..251
mttttttttycgktsywacytgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggag

SEQ ID NO: 1104 - DNA, 487 bp, Homo sapiens
  CDS 69..485
  misc_feature 371..372,456: n=a, g, c or t
acccccagcccggccagaacggcccccgggacagagcgacgsgaaccccgggcgcctgggtccccagcatgatcctcggcagcctgagccgggcagggccctgctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggaccttgctcaagaccaagcggcccgtcatttcctgtaatatctgtcaaatccgcttcaattctcagagccaggctgaggcgcactacaaaggtaatcgccacgcccgacgagtnnaaggcattgaggctgccaagaccagaggcagggagcctggcgtccgagaacctggagatccagctcccccaggcagcaccccancaaatggggatggtgtagcaccccgtccagg

SEQ ID NO: 1105 - DNA, 514 bp, Homo sapiens
  CDS 191..514
  misc_feature 363: n=a, g, c or t
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtasacagattctcctctgtgctgtgtggacattgccatcccatgcrrcaacaagggagctcactcagtgggtttgatgtggtagatgccggctcgggaagtttttgcgcatgcgtgacaccatttcccatgaacacccctgggangtcatgcctcagctctgctktctacagagatcctgaagagattgaaaaagaagagcaggctgctgctgaaaaggcagtgaccaaggaggaatttcagggtgaatggactgctccagctcctgagttcactgctactcagcctgaggttaca

SEQ ID NO: 1106 - DNA, 493 bp, Homo sapiens
  CDS 303..491
atatatatcctcctggaatactggccagagggcatgctgaagtttgctgctgccactggagccactccaattgctgaccgctttactcctggaaccttcactaactagatccaggcagccttcccggagccaccgcttcttgtgcttactgaacccagggctgaccaccagcctctcacggaggcatcttatgttaacctacctaccattgctctgtgtamacagattctcctctgtgctgtgtggacattgccatcccatgcaacaacaagggagctcactcagtgggtttgatgtggtagatgccggctcgggaagttttgcgcatgcgtgacaccatttcccatgaacacccctgggaggtcatgcctcagctctgcttctacagagatcctgaagagattgaaaaagaagagcaggctgctgctgaaaaggcagtgaccaaggaggaatttcagggtgaatggactgctccagctcctgaagttcactg

SEQ ID NO: 1107 - DNA, 492 bp, Homo sapiens
  CDS 117..491
  misc_feature 13: n=a, g, c or t
aggatgcgcgcgndcttccgcccagcgaagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaaga

SEQ ID NO: 1108 - DNA, 526 bp, Homo sapiens
  CDS 341..526
  misc_feature 338: n=a, g, c or t
gcgaagtcaaactgttgctgtttgctgatgatgtaatcatvbacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctchnggatgggtagaatcaatattgtgaaaatgaccatactgcgaaaagcaatccacagattcaatgcaattcccaccaaaacaccaccatcattcttcacagaactagaaaaaacaatcctaaaattcatgtggaaccaaaaaagagtctgcatagccaaaacaagactaagcaaaaaaaaaaaaaattgg

SEQ ID NO: 1109 - DNA, 484 bp, Homo sapiens
  CDS 207..482
gaggccagctgttacaacggacatgaagatgtgtgattattttcagtaggcagacatctaataaattcaagatggaggcgctttcctactgattatgcttccacctcagaagatgaatttggatcaaaccgtaattcccctaaacatacccgtctacgtacttctccagccctgaaaaccactcgcttgcagasgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaaksactgctgccaccaccccctggctctgcatagacactagaaagagttggttgatcgtgtttttgatgaaagcctcaacttccgaaag

SEQ ID NO: 1110 - DNA, 523 bp, Homo sapiens
  CDS 341..523
gcgaagtcaaactgttgctgtttgctgatgatgtaatcatrtacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagattcaatgcaattcccaccaaaacaccaccatcattcttcacagaactagaaaaaacaatcctaaaattcatgtggaaccaaaaaagagtctgcatagccaaaacaagactaagcaaaaaaaaaaaaaaw

SEQ ID NO: 1111 - DNA, 351 bp, Homo sapiens
  CDS 137..349
tttagggaaatgataattatttaaatttctttggtctcatttccagagacctgtccttttcctggtctcctcattcagcctccatatgatcctgttgtgaacatcaagtttcctggytacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctctttcctgtwacacaagccacagaagccaggagcaaatgt

SEQ ID NO: 1112 - DNA, 257 bp, Homo sapiens
  CDS 96..257
cttagttatagctttagaggaagtcttgaaatttggtagtaagtcttccagttttgttattttaacaaatttctctaggctgggcatggtggctcatgcctataattcccagshactttaggagccccagacaggaggatcacttgagcgcagaagatcaagaccagcctgggaaatatggcaagaccttatctctacaaaaaaatttagaaattggctgggcatggtggcacccatytgtagtcctaactgctcar

SEQ ID NO: 1113 - DNA, 484 bp, Homo sapiens
  CDS 96..482
gcggcgggaatcatggctgctcgcagastctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatct

SEQ ID NO: 1114 - DNA, 331 bp, Homo sapiens
  CDS 116..331
  misc_feature 114,144,319,324: n=a, g, c or t
ggaagtggccggtcagcgtcgckccggtctccgsggagaggactctggagtttgggcggsccgggcggccactaggtactctgatattccgtactaaacacgtctgcaagtcwngatgtcgcacccgtccccccaagccaagsnctccaascccagtaaccctcgagtcttctttgacgtggacatcggaggggagcgagttggtcgamttgtcttagaatttgtttgcagatatcgtacccaaaactgcggaaaattttcgtgcactgtgtacaggagaaaaaggcattggacacacgactggggaaacctctscatnttcanaaggatg

SEQ ID NO: 1115 - DNA, 261 bp, Homo sapiens
  CDS 10..261
gactcggccatgskrsgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgscagaccgtgcgcgccctyargatggagttcgtgtccgaggtgcagaggaargtgcacgar

SEQ ID NO: 1116 - DNA, 367 bp, Homo sapiens
  CDS 204..365
  misc_feature 14,100: n=a, g, c or t
aacagcgggacssnasmttggagaccagcagcagggagctccaagccgcggagtatttggaaaagcatcagatcaaggaggtggttagctaccdmaccancgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaa

SEQ ID NO: 1117 - DNA, 523 bp, Homo sapiens
  CDS 341..523
  misc_feature 41: n=a, g, c or t
gcgaagtcaaactgttgctgtttgctgatgatgtaatcatntacctagaaaaccctaaagactcctccaaaaagctgctagaactgataaatgaatttagcaaagtttcaggatacaaaattcatgtaaacaaatcagtagctctgctataaaccaacagcaaccaagctgagaatcaaatcaataactcaaccccttttataatagctgcaaaaaatatatatactcagaaatatacctaatcaaggaggtgaaagccctctgcaaggaaaactacaaaacactgctgaaagaaatcatagatgacacaaacaaatggaaacacatcgcatgctcatggatgggtagaatcaatattgtgaaaatgaccatactgcgaaaagcaatccacagatdcaatgcaattcccaccaaaacaccaccatcattcttcacagaactagaaaaaacaatcctaaaattcatgtggaaccaaaaaagattctgcatagccaaaacaagactaagcaaaaaaaaaaaaaaw

SEQ ID NO: 1118 - DNA, 406 bp, Homo sapiens
  CDS 218..406
ttgtttctcgccagatagaattaagttgggggaatgaaagaatgctccagtgtggcgtagtttttaagagtcaagaacatttttgagttatctgtagcttgtggcaatactcctgtaaacaaaattttagagcatatttctctctatctgatttctccagaatttggaaactatttccagaactcactctgacttatactaagatatcagccccaagatgaggaagccgaagctgaaagcaatgattccatggtctgaaaggctatgcagtcctctgacaagtaattcctgtaacctcattctttcccttccccctctcctgatggccccctctccaggaataaacagaggtcccccattcctgggttttctcatgtttctctctccaaaaaaaaaaaaaaaaagg

SEQ ID NO: 1119 - DNA, 248 bp, Homo sapiens
  CDS 37..246
gggaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaa

SEQ ID NO: 1120 - DNA, 616 bp, Homo sapiens
  CDS 163..615
aatacatagttctataataaatcatacctttaacatgttttcttatacagaatacagcaataacctccaagaggacatttattcagagacctcrggacacttcagagatactctcatgaacttggtccaggggacagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgagg

SEQ ID NO: 1121 - DNA, 284 bp, Homo sapiens
  CDS 116..283
  misc_feature 100,218: n=a, g, c or t
aaaaaacgcgccaagttcccctcggtggcggagtgctaaagaccctagcggttcaggcgttcggcgarcggggccgctgcttgttgcgmkcctggmtctnhygrggcgggcgcagatgggcgccgctcccgggatrtaktyggtgttggtgcaaracgggagcgagcggcggtcggggttcccgctcttgggagcggmtggtcactcccccgcggganwgvcgagccgaccagattttcctggggccggggacccggmrggctcggggcagggactcacctgtc

SEQ ID NO: 1122 - DNA, 559 bp, Homo sapiens
  CDS 386..559
  misc_feature 117: n=a, g, c or t
tttacggcgccgtaaagcagctcggssgagcagactgctgcggttcctgggtggcggcggcatggaggcgcgcttcacgcsgggaagtcggcgctgctggagcgcgcgctggcssgnccgcgcaccgaggtgagcctgagcgccttcgcactgctgttctccgagctggtacasactgccagarccgcgtcttctccgtrgccgagctgcagtcgcrcctrgmcgcgctgggccgccaggtgggcgcgcgcgtrctgggcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcrcaccttctacatcatcgagcrcgaccgctcatcaacacctacatctccgtrcccaaggagaacagcacgctcaactgcrccasttcacggcgggcatcgtggaggcggtgctcacacacagcggcttcccctgccaargtcacggcgcactggcacaagggcac

SEQ ID NO: 1123 - DNA, 399 bp, Homo sapiens
  CDS 69..398
agcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaac

SEQ ID NO: 1124 - DNA, 551 bp, Homo sapiens
  CDS 324..551
cctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgattgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagcttta

SEQ ID NO: 1125 - DNA, 484 bp, Homo sapiens
  CDS 179..484
aacctaaaatgaaaaccatgtgttgtggagaaataagaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtttcattctaactgtcacaatattcagacaaatgatacagctaagacaacattccaagaatatccacttatcaaaaact

SEQ ID NO: 1126 - DNA, 533 bp, Homo sapiens
  CDS 381..533
caatatatgtaaatcaataagtgtgattcactaaataaacagaattaaaaacaaaaaccatatggtcatctcaatagacatggaaaatactctcaataaaatccagcatcccttcatgataaaaaccctcaaagaaatgaggcattgaagaaacatacctcgcaataataagagccatcaatgacaaaccgacagccaacatcatactgaatgggcaaaaactggaagcattccccttgagaactggaacaagaaaaggaagcccacttggccattcctattcaacatagtattggaagtactagccagagctatcaggcaagagaaagaaataaaaggcatccaaataagaaaaagaaaaagtcaaattatctctcctcatggatgatataatcctatacctagaaaaccctatagactctgccaaaagcctccaggaactaataaatgacatcaataaagtttcaggatacaaaatccatgtacaaaaaccagtggcatttctatacgtcaataacattcaagatgaaagc

SEQ ID NO: 1127 - DNA, 223 bp, Homo sapiens
  CDS 65..223
agccgccgcagtcgctgcgccccgagcccctctccggctcctcaacagakggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggcggcggcgag

SEQ ID NO: 1128 - DNA, 502 bp, Homo sapiens
  CDS 316..501
agacgcakatggccctcgccggccgccatcyccgaaactygcgagtgtcgcgtctgcagtgtgtggggttcrcggggcggcgggtagaggcgagtgtttagagacttcgggtccctgactcgcctccagcagtgragacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattct

SEQ ID NO: 1129 - DNA, 427 bp, Homo sapiens
  CDS 214..426
tactgcgaggagccggcgcagggtggcccgggaggggtgagcagggtgccgctggctgctggggtctgcaggtcascgagtccccaggagaggggactcctaagaagccacctgcctgtgtttacccggcagcgagcgcgcaggcccccgcgaactcctggcagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgtkcctgddcccaacctcaacgaggtaatatttgaggaatcaacttgccagaatttggttaaaatgctggagaactgtctgtccaaatcaaagcaaacta

SEQ ID NO: 1130 - DNA, 258 bp, Homo sapiens
  CDS 52..258
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgyatcgccccgcgccccgcgtcgggtcccatccggcccatcgtgcgctgbcccacggttcggtaccacacgaar

SEQ ID NO: 1131 - DNA, 471 bp, Homo sapiens
  CDS 99..470
gctaggaagaggccgcgtggggcgaaggcggcgcttggctggtgggggccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagatttgactccaacaacgtggtcctcattgaggacaacgggaaccctgtggggacacgaattaagacacccatcccca

SEQ ID NO: 1132 - DNA, 528 bp, Homo sapiens
  CDS 270..527
aagaatatggttagtaaaggagaagtagtgagagtagggagaaaagagcaactactgaagcaactatcaagtagtttttccttccttcttttattttccatggcagtaggaagacatttaatactgtaaatcagtgcatgcctagcgggttacatctgctcttaagtaagtcacagccagagtagatagtgacttaaaggttgctaataggaagcagaagatccagaagccagactgagagatgtcgatgtcttcatagagaaactctaatggatcctgtttacaccactcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaaataaggtgactttaa

SEQ ID NO: 1133 - DNA, 349 bp, Homo sapiens
  CDS 178..348
  misc_feature 339: n=a, g, c or t
aatcagaaggccagcctgcgcctggaggsggtggcgggaagtgcactaggtttgaaatcggaaagttggcggggctgcgggastgagcctagagtccggctgttggctagagtgggcgcggatctggtttggggaaggcggcgggactcaggcctgcctgcgavrttgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagangaacgaatgg

SEQ ID NO: 1134 - DNA, 506 bp, Homo sapiens
  CDS 191..505
agtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaa

SEQ ID NO: 1135 - DNA, 564 bp, Homo sapiens
  CDS 157..564
attctttcgacaggagttgaaaccagcaccttccctttctctgagtcctgcctccttctgcagaagggagctcaaaagaactttgttgttttgccttttactctggggtgaaagcggcaggaggtatgtgagatggtgaaatgatttgcttctgccatgctggggtcacgggtggatcgccctaaactctcggtggccccctcagtagttttggaagaggaccaagtccttgtctctccagcagtggacctggaagaaggatgccggctcagggacttcactgagaaaataatgaatgtcaaaggaaaagtaattctgtcaatgctggttgtctcaactgtgatcattgtgttttgggaatttatcaacagcacagaaggctctttcttgtggatatatcactcaaaaaacccagaagttgatgacagcagtgctcagaagggctggtggtttctgagctggtttaacaatgggatccacaattatcaacaaggggaakaagacatagacaaagaaaaagtaagagaggagaccaaaggmaggaaaatgacacaacagagcttc

SEQ ID NO: 1136 - DNA, 522 bp, Homo sapiens
  CDS 296..520
aattattccaggtacctggttaacacaaccaaaattcctggcagctctacacatcaaatgcatttgtctcaagcagtagccacctccagtctgatacaaaggattactccctccccagtgccagctggagccccatcatggtgaggctctacaatgagttcatggagaagactgtggatgggtcatggacaagacttccaggttgtwggtgctctgtgcaattccttaaagaagcagaccttactaagattgctaaagctgtccctgccatcttcttacaaatgaagtgacgcagatgcaaggtgctgcaaggcccacctcctcctgctctgacaggcagacaggaaaccaaagcccctatctgagcagcctctgtctctcccattcacctccagcttcccatgtggacctttgccttttccttcttggatggtggaaactcctccagatgtcaagacttgctgtgaataaagttttaagaggaggtcatgtatccaaactaaaaaaaaaaaaaaatgsgaa

SEQ ID NO: 1137 - DNA, 524 bp, Homo sapiens
  CDS 93..524
atttggtgacgggtgaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtcttt

SEQ ID NO: 1138 - DNA, 356 bp, Homo sapiens
  CDS 42..356
  misc_feature 281: n=a, g, c or t
gtggagaccacgtacttctgcaacacgtgcggacagcccctatgcgcgcgctgccgsacgagacgcaccgagcacgcatgttcgcgcgccacgacatcgtggccctgggtcagcgaagcgcgacgtgccccagaagtgcagccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcaganaggaaagcgctgctgctgcaggctgtgcagagccaatacgaagagaaggacaaggccttcaaggagcagctctct

SEQ ID NO: 1139 - DNA, 609 bp, Homo sapiens
  CDS 322..609
  misc_feature 348: n=a, g, c or t
attggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttacchnratatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgag

SEQ ID NO: 1140 - DNA, 479 bp, Homo sapiens
  CDS 203..478
agcccccgtagctgtgggtcaaaagtgccggtcaaaatggaagtgaatccccctaaacaggagcacctgctggcgctaaaaggtcctgtttccctctgatttggcaagagagacaatcttgcaataatraattaacattctagctctgaggagttcaactaagaaattttctcatcactaagrgtaactggattactgcagaatgactacagaagtaatattacattatcgaccatgtgagagtgatcccacacaactgccaaaaattgcagaaaaagcaattcaagactttcctactcgtccgctatcaagatttataccttggtttccatatgatgggtccaagcttccactcagacctaaaagatcaccacctgtgatttctgaagaggcagctgaagatgtgaaacagtacttaaccatttcagaacatgatgctaagtcacacagttatgattgcacagtagatctattggagt

SEQ ID NO: 1141 - DNA, 494 bp, Homo sapiens
  CDS 283..492
gactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgag

SEQ ID NO: 1142 - DNA, 393 bp, Homo sapiens
  CDS 36..392
agaaggctgggagggctgcgcgggctgcsgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaakkacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgmgcacatttactacgtgtgcacagccccacactgcg

SEQ ID NO: 1143 - DNA, 510 bp, Homo sapiens
  CDS 66..509
aaaaaagtgctgcagccgcttgctccggccggcaccctaggccggcccgccgccagctgtcggacatggaacccttggccagcaacatccaggtcctgctgcaggcggccgagttcctggagcgccgtragagagaggccgagcatggttatgcgtccctgtrcccgcatcgcagtccaggccccatccacaggaggaagaagcgacccccccaggctcctggcgcgcaggacagcgggcggtcagtgcacaatgaactggagahgcgcaggagggcccagttgaagcggtgcctggagcggctgaagcagcagatgcccctgggggccgactgtgcccggtacaccacgctgagcctgctgcgccgtgccaggatgcacatccaggcctcctgttatgggcagtctatcctggtgccacctgggaggcagctccagggacaggaggggaaargactgakaagacgccartcactgggtcctcccagggctcctgctgctgctggggctg

SEQ ID NO: 1144 - DNA, 468 bp, Homo sapiens
  CDS 94..468
aagcaacgggatgccttggaaagcatcgttctgcagcaggactgctcaaccggccaatcagaacacagggaaccatgaaagagaggatagtgcatgcccagcatgagactcgcttccatcgcgacacagaggacagcatggagcccagctcgagtgccgtccccccaccatgacagcgcacatgggccttccaagccacagagccacagggaagccagtcctcctggaccgtgtgtggctgttttggagccagttgtgtcctgtgaagagcgcaggcccgcaggtgaggcaggagtgaagatggaggaggcggccatctctctggggcctggcaacagcgagagcttttgccaagccactgtctcccggagacaagatctccttcccaaaagcaagatggccaagagtatggagaagaaagtaggtaatacaagtttgctcagaataaacctatgtgttcatgaaaat

SEQ ID NO: 1145 - DNA, 239 bp, Homo sapiens
  CDS 71..238
agatgtgtggtttgcaaatattttctcaatgggtgattcttgatcagttttttaagctttgaagttaattatgggaatattgaatttcaatattgagtgtgtattgggtaatagtattgaatacagtaatggcgttgtggttacaaaaaacgcccttgttcttaagagcgatatattgaaatatttaggggtgaggtgttatgatatttgtgggttactttcttctttttttttttttt

SEQ ID NO: 1146 - DNA, 343 bp, Homo sapiens
  CDS 27..341
aataaccataccctgttagactaagcatggtccacccgcgaatcctctacagagatggccaagcgctggggtcgtggctgcgtcctctaggccagccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtggaaaggttctctgtcctttgcagtcaccaaa

SEQ ID NO: 1147 - DNA, 528 bp, Homo sapiens
  CDS 265..528
aatctcatttatgggggtgcaaaaaacaaagcacttcaggtcagggagaatgtataaatgtccattgccatcgaggttctgctatttttgagaagctgaagcaactccaaggacacagttcacagaaatttggttctcagccccaaaatactgattgaattggggacaattacaaggactctctggccaaaaacccttgaagaggccccgtgaaggagkcagtgaggagcttttgattgctgacctgtgtcgtaccaccccagaatgtcactgggggctgtgcagatgcctgggggggacctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgcgggaagcgatttgcgatg

SEQ ID NO: 1148 - DNA, 483 bp, Homo sapiens
  CDS 86..481
cttggaaggcggtgctctgagaagccggactacgcggcassctcttcaaagcggaccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatga

SEQ ID NO: 1149 - DNA, 505 bp, Homo sapiens
  CDS 39..503
agtagaggaaattgcggtagtgaccctcgggcctcgccatgaagagccgctttagcaccattgacctccgcgccgtactcgcggrrstgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgg

SEQ ID NO: 1150 - DNA, 518 bp, Homo sapiens
  CDS 218..517
  misc_feature 80: n=a, g, c or t
gatgattcacagaagctgggcttatagtcctaataaaggaaagtagagcgcctgccggaacctaccagaacccaccgtknccatacccacaaaaggagaagaaacttttcctgggaacctgctgactatacaaaggacaaaggcattatgtgtcaggccttgttcccttatctgagtgagctggagccagagtaagctttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagtctcctggtccccgagaagctctgagccggctccgagaactctgtcatcagtggctaaggccagaaatccacaccaaagagcaaatcttggagctgctggtgctggagcaattcctgactatcctgcctgaggagctcaggcctgggtgcgggg

SEQ ID NO: 1151 - DNA, 529 bp, Homo sapiens
  CDS 137..529
tgtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagt

SEQ ID NO: 1152 - DNA, 371 bp, Homo sapiens
  CDS 191..370
  misc_feature 362: n=a, g, c or t
atccttttagtggaagcaacgggagaagctttctgttgtcccacttcctttgaaacacaagaaaagagagtggtgaaagaasctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctcnagatatgtc

SEQ ID NO: 1153 - DNA, 452 bp, Homo sapiens
  CDS 136..450
gaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaa

SEQ ID NO: 1154 - DNA, 455 bp, Homo sapiens
  CDS 70..453
cttttgcaagagctgctaagagcgctggctcagactctgcggtggagctgtggaagchaggcgcacaggatgcaagcagccaggcccagggaggcagcagctgcatcctcagagagbhhgccaggatgccccactctgctggrggtactgcaggggtggggctggaggctgcagagcccacagccctgctcaccagggcatagcccccttcagaacccacaggtgtcctgtcaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgamcggcttcgagtcacggtgatgcttctggagacatctcggag

SEQ ID NO: 1155 - DNA, 459 bp, Homo sapiens
  CDS 253..459
  misc_feature 92: n=a, g, c or t
ctttctgtgtctcgccctcttgcagtctgcagcttctcctgtcatcggaaatgccaggccaaggtggctgccccctgcgttcctccatcbdnccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctatctccttccccagcacagccaatgaggagaacttccggagcaacctccgtgagtggcgcagatgctcaagtccaaacatggaggcactactgctgttcaacctctctgagcggagacctgacatcacgaagctc

SEQ ID NO: 1156 - DNA, 494 bp, Homo sapiens
  CDS 147..494
ataaacgatttttcttgttgcaggggattgcagtggcaaagctaggctaggtcttggaggctggtgtaaggcgatgtgggtgaaggcaggargctgatggaaagactggggggaagaaaagccgaaatggattcacggtgccttggatgaaggacgagaggggaactgcaagctccttcaactggttctgtccggtgagaagtgatcaagcttgggctgacaagakgctcagcgagcctcacgttctttcgcttttttacctgccaatcaaactgctacaagacaacaccctgatctggcatggacatcgcgggtccaagcctgtagccccaaatcggataatctctgcagctgataacaagcaaaagagaagccaggcaacagccatattaaagaagaaaacaatcaactctgagatccaacttagaaataaatgtttcattcaagataaggctcgtggcttaggagattgtgacctagcttgcatcattcta

SEQ ID NO: 1157 - DNA, 557 bp, Homo sapiens
  CDS 272..556
actgaatgcttatcaggaatattaataacattaaacgaaktgttctcttcccgtaagattcatttaggatgcatattgtcaaactcatatttgagattaccaagactaattactagaatcttctgaattttataatagaatagggattatctgataacagaaataaactgtagaaagttgtatttaacctttggagaagagatttagacagtaaactctaagaattaaacatccacaagtacaatatacattagcaaaatctcattctaaaatgggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatcacagtggaagctgtatctcaaaactcagaacgtttgga

SEQ ID NO: 1158 - DNA, 458 bp, Homo sapiens
  CDS 182..457
  misc_feature 16: n=a, g, c or t
ggaaggagtgcagcgnctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaacccagmttatccaaagagagaagcagaatcattatraatcccagtagcagtctgctggccagccaagatgagacawagcactgcttcatscaagctgctgacctcctcatggccgacttcaaagtgctcagtagtcaggacatcatgtgggccctgcackagctcaaaggacactatgcaatcaccc

SEQ ID NO: 1159 - DNA, 482 bp, Homo sapiens
  CDS 280..480
aaagggtagaatcaacctcctacaggaccacctacaggacccgagctggggaggggcggtggctttatgctgacaaaacaacagctgcccgttatcccctccccggtttagctccatcacaaccccacctccgtgtgcttaccggagtggccatgggctgtcttggaatgggcaggtgaaggattgaaggaaatgggtagcggtggaaatagcttacaagcccagagccagaagctggtaggcttgctggagggataaaagctcctagaatgtcgtaagatgaggagaagaaacagaggctcagcgagtgaggtcgcatacccgaggtcacccagcaagcagtattccaacccaattctccatccgaagctctcagcagcattccggaaacagcgccaggccccctggaggagccggtctgctgctggctgcggggctggaaggggcttgcggttccctagcctccctcagagctgctgggt

SEQ ID NO: 1160 - DNA, 536 bp, Homo sapiens
  CDS 323..535
attcgtttccccgcccctttcatgaccttcaccgggaggctgagstcggmgtcccgattttctcctgctgctgtggcccggacatggcgactcccggccctgtgattccggagtcccctttgaaccatcgaagccyccagtcattgaggggctgagcccactgtttacaggaatccasagagtttcaaggaaaagttcgttcgcaagacccgcgagaacccggtggtasccatagacagggtctcactctgctgcccaggctggagtacagagacgtgatcacagcacacggcgacctacctacacctcccgggctcaagctatgctcctgcctcagccttcccgagcagctggaactacaactacagctacatgccaccatgcctggctaatttttgtatgttttgtagagatggggtttcaccatgttgcccaggctccacagcatttgaaagagcatggagcccagagttgggaggcgtgggatcaagtcctagattwggtcagttcctggctgtgtgactctgggcaagata

SEQ ID NO: 1161 - DNA, 507 bp, Homo sapiens
  CDS 339..506
cttctttcgcgtctgsgtgctcggagtgtggtacttctcctagttgcagtcaggcttcatacgctattgtcctgcccgttagagcagccagcgggtacagaatggattttggaagagggagtcaccactggacctccaaggaagccacgtgcagacatcacaaccttcgatctcctgacgagtttattgttggccaaaaccaggctttgatttaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgtttagacttttgaaatttctaactg

SEQ ID NO: 1162 - DNA, 499 bp, Homo sapiens
  CDS 338..499
ctttcgcgtctgcggtgctcggggtgtggtacttctgctggttgcagtcaggcttcatacgctattgtcctgcccgttagagcagccagcgggtacagaatggattttggaagagggagtcaccactggacctccagggaagccacgtgcagacatctacaaccttcgatctcctgacgagtttattgttggcsaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttct

SEQ ID NO: 1163 - DNA, 488 bp, Homo sapiens
  CDS 338..487
ctttcgcgtctgcggtgctcggagtgtggtacttctcctagttgcagtcaggcttcatacgctattgtcctgcccgttagagcagccagcgggtacagaatggattttggaagagggagtcactactggacctccaaggaagccacgtgcagacatctacaaccttcgatctcctgacgagtttattgttggccaaaaccaggctttgattgaaccaggatgaatgcgggtgttggaagtagaatatatatatacatataadattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaaggctgtgccacttcaagaatgtcattgttagac

SEQ ID NO: 1164 - DNA, 491 bp, Homo sapiens
  CDS 342..491
ctttctttcgcgtctgcggtgcccggagtgtggtacttctcctagttgcagtcaggcttcatacgctattgtcctgcccgttagagcagccagcgtgtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataarattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagac

SEQ ID NO: 1165 - DNA, 476 bp, Homo sapiens
  CDS 299..475
ctttcgcgtctgcggttgctcggagtgtggtacttctcctagttgcagtcaggcttcatacgctgttgtcctgcscgtaagttcccgttttgtgtgtggttagagcagccagcgggtacagaatggattttggaagagggagtcaccactggacctccaaggaagccacgtgcagacatctacaaccttcgatctcctgacgagtttattgttgtccaaaaccaggctttgattgaaccaggatgaatgcgggtgttggaagtagaatatatatatacatataarattgaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaratttctaactgcctacctgcat

SEQ ID NO: 1166 - DNA, 488 bp, Homo sapiens
  CDS 339..488
cttttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagac

SEQ ID NO: 1167 - DNA, 492 bp, Homo sapiens
  CDS 337..492
ctttcgcgtctgsgtgctcggagtgtggtacttctcctagttgcagtcaggcttcatacgctattgtcctgcccgttagagcagccagcgggtacagaatggattttggaagagggagtcactactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaa

SEQ ID NO: 1168 - DNA, 322 bp, Homo sapiens
  CDS 118..321
agtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacactttttcgaggacttctgcgggagttgcgctacctgagcgcggccaccggcgaccctatcgcgacaccgcggcctatcggtaccttgtgaaggctttccgtgcacatcgggtcaccagtgaaaagttgtgcagagcccaacatgagcttcatttccaagctgccacctatctctgcc

SEQ ID NO: 1169 - DNA, 459 bp, Homo sapiens
  CDS 14..457
ggacgctctcaagatggcgacctctctgggttccaacacctacaacaggcagaactgggaggatgcggacttscccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaa

SEQ ID NO: 1170 - DNA, 519 bp, Homo sapiens
  CDS 353..517
agaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcct

SEQ ID NO: 1171 - DNA, 456 bp, Homo sapiens
  CDS 204..455
ctcttccagggcgggcggtgtggtgcacgcattgctgtgctccaactccctcagggcctgtgttgccgcactctgctgctatgagcttcctcaaaagtttcccgccgcctgggccagcggaggggctcctgcggcasaccagacactgaggctgtgctgaacgggaagggcctcggcactggtaccctttacatcgctgagagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatga

SEQ ID NO: 1172 - DNA, 564 bp, Homo sapiens
  CDS 151..564
ataacaaaacaatccaactatactgaataatacagaatcaaactgggatccaaaaacaatttaaaacaaagttggaaactcaaccgaaacaagaacaaatcgaatccgacatgaaacaagtctcacaagtgttcttaagctgacagaaagatggtcaaaaccaaacttaaaaccgtagtaatcgacataacggtcataccattcgccgacgattttttctgccctggagctccagccggcgtagagatatcaccagcggctgatggaccatctcctgaaggacccatcgccgagcctgacggagaatctgacggtgaagaagaagtagagcctcccggagccaacgatggagaaacggtgggtgagtttgaaacaggggatgaagatttaggtgccattgatccaggtggtgaagtcatcggagcagaagacggaggaatagttgaagatgatttaggtgccattggtgccggcggtgaagtcatcggagcagaggatggggaaacaggggacgtggatttaggtggtgccggtggtgaagtcgtcggagaaacaggggagctc

SEQ ID NO: 1173 - DNA, 469 bp, Homo sapiens
  CDS 23..469
tttcccggcagtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacaratgaggatgcagcaaccaccagcacctgtaccaactacaacaacaacaacacaacagcatcctagacaagcagcccctcagatg

SEQ ID NO: 1174 - DNA, 498 bp, Homo sapiens
  CDS 274..498
gctggctgctgcgtttgcggcgggaggtggtggccgcggtcccacgagagggggtatttttcgagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaasaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagraagggcagctcagattgctgaa

SEQ ID NO: 1175 - DNA, 505 bp, Homo sapiens
  CDS 191..505
aaaaaacgtgcacaaagatagactactgtgcctcatctaatcacggatgtcagcacgagtgtgttaacacagatgattcctattcctgccactgcctgaaaggtttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgca

SEQ ID NO: 1176 - DNA, 511 bp, Homo sapiens
  CDS 361..510
  misc_feature 352,377: n=a, g, c or t
akstctttcccatcttgcaagatggcgggtgaaaaagttgagaagyccagatakstaaagagaagaaacccgaagccaagaaggttgatgctggtggcaaggtgaaaaagggtaatcctcaaagtctaaaaagcccaagaaggggaagccccattgcagccgcaatccctgtccttgtcagaggaattggcaggtattcccgatctgccatgtattccagaaaggccatgtacaagaggaagtactcagccgctaaattscaaggttgaaaagaaaaagaaggagaaggttctcgcaactgttacaaaaccagttggtggtgacaagaacggcggtacscgggaggttaaanttcgcaaaatgsctagatattatcntactgaagatgtgcctcgaaagstgttgagccacggcaaaaaacccttcagtcagcacgtgagaaaaactgcgagccagcattacccccgggaccattctgatcatcctcactggacgccacagggggcaagag

SEQ ID NO: 1177 - DNA, 531 bp, Homo sapiens
  CDS 351..530
aagtctaagatgtcaaacaattgatgcacaaacttaatcaaggtataccaagacctctggcttcttcccagaaagctgctaaatatcagcaaggacatggctagagatcttgattctcgctttttttgatgtttctatgaaagaaccaagagagatttcttcagcagacagtgtttccaatgagtgaatttycttwaatamctccaaattcttcagggaaaacttccacccacacagcagtgatgactgctggtgctctgagggaattacggcacatagtaataaaagatgtatagaatttctacatcagcaacgtgaagtccagcccagcaccctagtatggagaacagatggagttccagaaggatgttcagctaaaagtaaaaacctacttgcttggaactgatttgtctatattcaaatatgatgatttcatctttgttttggatataatcagcaggttgatgcaagttggagaagaattttgtggtaacaagtctgaagttttacaggaatctattaraaaacaaa

SEQ ID NO: 1178 - DNA, 526 bp, Homo sapiens
  CDS 108..524
atagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagagcttctcagctcagccaaacggaagcaggaggtaaaaaactaaggagcactgtccaaagaagtacagaaacaggcctggccgtggaaatgaggaactggatgactcgacaggcaagccgagagtctacagatggtagcatgaacagctacagctc

SEQ ID NO: 1179 - DNA, 915 bp, Homo sapiens
  CDS 351..914
aggactgggcttatcgtggaaggagtggattgttcatttactgcattatcagtattcaagtaaatttgctgaagatgataactgtgacttaagccaagaaaggataaatttatttaccatttggctccagttgaaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaagcaggataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagaaacctagagaaagatgatgaactggaactgaaaagaagtcttttatgtagagactctgcctatgacagtgaccccgagtatagctcatgtcagc

SEQ ID NO: 1180 - DNA, 557 bp, Homo sapiens
  CDS 194..556
acaccactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctkcacc

SEQ ID NO: 1181 - DNA, 691 bp, Homo sapiens
  CDS 104..691
gattggtcgakcctgggccagcatggcggcgcccatgtaacccggtccgtgccgcaaagcgaacggcggccgcggcgcggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattac

SEQ ID NO: 1182 - DNA, 567 bp, Homo sapiens
  CDS 108..566
agatacccgatcctcggtcgcgcgggtcgcccccgccccgacctccccggctgacgcgctctgggctcggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgccc

SEQ ID NO: 1183 - DNA, 436 bp, Homo sapiens
  CDS 31..435
  misc_feature 126: n=a, g, c or t
gtttacctgctccccaggccggcacccaggatgggcgaggtggaggccccgggccgcttgtggctcgagagcccccctgggggagcgccccccatcttcctgccctcggacgggcaagccctggtnctgggcaggggacccctgacccaggttacggaccggaagtgctccagaactcaagtggagctggtcgcagatcctgagacccggacagtggcagtgaaacarctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcasccctctgggtgtccaagatgagaagagagatgctgagctgc

SEQ ID NO: 1184 - DNA, 486 bp, Homo sapiens
  CDS 334..486
agtgtctagtatagagctatgttacattgaatggcaaaagtgactttgtagagacttatttattctgtcttctgggaatatagcagacagttggcttagcaactctgagtgctgggctcaacagaagaacaagctgatakaagtccttgggctctgaggctccattctaatcaaagtacttctccaaccagaggacttccattgatcaatagccactcagatgttctgtgtttgccatgagtatcggacttcagtcttctggaaagatggctgtggtgcctaaacacatctgtgcctggcctcacccgcgggtgtcgtttatccggatgctgcatgattaagaccaccatactcttatcaagcatacaggtgttaatgtctattttaaagaggagagamctcaagaagttctgtagaaactgctttcttcatcatatctcaaaggatttgctgaggatttcagaggtgccacgagttkagagaagt

SEQ ID NO: 1185 - DNA, 599 bp, Homo sapiens
  CDS 75..599
aagtgggcgggtcgcgaggagcctgaggaagagggcggcgacggtggtggtgactgagcggasccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaa

SEQ ID NO: 1186 - DNA, 548 bp, Homo sapiens
  CDS 279..548
  misc_feature 440: n=a, g, c or t
aacttctctcgccaggcgtcctcgtggaagtgacatcgtctttaaaccctgcgtggcaatccctgacgcaccgcccgtggratkscccagggaagacagggcgacctgggaagtccaamkdadttyccktaagatcatcgtaagtgcaggcaactattggatgattatcccgaaaatgtttcattgtggggagcagacaatgtgggctccaagcagathgcagcagatccgcatgtcccttcgcgggaaggctgtggtgctgatgggcatagaacaccatgatgcgcaaggccatccgagggtsacctggaaaacaaccgcagctctggagaaactggctgcctcatatccgggggaatgtgggctttgtgttcaccaaggaggacctcactgagatcagggacatgttgctggccaataaggtgcgcagctgctgcccngtgrctggtgccattgccccatgtgaagtcactgtgccagccccagaacactgggtctcggggccccgagaaagacctccttttttccaggctttaggtatcaccact

SEQ ID NO: 1187 - DNA, 510 bp, Homo sapiens
  CDS 36..509
ttaggagtgagccacgcccgggctgtgggrataagatggcggggaagaagaatgttctgtcgtctctcgcagtttacgcggaagattcakagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatkaacgaaagataaaggagggaatggatatgaactacattatccaaaaggaagaaagaa

SEQ ID NO: 1188 - DNA, 472 bp, Homo sapiens
  CDS 277..471
cacaaaatggtagccgccgtgggggatgtccagttttttttcctcttcccaagtacagacgcagagcagacttgtctttccgcttaacctcaacctcgtgtgatctgccagtttcgctcccggttagcccaggactttttatagcatagagttttaaagcaagggcttagaatcagacctgggtcaaaatcctgccttccaccttcaccaaggcagtgtgaccttgacgttcctacataagagattaaaatacgccaaattccagcgraacagctgatgccagccagcttgaagacccctgccacagaagaagggaatsagcatgagaatwcagcttcttcatctcgctgtcccatgacttcgccctgtamtcttcagccaattaatgatctccacacttgggaccactctaaaacccttaagaacctgagactcaaagtcctcctggagacgaatttgagggttcctccta

SEQ ID NO: 1189 - DNA, 472 bp, Homo sapiens
  CDS 290..472
  misc_feature 460: n=a, g, c or t
ttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatccctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcaggncaaaaaccctgg

SEQ ID NO: 1190 - DNA, 536 bp, Homo sapiens
  CDS 32..535
aaccagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcastttactcccgattatgaagatgaggaggaggaggaagaggagga

SEQ ID NO: 1191 - DNA, 476 bp, Homo sapiens
  CDS 294..476
agtaaataatgaaaacgtttagtatcttggtatgtctaggattaagtgctttggatgtttgagttttgtttgctgtggttttatggattgtaatgccacgaagatctgtagctttaatgtttttagttagtgataaaagtgtgaatccgccaagagaaataagtaagtgctgatgtgttggtttgagagctgtaatattcactgctaaggtctgtaatttctctcctgagccagcaagatagtaaacccgccagaaagaaaaaacttcagagacactactttctacaactgtaatgctcactgtgagggtctgcagtttcatttttgtaagtcagaccaaaaacctgattgtggccgttggggaactctgcgtcctttgtagctactggtgtgagtgtaaattttctgttgagggccagcagtgtttgttaactctccgggagtgcggggtggcagagccaggcctgcacacccgg

SEQ ID NO: 1192 - DNA, 553 bp, Homo sapiens
  CDS 331..552
attaccaggatgtgaccctagaaggaagcagatttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctcgtacacaatktgcatccttgtcga

SEQ ID NO: 1193 - DNA, 574 bp, Homo sapiens
  CDS 290..574
agggaaacctggagcggtcagagcaggtagaaktwcaaggcttagagaggttaatcgacttacccaaagccacacagccaggaagtggtgagacactggaattgcattccaaatgtgtttttcgtttccacttcagtaatgaggaaatgaaagcccagaagatcaagtggacttgcccaaggctatatagcttgtggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgag

SEQ ID NO: 1194 - DNA, 469 bp, Homo sapiens
  CDS 65..469
acttcggcaagatggctgccctgacagcggacgatttttgcagcactccagagcctgctcaagaatgccgtataaatggaataatacagcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggcgtcc

SEQ ID NO: 1195 - DNA, 479 bp, Homo sapiens
  CDS 128..478
aagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggraatagtggagaaagcactggcacctatagagraaaaaactgagccacctgggagcataaccaaagtat

SEQ ID NO: 1196 - DNA, 554 bp, Homo sapiens
  CDS 86..553
cctccttcctccccgcctccagctgccggcaggacctttctctcgctgccgctgrgaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgrtgatatcacgcacgttgaaggaagtgtagatcctattcgagatatagraataatacatgaagagcttcacttaaagatga

SEQ ID NO: 1197 - DNA, 482 bp, Homo sapiens
  CDS 51..482
gagcgtggstcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggccckcagctcttcccgcaagtatacagaattg

SEQ ID NO: 1198 - DNA, 461 bp, Homo sapiens
  CDS 92..460
aaaaacctgcctgctcgctcctctccccatcgcctgcgttccgctggttgtgggctttctgcggccgctgagggcgcgtctcccctccgccatggcatcagttttgaatgtcaaggaatccaaagctcctgaaagaacggttgtagttgctggtcttccagttgacctttttagtgatcaattattggccgtattagtgaagagccacttscaagacattaagaatgagggcggagatgttgaagatgtgatatatccgacaagaaccaagggagttgcatatgtaatattcaaagaaaaaaaagttgcagagaatgtcatcagacaaaagaaacactggctagcaaggaagactagacatgctgaactcacagtctctctcagagtctctcattttggtgacaagatcttcagctctgtaaatgccatccttgatctttctgtttttggaaaagaagtta

SEQ ID NO: 1199 - DNA, 467 bp, Homo sapiens
  CDS 138..467
acattaattcatgtggcttggtgaaaaaaaatgctataactcctttacttaatgggattcttcccctgtggcagtgcaaacggttagagcaggagcttcatcatgtgaaagagcagaaccagacttcagcaaacaacatgagacatctgactgctgaaaacaatcaagaacgtgctctgaaggcaaagttgttatctatgcaacaagccagagaaactgcagttcaacagtacaaaaaactggaagaggaaatccagacccttcgagtttactacagtttacacaaatctttatctcaagaagaaaatctgaaggatcagttcaactatacccttagtacatatgaagaagctttaaaaaacagagagaacattgtttccatcactcaacaacaaaatgaggaactggctactcaactgcaacaagctctgacagagcgagcaaatatggaattacaacttcaacaa

SEQ ID NO: 1200 - DNA, 486 bp, Homo sapiens
  CDS 171..485
  misc_feature 473: n=a, g, c or t
aaaaccgcccactccctgagacggctaggtcacagaagcagtgggtcagaagccagaggggacgtggggagtgccaccctggagcctaccggcacacctgctgagatggaggcctcagatgggcaagggggtgaaggggacaagccactagagcaggtgacaaatgtgtcatgcctggagacaagctccagcgccascctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggacaattcaacacctttctgcagcattactgccaagcctgggaaatcaaacactggagaaagatgctctggcggttcatctccctcttctcggagctggaanaaagcagcttcgc

SEQ ID NO: 1201 - DNA, 208 bp, Homo sapiens
  CDS 24..206
ccttccctgcggccgcgcagagcatgccgggagccgccggccgccggtgtccggaccgctcgcccccgtttggacccgacttcggttcttctggggtgttgatgctcctaaagcccgagagcacgtgtccagaccctagcctgtacgacgcdbaactctgcccggtcccagaaccaaagccatgccggggtgtggcctctgaccccac

SEQ ID NO: 1202 - DNA, 512 bp, Homo sapiens
  CDS 343..510
  misc_feature 493,497,503: n=a, g, c or t
agttatgcgaaaacatggctgcggcggtttggccttcttggtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggakgccaakcggcagagattgccaatgccaagtccagagcggttagataaggtagtagattccatggatgcattagataaagttgtccaggaaagagaagatgccctaaggcttcttcagactggtcaanaaanagctanacctggtgc

SEQ ID NO: 1203 - DNA, 750 bp, Homo sapiens
  CDS 360..749
  misc_feature 713: n=a, g, c or t
attttaggtgagctgccacgtccggagagggcagcaagaatgaaagacctctagttttccagactcccggagccctggtctctacaccacatggacgttatccacctcctctgtgtcctcccagcatttcagaaggtgatccacggcaaagcgtcccttcaaatccgtctttgtgcccactgccatagtcaaccccgtgagaagcacagccggcmctgggactttaggacaagggtctcttcggaaagggcggasagcatgagaaagagtaagtggtggcagagagatggatccctgcagagacccctcagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggcccggatccactccgcggccagctccctcattatggaagacaaagaaatccccatcaagagtgagcctctgccaaaaccgcccgcatctgccccaccatccatcctggtgaaaccagaaaactcaagaaatggcatcgaaaagcaagtcaaaaccgtgagatttcagaattacagccytcytcccaccaamcattacacctcccatcccacntccggaaagcytgaacagccagccaccctcaaggcgt

SEQ ID NO: 1204 - DNA, 534 bp, Homo sapiens
  CDS 375..533
acttttggggaccttcatttaggtgagctgccacgtccggagagggcagcaagaatgaaagacctctagttttccagactcccggagccctggtctctacaccacatggacgttatccacctcctctgtgtcctcccagcatttcagaaggtgatccacggcaaagcstcccttcaaatccgtctttgtgcccactgccatagtcaaccccgtgagaagcacagccggcactgggactttaggacaagggtctcttcggaaagggcggasagcatgagaaagagtaagtggtggcagagagatggatccctgcagagacccctcagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacgggggagcccgccctcacgtgcatcagcaggggcagtgaggccgggatccactccgcgg

SEQ ID NO: 1205 - DNA, 452 bp, Homo sapiens
  CDS 288..452
attttaggtgagctgccacgtccggagagggcagcaagaatgaaagacctctagttttccagactcccggagccctggtctctacaccacatggacgttatccacctcctctgtgtcctcccagcatttcagaaggtgatccacggcaaagccgtcccttcaaatccgtctttgtgcccactgccatagtcaaccccgtgagaagcacagccggcactgggactttaggacaagggtctcttcggaaagggcggasagcatgagaaagagtaagtggtggcagagagatggatccctgcagagacccctcagtccgggatccccactctcgtggtaggctccctcagacgcagccccaccatggtccttcggcctcagcagttccaattctaccagccacaggggatcccctcctccccctcagccgtggtggtggagatggggtcaagcct

SEQ ID NO: 1206 - DNA, 465 bp, Homo sapiens
  CDS 188..463
attttggtggccgggcgcggaggtgattccacactgaggcgagcgcggcgccggggtggtagtggcagtgttcgtgtgctaaggtctgaatcgccgagggaggaggcggtggaggaagaggtggcggcggtggcggtggtcgtagcggtggcgagghggcgggtacgaatcagctgcgggcggatacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggttatcactaaaatatggcatcctaatattagttccgtcacaggggctatttgtttg

SEQ ID NO: 1207 - DNA, 507 bp, Homo sapiens
  CDS 15..506
acttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacaga

SEQ ID NO: 1208 - DNA, 457 bp, Homo sapiens
  CDS 157..456
aactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaaagcgaac

SEQ ID NO: 1209 - DNA, 487 bp, Homo sapiens
  CDS 157..486
cactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctca

SEQ ID NO: 1210 - DNA, 601 bp, Homo sapiens
  CDS 273..599
attcgcttccgggtgagaggtgcccggtcgccccagcaaccaagtcgcacctggagctgtcctagcgcctagttctctcccggccgcagagctggccgcdscagggggagtcgcagagtttggaagaactctctaacacctctcggccaacttcagaagtgtataagatcagctttatctttccaaatggagacaagtaatgatggtgacttgtacaagaacatcttctggaatctacgagagaaatggaataggtattcataccactcctaatggggattgtctacacaggaagctggaaagatgacaagatgaatggttttggaagacttgagcatttttcaggagcagtatatgaaggacaatttaaggataatatgtttcatggacttggggactttacaacatttcccaaatggggcaaagtatactggaaaatttcaatgaaaatagggttaaaatgtkaaatgggaatatacttgatatccaaaggactagaaaatggagtggtaactttcatttttacagctgctccagacctgaaawttaaagcttcacatgtagatgtgatgttaaatttaaagttgaaatgtagtaattg

SEQ ID NO: 1211 - DNA, 561 bp, Homo sapiens
  CDS 372..560
  misc_feature 158: n=a, g, c or t
ggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcacnccatcttgggacgtgaaactttttgaaagtttagaagcgaacttactgtgggctgtcacgtgtgaatatgtgtctagtgcatccttaacctgaggacttcaccagttcgaaattacagttttcaccatcaactaccttatcctttttggtctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaaaaaaaaa

SEQ ID NO: 1212 - DNA, 454 bp, Homo sapiens
  CDS 267..452
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtgaaaggtgaaggggaatatactgatatccaaggactagaatggagtgg

SEQ ID NO: 1213 - DNA, 402 bp, Homo sapiens
  CDS 145..402
ttttcgcttgctgtktctgtgactttacgctctgctgrcctagaggtcttagttccggagggaggaatgctgccaccaggrgacacaacaatgattcrattaaactagaatttacgactgccacctggccacgctgagctccacatgcctctgaatcaaaaggcaaagagagagttatgcattggctggggagacccatctggactaccaaggagaagctatagactacttctactcbaccaggaaggtcatattgaacattccagatacctatcattactcgatgctgttgataacagcaagatggctttgaactcagggtcascascagctattggaccttactatgaaaaccatggataccaaccggaaaamccctatcccgcacagcscactgtggtc

SEQ ID NO: 1214 - DNA, 549 bp, Homo sapiens
  CDS 373..549
gtagaatgttgttggtactgcagtgagaggcatgcttccttagaccagcttattcttttgtggactgttaatcatgaatgaaacaaaaccatggggaactgacatatgaagaggcagatcagtggagcagaatagaaaatcaataaattgacccaaataagtaaactcaaggttgcatttcatatcagcatggagtggattattcattaaaagtggctaactcagggggaaaaccttggatctgtcacttcttatatcagataacttccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagcttacatggctgggtccctggtgatagaaaacgggctagaaaaatttatagactctgatttttcagaaagt

SEQ ID NO: 1215 - DNA, 524 bp, Homo sapiens
  CDS 22..522
gcgaaacactattctaatggcatggtgccgcggtcctgtcttgctgtgcctgcggcaggggctcggaaccaattcattcctgcacggcctggggcaggagccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcccctcgagagctcgaggactcgagcgkagaccagggccggtgcggtcccacacaccagggatccgaggatccttcgatgctctcgcaggcccagtccgctaccgaggtcgaagagcgtcacgtctccccttcttgttcaacttccagagaaagaccctttcaggctggggaactgattttagctgagactggggaggggagaaacaaaaatttaagaaatta

SEQ ID NO: 1216 - DNA, 505 bp, Homo sapiens
  CDS 104..505
atataataaatatgcatctggtgaggactcatgtttctcttgagcagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagac

SEQ ID NO: 1217 - DNA, 350 bp, Homo sapiens
  CDS 199..348
  misc_feature 19: n=a, g, c or t
catcctaatctgtcccagntgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcgaaggagcggctgtacccgctgcggaagtacgcggtcaaggcctgaggggcgcattgtcaataaagcacagctggctgacaaaaaaaaaaaaaaaaa

SEQ ID NO: 1218 - DNA, 455 bp, Homo sapiens
  CDS 267..455
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtgaaaggtgaaggggaatatactgatatccaaggactagaatggagtgga

SEQ ID NO: 1219 - DNA, 453 bp, Homo sapiens
  CDS 267..452
  misc_feature 448: n=a, g, c or t
aagtcgcacctggagctgtcctagcgcctagttctctcccggccgcagagctggccgcccagggggagtcgcagagtttggaagaactctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtgaaaggtgaatgggaatatactgatatccaaggactagaatngagtg

SEQ ID NO: 1220 - DNA, 453 bp, Homo sapiens
  CDS 268..453
aaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagt

SEQ ID NO: 1221 - DNA, 486 bp, Homo sapiens
  CDS 27..485
agagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgccgaaaggccta

SEQ ID NO: 1222 - DNA, 460 bp, Homo sapiens
  CDS 274..459
  misc_feature 421,424,445: n=a, g, c or t
agcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtnaangggaatatactgatatccaangactagaatggagtg

SEQ ID NO: 1223 - DNA, 464 bp, Homo sapiens
  CDS 262..462
  misc_feature 72,299: n=a, g, c or t
tctggctgctctgaaaagccatctttgcattgttcctcatccgcctccttgcccgccgcagtcgcctccgcngcgcgcctmmtccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgttaacgggaatgctaatganggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgagga

SEQ ID NO: 1224 - DNA, 459 bp, Homo sapiens
  CDS 261..458
  misc_feature 94: n=a, g, c or t
ctggctgctctgaaaagccatctttgcattgttcctcatccgcctccttgcccgccgcagtcgcctccgccgcgscctcctccgccgccgcganctccggcagctttatcgccagagtccctgaactctcgctttctttttaatcccctgcatcggatcaccggcgtgccccaccatgtcagacgcagccgtagacaccagctccaaaatcaccaccaaggacttaaaggagaagaaggaagttgtggaagaggcagaaaatggaagagacgcccctgctaacgggaatgctaatgagggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcastgaagatgatga

SEQ ID NO: 1225 - DNA, 348 bp, Homo sapiens
  CDS 182..346
  misc_feature 327: n=a, g, c or t
ccycactggctgctctgawaagccatctttgcattgttcctcatccgcctccttgctcgmcgcagccgcctmygccgcgcgcctcctccgccgccgcggactccggcagctttatcgccagagtccctgwrctctcgctttctttttaatcccctgcatcggatcaccggcgtgccccaccatgtcagacgcagccgtagacaccagctccgaaatcaccaccaaggacttaaaggagaagaaggaagttgtggaggcagaaaatssaagagacgcccctgctaacgggaatgctaatgaggaaaatggggakcaggatgctgacantgaggtagacgaagaagagga

SEQ ID NO: 1226 - DNA, 202 bp, Homo sapiens
  CDS 51..200
  misc_feature 80: n=a, g, c or t
csggcsgggcscggaagctacagcagcggcgcgagactgcggggsgggccatggcggcgaacctgagccggaacggccancgctgcaagaggcctacgtgcgggtggtcascgagaagtccccgaccgactgggctctctttacctatkaaggcaacagcaatgacatccgcgtggctggcacaggggatggtggcctggag

SEQ ID NO: 1227 - DNA, 458 bp, Homo sapiens
  CDS 262..456
  misc_feature 299: n=a, g, c or t
actggctgctctgaaaagccatctttgcattgttcctcatccgcctccttgctcgccgcagccgcctccgccgcgcgcctcctccgccgccgcgactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatganggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatga

SEQ ID NO: 1228 - DNA, 594 bp, Homo sapiens
  CDS 178..594
  misc_feature 558: n=a, g, c or t
aattccatggaaaaagatagttagaatcctactttactccaaacacaaaaataagttccagatggattaataacaagctaaatgtgaaaagcaaactttacaacttagaagaaaaaataggaatctaccctgatgatactgcagtaggatggatttcttcaaacagaaaaagcacaaatgaataagaaaaaggtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgmccagggtgaatatctgacagtcactggaaktctagcagacaccagggcaacatctgtgtgcatttctccntatagtggaaagcatactcagatctggtactactgc

SEQ ID NO: 1229 - DNA, 579 bp, Homo sapiens
  CDS 109..579
cttttttctccgtcgccgctccaggacgcggcctcgggggagccctaccgggacgagccgcggggcctgcgacttcccccggagctggcctragggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacaagagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaa

SEQ ID NO: 1230 - DNA, 504 bp, Homo sapiens
  CDS 103..504
gagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaatagga

SEQ ID NO: 1231 - DNA, 517 bp, Homo sapiens
  CDS 62..517
gtcggcctgcgcctgtcacccccctcctcccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatragacctttgttgacaaggacttttgtaccatatca

SEQ ID NO: 1232 - DNA, 318 bp, Homo sapiens
  CDS 155..316
agttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgmcgcggcattcggggaatctgcagggcagatgagtaacgaaagaggctttgaaaatgtmsaactgggagtcataggaaaaaaaaaawaawaaaagct

SEQ ID NO: 1233 - DNA, 474 bp, Homo sapiens
  CDS 270..473
  misc_feature 251: n=a, g, c or t
ataattgagaagatggcggaccagcaaggacctcatcagaataggtttccatcgtgtgggaagaacggagtaacgagtctcacgcagaaaaaggtcttgagagcaccttgtggcgcacccagtgtaactgtgacgaagccaaccatgaaggaccgctcttcaactccccccttacatgttcacgtggatgagaacacccctgtccacgtccacataaaaaaactcccgaaaccatcagcgayyagcagcynaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcag

SEQ ID NO: 1234 - DNA, 489 bp, Homo sapiens
  CDS 57..488
aaccaagcaggcgcaagaagcaaccagcagcgctatccgctcccgttgctaccggaatgcctcttcaggttagcgattacakctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatag

SEQ ID NO: 1235 - DNA, 317 bp, Homo sapiens
  CDS 141..317
  misc_feature 180: n=a, g, c or t
actttttaacacttctgtcaagcatagtaaaatttcaacttaaaatatcacaagtctaaatcaatcaatgattcatttgtgcattttactttatttttgagacggagyttgctctgtcgcccagactggagtgcagtggcatgatctcgtctcattgcaacctccacstcccagattcangcgattctcctttgtcagcctcccaagtagctgggattacaggcatccactaccacgcctggctaatttttgtatttttagtagagacaggatttcaccatgttgggccaggctggtctccaactcctgaacttcag

SEQ ID NO: 1236 - DNA, 485 bp, Homo sapiens
  CDS 114..485
gactgggacgttcaggcggaagtggcgtcaggggcgctttagrgactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaaaaaaaaa

SEQ ID NO: 1237 - DNA, 455 bp, Homo sapiens
  CDS 75..455
aagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaaaaaaaaaaaaaaaaag

SEQ ID NO: 1238 - DNA, 536 bp, Homo sapiens
  CDS 105..536
aaagtcccagcaagaaaagaaggaaaaggaatgccaagcagtcatgttagcagtttgaaggggctggagcaagatggaatcaggaataaggagtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagawwammwwwwaaaawkrwksmwwwttwmywmmagggsytwawwwwrrrgractatatccagagacctctagtttcatcactttatgatgggtcgatgactatc

SEQ ID NO: 1239 - DNA, 468 bp, Homo sapiens
  CDS 29..466
aatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggacaaaatcaaagggacccttaggaggagagtgtgtcattttctaggggaaaaaagaagttttcagtgcctcagctcttgccaggctgaagagacaaagttgtgtttatcttg

SEQ ID NO: 1240 - DNA, 567 bp, Homo sapiens
  CDS 307..567
agactgaacaaggccgcctccccgccccaccctgctgcaacctaggaagggccaatttgatatctatgagcagaggacaaaatcaaagggacccttaggaggagagtgtgtcattttctaggggaaaaaagaagttttcagtgcctcagctcttgccaggctgaagagacaaagttgtgtttatcttgaaaagtctttcagtgcgtggtgccacttgtcctggagaacacaccagcctctgcccctgcactgtaccatccctatattatatcccccacctccacctcatcccccagcccccaagtcatgaggctcagtcgttgctgggagaatggtgaagaggagtcacagaacaggtggataaacttagtggatgaactgcacctaccttcctctcagacagagatttggtccccaagacttttcagagcgggtttgtgctggtcaccttcccacagaaggaagtgtgtggaggaagttgaagctgctgtggttccagacgcaggcaggtcacccctgatgctttcaacaagarggcgtgcagtgcatcgcaggacatctgctaag

SEQ ID NO: 1241 - DNA, 248 bp, Homo sapiens
  CDS 73..246
ctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgcgcyaaa

SEQ ID NO: 1242 - DNA, 409 bp, Homo sapiens
  CDS 250..408
ctctttctcctcctcctcagggctccagtcaggccgatccgctccgctcacggaaggaaaacagaaataacttgctggcttgtctggagtcacatggtgagtttagaggttaaccttacatccaataatttgtgaatcccaagtttcatgtttcaatatttggtgttacttaaagtgactcattaaattgactgatatcatgtgtcagtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaa

SEQ ID NO: 1243 - DNA, 541 bp, Homo sapiens
  CDS 261..539
agctgacgtgaaccgaagtccttatattcccaggcttctttctcctctgggtacarctccttactgccctgcagacaagcgtgccgtgcgtgcttgtggccaagggaaggaagagctggttgatccacagatagctccttcctccccgccccttcctttttgtttgcaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcg

SEQ ID NO: 1244 - DNA, 563 bp, Homo sapiens
  CDS 309..563
agaaccgctgcagtgccgagcttccagggacgtgaagccggaaagccaggcgcccttcttgactgcgcctaggtggaactggccctccagcagcttgaacgtagcctcttttcacactggtagttcctgaacctcttgtgaaatgaaagatgttcctcattccaagctgaggacggagaaaagccgtaaagctgacactggagctagaatgacttgtcagccacctttgagcaagaacttgcctggagtccaaatgtatggctattgaaggatagtaagcagacagcactaaaagtcatccattcgttatggatttagtcttaagaccctcatttgagagatgccttccctgtacctggaggaaagaaacatctttatctctgaagacacagggccacagagaagagtctgaacaaacaggctttaccaatttcccccagttgttaccgttagatcagacctttgtccagtcatatccttccacaagttgtccactcatcaaccctaagcataaaaatgcacaagtttccttgtttgtttgggtcttcatttccaagggctcc

SEQ ID NO: 1245 - DNA, 545 bp, Homo sapiens
  CDS 293..544
agttgggggagggtcctagcggggagtgaaccggaagtgtaaaggttcctgcctctcctcggccaggcggaacctctctgctgggcccggtggcgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtga

SEQ ID NO: 1246 - DNA, 478 bp, Homo sapiens
  CDS 75..476
aaaaaagatggtggcgcccagagcttcgctcttgctgctcccctgaggtgaactgaagccagcagccccgcatcatgtcaaagctcggccgggccgcccggggcctcaggaagcccgaggtcggcggtgtaatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgcctgcaggatgta

SEQ ID NO: 1247 - DNA, 504 bp, Homo sapiens
  CDS 268..504
attttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacactttggagtattagaaccactgtatatatgtggaaagccaggtcag

SEQ ID NO: 1248 - DNA, 527 bp, Homo sapiens
  CDS 55..525
atcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggragagaaaatggtacagcagttacaagaggatgtgga

SEQ ID NO: 1249 - DNA, 468 bp, Homo sapiens
  CDS 221..466
atttgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatgatgccgagagggacaggcttctccggaaggaacagattttagctgtggccaggcaggtagagtcaatgtgtcggctgcagcagcaggcatctggccggscccccatggacctgcagccgcaatc

SEQ ID NO: 1250 - DNA, 537 bp, Homo sapiens
  CDS 33..536
aaaaacgtttttgttagtcatttcaagtatccatgtccattgcagctgctctggaactcacaggaagatctcagtttttgcaaactcatggaagaatcacctggcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcrtatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagca

SEQ ID NO: 1251 - DNA, 568 bp, Homo sapiens
  CDS 41..568
attttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggacttccttggagcagaggtttgaatcctattacaactactgcaatctcttcaactacattcttaatgccgatggtcctgctccccttg

SEQ ID NO: 1252 - DNA, 492 bp, Homo sapiens
  CDS 41..490
attttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttgccaaagtcagtgggggaccttccttggagcagaggtttgaatcctattacaactactgc

SEQ ID NO: 1253 - DNA, 528 bp, Homo sapiens
  CDS 40..528
atttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagatgctgtcttcctgattttatacaaagaattatactacaggcacatatatgccaaagtcagtgggggacttccttggagcagaggtttgaatcctattacaactactgcaatctcttcaactacattcttaatgccgatggtcctgctcmccttgaactacccaaccagtggctctgggatattatcgatgagttc

SEQ ID NO: 1254 - DNA, 515 bp, Homo sapiens
  CDS 32..514
ctttccggcggtgctcgcaagcsaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggacttccttggagcagaggtttgaatcctattacaaacttactgc

SEQ ID NO: 1255 - DNA, 512 bp, Homo sapiens
  CDS 32..511
ctttccggcggtgctcgcaagcgaggcagccatgtcttatcccgctgatgattatgagtctgtggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacactactg

SEQ ID NO: 1256 - DNA, 481 bp, Homo sapiens
  CDS 34..480
atctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggacttcctt

SEQ ID NO: 1257 - DNA, 484 bp, Homo sapiens
  CDS 33..482
  misc_feature 434: n=a, g, c or t
cttttccggcggtgctcgcaagcraggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagathtgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaaganttatactacaggcacatatatgccaaagtcagtgggggacttccctttgg

SEQ ID NO: 1258 - DNA, 454 bp, Homo sapiens
  CDS 89..454
aacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttc

SEQ ID NO: 1259 - DNA, 525 bp, Homo sapiens
  CDS 324..524
attttatactaatggagagagagagaaagacatagaagtctcactgacttgcacagtttacttcccactgactagatcttggataaggacttttttgtcttattcataaaaggcgattgtgttcaattatgttatgctcagaggtggaatatataatactgacttctattgcttaaaaaaggtgattatgaatggaggaagaagtctgtgggacaggaaatttaaaataaaattttagagttagatagattatgagaagaaaaaatcaatgccaagttttgttgaccgcatctttggtggtgaactaactagtatgatcatgtatgatcaatgcagaactgtctccttggttcatgaatctttccttgatttgtccctccccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaa

SEQ ID NO: 1260 - DNA, 554 bp, Homo sapiens
  CDS 121..552
  misc_feature 32: n=a, g, c or t
ttttgcttccgggtcgtaggcgctacgtctgngcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggc

SEQ ID NO: 1261 - DNA, 651 bp, Homo sapiens
  CDS 245..649
acttacttagggcgggagccggccgtgggcgcsgttgttttgttctgtctgaggccaggaagtttgaccgcgctgccatgccgaaccgtaagccagccggaatgcttactatttcttcgtgcaggagaagatccccgaactacggcgacgaggcctgcctgtggctcgcgttgctgatgccatcccttactgctcctcagactgggcgcttctgagggaggaagaaaaggagaaatacgcagaaatggctcgagaatggagggccgctcagggaaaggaccctgggccctcagagaagcagaaacctgttttcacaccactgaggaggccaggcatgcttgtaccaaagcagaatgtttcacctccagatatgtcagctttgtctttaaaaggtgatcaagctctccttggaggcattttttattttttgaacatttttagccatggcgagctacctcctcattgtgaacagcgcttcctcccttgtgaaattggctgtgttaagtattctctccaagaaggtattatggcagatttccacagttttataaatcctggtgaaattccacgaggatttcgatttcattgtcaggctgcaagtgattctagtcacaagattcctatttcaaattttgaacgtgggcataccag

SEQ ID NO: 1262 - DNA, 491 bp, Homo sapiens
  CDS 141..491
actcctagctgttactgcaagtccatgcctctaccatgagggtggaggagttaagatcaacagatccacatgtaccttgaggtgacagactggctctgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcatggaagttcagagcagsaasasagtgcgagttctccaaacaggagttcatggatggcatgaaagaattaggatgtgac

SEQ ID NO: 1263 - DNA, 508 bp, Homo sapiens
  CDS 199..507
attcgctgcggacgcggaggaggaggggagaggcctggaggacaccaacatgaccctcaagatgagaataaaattggaatagatggcatacagcagttctgtgatgacctggcactcgatccagccagcattagtgtgttgattattgcatggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgsagatg

SEQ ID NO: 1264 - DNA, 490 bp, Homo sapiens
  CDS 66..488
agtgcggctgcgccggccggtagctgcagctggagcagtggcgtttggaggagactcgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaagatggaagatctggaa

SEQ ID NO: 1265 - DNA, 540 bp, Homo sapiens
  CDS 159..539
tgaggagcaggaactggaaccctggccgagtccgaaaaaagccagatctggaaggtggctgcggaacggttttaagcggaagatggaggagccggagaaccggcgacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagsatctggtttttgta

SEQ ID NO: 1266 - DNA, 308 bp, Homo sapiens
  CDS 157..306
tatagaagacttgaagaacactctcagccaactctacctaactcacatgtaaagaatacatattttttcaagtacacatggaacattctccagaatacgtcataagggaggccataaaataaatctcagttcatctaagaggactgataccatacaatgtgttttctaatcacaatgcaattaaaattgaaattaacaacaaaaggaaatctggaaaattcccaaattttggaaattaggcaacacacagctaaatacctactggvtcaaagaagaaatcacaatagatttttttttttttttttttk

SEQ ID NO: 1267 - DNA, 516 bp, Homo sapiens
  CDS 291..515
gaaaattctagaagtttgagtttgtgtgcttactagcaaccactttcagcgtttctgcaaagctagagaaggtatcttctaatttaaatgtctttaagaattatctattgcgtaatatactgtcaacaggaggtcagttttaaaggaatactactgatagcctgaaagactgtggaaaagaaattatttttcccccttacacactgatagttcttgtatttgcattcctgaaattcatatatatttttcaaaaaaaaaaaaccattggattagcagcaagagagttgaaaatggcagaagttgggaatgactgctatttcttttttaattccacatgcataaagggttcccagtgccgattccgacactgtgaagaggcccttggcagtgacactgtgtgctcattatggagagagaggaaatgtttagatccactttgcagatttagacacatggaaatgcagcaaaactgcrgcatttcatgcttctgggaaaytcagcctcttggttgtgtga

SEQ ID NO: 1268 - DNA, 612 bp, Homo sapiens
  CDS 189..611
  misc_feature 580: n=a, g, c or t
aacaatgaggaaaattctagaagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggratactacagatttcatactcntccagatattttgtcatcaaaaagcatgacac

SEQ ID NO: 1269 - DNA, 544 bp, Homo sapiens
  CDS 84..542
atcaccaccaccagcagagcctgagctgaggaaaccacggttctcaatacccagcacacccacttccaactatctgttaaaacatggtggattactatgaagttctaggactgcaaagatatgcttcacctgaggacattaaaaaagcttatcataaagtggcacttaaatggcaccctgataaaaatccagaaaataaagaagaagcagagagaaaattcaaagaagtagctgaggcatacgaggtattatcaaatgatgagaaacgggacatttatgataaatatggcacagaaggattaaacggaggtggaagtcattttgatgatgaatgtgagtacggcttcacattccataagccagatgatgtttttaaagaaatttttcatgaaagggatccattttcttttcacttctttgaagactcgcttgaggacctgttaaatcgtccaggaagctcctatggaaacagaaacagagatgcaggatactttttctcactgccagtgaatatccaatttttgagaaatttycttcatatgat

SEQ ID NO: 1270 - DNA, 497 bp, Homo sapiens
  CDS 154..495
aatcctgtcaacagcaatcgcccatttccaaagccatgcatgtctgccaccatcctcatgcactgcttccaagtgcctaggagcctttatgagcgtccctaaacctaaaagaatccagaggcggggctcggatgaaccctcgagataagcaagatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttattt

SEQ ID NO: 1271 - DNA, 530 bp, Homo sapiens
  CDS 378..530
aatcctgtcaacagcaatcgcccatttccaaagccatgcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgtttacacgtgggtggcactcgctggaatccagcgctcgggcagccctgggaggacgcgctcagctgcgaggaggatggagagcaatacatcatcatctttggagaattgagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattgga

SEQ ID NO: 1272 - DNA, 474 bp, Homo sapiens
  CDS 193..474
agagacgctcgagggatgggcagggaagggtgccctccgcggctgtgctgacttcaggagcctgtgactctcgcgttgaaaatacttcactcatgttcacttaggccatccctctgtgaattgctacataaaatacaagacgccgcaatcaattggaatttctctgaaagagcgaatgattcttagtccaagatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgca

SEQ ID NO: 1273 - DNA, 435 bp, Homo sapiens
  CDS 41..433
atatccggcccttgcgatcagggcttgaggaacccgcgccatgaagtgcgtgtttgttaccgtaggaccaccagctttgacgacctcattgcgtgtgtgtcggcgcccgacagtctgcaagtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccgg

SEQ ID NO: 1274 - DNA, 227 bp, Homo sapiens
  CDS 33..227
  misc_feature 145: n=a, g, c or t
atttcttgacactcctgtcttcttgccacctcatgatgcggccaatgcttcgttgtgtggkagatcttcagacaattcaagtgatcaagattttaaaatatgaaaagaaactggccaaaatgtgctttttaatgatattcacctncctggtctgttggatgccttatatcgtgatctgcttcttggtggttaatggtcatggtcacctggtcactccaacaatatcw

SEQ ID NO: 1275 - DNA, 519 bp, Homo sapiens
  CDS 205..519
  misc_feature 340: n=a, g, c or t
aaaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcgnagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaat

SEQ ID NO: 1276 - DNA, 540 bp, Homo sapiens
  CDS 130..540
agtggagggacagcttatagaaagttgagatggtcctaatgtaggtaaatagaaatctcaaactgatattgatactttcaggatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatgga

SEQ ID NO: 1277 - DNA, 496 bp, Homo sapiens
  CDS 102..494
  misc_feature 473: n=a, g, c or t
agatgtggtagtggagggacagcttatagaaagttgagatggtcctaatgtaggatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcanttactcaaactgaaacgtctcct

SEQ ID NO: 1278 - DNA, 487 bp, Homo sapiens
  CDS 134..487
ctgttcagcagtgccttgggtacaactatgtctgagtaggcagccggtaacacaatgtctcccttgtgcaaagtaactctcttagtgagtgctcagatatgtgaggaaaaagtatttggtggagtgtgacaatatgaaccgctttgaccgaccagacagaaatgttcggcagcctcaggaaggtttttggaaaaggccaccccagaggcggagtggacaggagcattaccacctcagccaccctgaccactatcatcaccatggaaaaagtgacatgagcagaggctctccctatagagaatctcctttgggtcattttgaaagctatggagggatgccctttttccaggctcagaagatgtttgttgatgtaccagaaaatacagtgatactggatgagatgacccttbggcacatkgttcaggattgcactgctgtaaaaactcagttactcaaactgaaacgtctcctgcatcagcatgatgga

SEQ ID NO: 1279 - DNA, 482 bp, Homo sapiens
  CDS 330..482
agttagatttggaggttcaacttcaacatggccgaagcaagtagcgccaatctaggcagcggctgtgaggaaaaaaggcatgaggggtcgtcttcggaatctgtgccacccggcmtaaccatttcgagggtgaagctcctcgacaccatggtggacacttttcttcagadgctggtcgccgccggcaggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctgg

SEQ ID NO: 1280 - DNA, 603 bp, Homo sapiens
  CDS 358..603
caatgttctaggtatctttaaatttgttattgtgkaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggacggg

SEQ ID NO: 1281 - DNA, 492 bp, Homo sapiens
  CDS 306..491
actctatgtatggaagcactgcagagcgacaaccataaacatcttatgttggtgggggtttattgttatttctagaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagctgtcggaagaggtggaccggctgcggacccagttacccagcatgccacaatctgattgctgacctggatggaaacagagtga

SEQ ID NO: 1282 - DNA, 512 bp, Homo sapiens
  CDS 114..512
agacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctacgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggcacccagacggcctccatcatccttcctactcttctgccaagaccactatgctcagctgaagagggagaacccgaactggtcggtggtgcaggtggccaaggccacaggggaagatgtggtcaac

SEQ ID NO: 1283 - DNA, 519 bp, Homo sapiens
  CDS 276..518
aatgagaaaaacaataaagaaattcccatcactggcaaaaatattacagatttaaaattccattccagagttccaagatacacactgtccttcctcgaccaaacaaaacatgaaatgaaagacaaagaaagacaaccatttctagtaaaacaaggatcaataatatttgaaaatgagaaaacttccaaagttaattccgttactgagcagtgtgttgcaaaattcagtacttacagaattacctaaaagaatctgtgcagatacagaaaaaagtaatggaactggagagtgaaaatctaaaccttaagtccaaaatgaaacctcttatctttaccacacaatctctcatacagaaagttgaaacatatgaaaagcaacttaagaacctggttgaagaaaagagtactattcagtctaagttaagtaaaacagaagaagacagcaaagagtgtcttaaagaatttaaaaaaataattagtaaatataatgttctgcaaggscaaaataaaactctagagg

SEQ ID NO: 1284 - DNA, 476 bp, Homo sapiens
  CDS 4..474
gcgatgctggcgacgctggcgagggtggcagctctgcgcagaacctgcctcttctccggccggggcggcgggagggggctgtggactggccgcccgcrgtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcacagacag

SEQ ID NO: 1285 - DNA, 478 bp, Homo sapiens
  CDS 135..476
agaaagttctagtggcttgaggtatccgcagagcggccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgcaagcagtcccgggactgcttcggatgccttcgagagtggtgcgacgccttcttgtgatgctctctgggaagctctcaatccccagccctcatccagagtttgcagccgaktagggactcctcccctgtcctctacgaaggaaaagattgctattgtcgtactcaccttccgacg

SEQ ID NO: 1286 - DNA, 518 bp, Homo sapiens
  CDS 235..516
agaagaaaaggggtcaagaaggcaggaccccgtgaagcacacctttcctaaggattttgacgaatgagaatgaagataaactgtgagttgaaagtgaaagagaaagcataagggatcttaggtgcatctgacaagccttagatgacctccagcaacttcagttctcaccgaattactgcatttcagccttactgagaagcagccagtcatactatcctcaaattttaacccaggatgagttctcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccc

SEQ ID NO: 1287 - DNA, 490 bp, Homo sapiens
  CDS 135..488
aacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgcgtccacccccagttcaaggagatccagaaactcatcaaggagcccgcccca

SEQ ID NO: 1288 - DNA, 490 bp, Homo sapiens
  CDS 132..488
aaagttctagtggcttgaggtatccgcagagcgccgggtggcgggaggaaccgttacgggaactgaagttgcggattaagcctgatcaagatgacaacctcccaaaagcaccgagacttcgtggcagagccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgcaagcagtcccgggactgcttcggatgccttcgagagtggtgcgacgccttcttgtgatgctctctgggaagctctcaatcctcagccctcatccagagtttgcagccgagtagggactcctcccctgtcctctacgaaggaaaagattgctattgtcgtactcacctccgacgtactccgggggtcttt

SEQ ID NO: 1289 - DNA, 420 bp, Homo sapiens
  CDS 89..418
agttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaagg

SEQ ID NO: 1290 - DNA, 512 bp, Homo sapiens
  CDS 279..512
acgtcgatctcagctttgcttgaggcaaatgcaacaatatttcagagtgaggattcagccaaacatctctaagaagaaaacctctggacacagcaggacacagaaatactgaaatctccagcctagggcaccatccctcaagttaaagcccaggcagtaagaaaacatatcagcttccacttttacctttaaggagaagccagctcccatgttaagaagttcaaatacctagagactgcgatggtttgcagaggctcaagctaaccacatggaaagacatggagagatattccttgccaaccctcaactactccaactattctaagacatcaaacctgtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaaaaaaaaaaaaaaa

SEQ ID NO: 1291 - DNA, 527 bp, Homo sapiens
  CDS 377..526
atactcaattttccttgttgtgagacaacaaacctcaggtatttacccagacaacgacactgcttcaaaactagaaaatagaagagcaaattaaactcaaagcaaacagaaggcaggaaatactaaagataatagtagaaatcaatgacatggaaaacaggaaaactggagaaaagtaagtgaaacaaaaagctggttctttgaaaaaaaaaatcataaaagtaatgaacctctagtaaggtgaacaaaaggaaagagaaggcccaaattaccaatatcaagactgaaacaggacatcactacagattctgcagacattaaaacttatgagaggaagtcaaggccattaaaggaaaattcatagctttaaaggcacatgttagaaaggrggaaagccaaaattaagaagcacccacctcagaaagaaaaagaacagtacattaagcctaaacaaagtagaaaaaagaaaataataaagataagaacagaagttaataaaattaagaatatacttacaaaagagaggd

SEQ ID NO: 1292 - DNA, 458 bp, Homo sapiens
  CDS 161..457
  misc_feature 156,458: n=a, g, c or t
aagataagctaggagccgcgcgagtcgtagtgtcgctgtttgcgggtctccgcgcgggaccggggcgcagggggtcgctgaggcgagggtgtcatgtcagacaacgaggacaattttgatggcgacgactttgatgatgtggaggaggatgaaggnctagatgacttggagaatgccgaagaggaaggccaggagaatgtcgagatcctcccctctgggagcgaccgcagccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagn

SEQ ID NO: 1293 - DNA, 484 bp, Homo sapiens
  CDS 253..483
aaaaatctggacacagcacacggtgaggagactatgtgaacacgaagaagcctgctgagatggttgatattgagtgtcaatgtgattggattgaaggatgcaaggtgctgttcctgggtgtgtctgtgcgggtgtttccaaaggaggttaacatttaagtcagcggatgaagagagacagacccaccctcaatttgggttggtaccatctaatcagctgccagcgagccaagagaaaagcaggcaggagaagatggaacaacacacttgcagtcttccggcctttatctttctcccatgctggatccttcctgccctggaacatcggactccaagttcttcagcttttgactcttggacttacaccagtggtttgccaggggctcttggggcctttgaccacagcctgaaggctacactatcggcttctctatttttgaggtttgaggactcaaactggcttccttgtccctcagcttgtgatt

SEQ ID NO: 1294 - DNA, 366 bp, Homo sapiens
  CDS 68..364
gtacagaaagattggtggacaggagcagcggccggtgggmgagggcgctcggcggcggcctgcggccatggccaccgtgatggcagcgacggcggcggagcgggcggtgctggaggaggagttccgctggctgctgcacgacgakktgcacgctgtgttgwwgcagctgcaggacatcctcaaggaggcctctctgcgcttcactctgccgggctccggcactgaggggcccgccaagcaagagaacttcatcctaggcagctgtggcacagaccakgtgaagggtgtgctgactctgcakggggatgccctcagccaggcggatgtgaacctgaagatgccccggaacaaccagctgctgcactt

SEQ ID NO: 1295 - DNA, 467 bp, Homo sapiens
  CDS 125..466
accttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgc

SEQ ID NO: 1296 - DNA, 493 bp, Homo sapiens
  CDS 242..493
acgaacgcacggccgcgcasatctgtcttgctggaagcttttttcctagagggktgagcggkttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccrgcagcggggcccaacagctcgaggaggaaggcccaatggaggargaaggaaaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtgggtgccggctacaagagtatcagccgctcttgaagaagccgacaagratgtttctgaggaacaag

SEQ ID NO: 1297 - DNA, 271 bp, Homo sapiens
  CDS 98..271
accacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattt

SEQ ID NO: 1298 - DNA, 472 bp, Homo sapiens
  CDS 20..472
atacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggattmggcttcgccatcgcccggcgtttggcccaggacggggcccatgtggtcgtcagcacccggaagcagcagaatgtggaccaggcggtkgccacgctgcagggggaggggctgagcgtgacgggcaccgtgtgccatgtggggaargcggaggaccgggagcggctggtggccacggctgtgaagcttcatggaggttcgatatcctagtctccaatgctgctgtcaaccctttctttggaagcataatggatgtcactgaggargtgtgggacaagactctggacattaatgtgaargcccagcctgatgacaargcagtg

SEQ ID NO: 1299 - DNA, 225 bp, Homo sapiens
  CDS 30..224
tgggagattcgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaaaaaaaaaaaaa

SEQ ID NO: 1300 - DNA, 562 bp, Homo sapiens
  CDS 37..561
cagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatc

SEQ ID NO: 1301 - DNA, 502 bp, Homo sapiens
  CDS 340..501
aggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgagagattcacaaggacctgctagtgactggcgcgtacgagatctccgaccagtctgggggcgctggcggcctgcgcascacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgccttagaagacctt

SEQ ID NO: 1302 - DNA, 639 bp, Homo sapiens
  CDS 279..638
atattgatgtggctctaaacaacaacagtgtgcgaaggcccaggggcactttgggattgaccaagaggaaacacaagttgcacaatgatacaatcttgttggtacaattgtcagagaagggaactcccacagcaaaggccataaaaccatccagggcagtctggggcggctcagttctgcggtgccagggagtggagcagagctcagccccgtcccaaacacagatgggaccatgaactccggacacagcttcagccagaccccctcggcctccttccatggcgccggagtggctggggccggcccaggagcttccccagggctcccaccgtccatggcggtgcggggggagcccgcatctccctgtccttcaccacgcggastgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatkaggaaaacatcacacacctgcaggagcagatagtggatggta

SEQ ID NO: 1303 - DNA, 597 bp, Homo sapiens
  CDS 73..597
agctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcac

SEQ ID NO: 1304 - DNA, 511 bp, Homo sapiens
  CDS 305..511
gattgttacagcagagaacaacggagacattctgttttgaagaccagtggattttgactttattcagtcaactccctttaaacctctggcactaaaaccaccgcttcatatactttaagtggaagaccaccagattttcaggatttagaaagacctccttcaacccttcaaaatgaagaaatctgtgcatttggcaagctaaaaagagactgctctttgagtgaaaatgttgttggccaaaatagacgttgatcaggagtgatttcatcgtgacaccatcaccataagaagctgtcttcccaacatgttacccgaaaatagaactaatctttcctctgttcatggcattctgtcatttatccagtcttctactcgtagggcttaccagcatatcgtggatgagatgggtgaaaatcgcagacctgtgcagtatggcaggtctgctgctaccacttctaatccgcatcgtgacaacatcaggtatggcacttcaaacatagatacaagtgaa

SEQ ID NO: 1305 - DNA, 471 bp, Homo sapiens
  CDS 299..469
ctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgagatcaacaatggtagacccagcgatcaacttgtttttcctaaaaatgaaaggtgaactggaacagactaaagacaaactggaacaagccca

SEQ ID NO: 1306 - DNA, 484 bp, Homo sapiens
  CDS 105..482
gtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttcg

SEQ ID NO: 1307 - DNA, 485 bp, Homo sapiens
  CDS 228..485
attctccttatgtcatgttccttcattgccctattcttcctttggtggaggaaaatatttgccttaaaaagaaaaacaaaattatctgccaacatttagaaagctgtgtcaattttatactagtttaacacagatctttagttattggcaatagagtttatatagttaaatataaaggaattatcagaaatactttatagttatcaaaaattctaaagaaaaaggccatggatgtagaaattcaggacacacctggaaagataagtatctctaaaaggtccatcctttcaggaactgttgagaatatagattacccacactattgtgatctcttaagaaaaatgaacatgtcttttgtgaaaggtcttgagaacagacataactatggcaggtttgaaaagaaatgcaaccctgcttttcttaaatttcacccttatcccccttcagttttgccagactatcatttacatgatccttatccccca

SEQ ID NO: 1308 - DNA, 339 bp, Homo sapiens
  CDS 30..338
cctttccgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttkatctttccctctttgtggctcagaaaatgtacaggttttccagggcagccttgtggattgggaccacttcctttatgatcctggttcttccccgttgtcttttgagac

SEQ ID NO: 1309 - DNA, 450 bp, Homo sapiens
  CDS 162..449
acggtagccggtattcaatcttcaaatcagcgccgcggaagtgcgggcgggtgttgctcccctgtctctggacgacgctgtgactgatcccaggcttggagccggagctgcgagcgagggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagagtctcgctctgtcgccaggctggagtgcagtggcgcaatctcagctcggg

SEQ ID NO: 1310 - DNA, 459 bp, Homo sapiens
  CDS 37..459
gacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggca

SEQ ID NO: 1311 - DNA, 487 bp, Homo sapiens
  CDS 14..487
gttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaagggaaaaactcggatgaagrcgcccccaagactgcccaga

SEQ ID NO: 1312 - DNA, 516 bp, Homo sapiens
  CDS 267..515
aacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgt

SEQ ID NO: 1313 - DNA, 471 bp, Homo sapiens
  CDS 269..469
gaggcctggctttctgtgcctgtggaccactcgtccctttcacgtgccctgggtttggacctgagctcgcaatattttcagggacaaaagccaggatggatgttcaaaaatggtatttgagaacttcaaagctggctctggscttggcaattatccgctcaaaaccagcagacaaaagcagcagagaatacacagagcaccttgctatgttgctgtctgaggagcagtcaaatggagatcaaaagttgaaatcttggaagctgaagttatgcaattacgtcaaaaacttcttgtgagcaggctttgttcaggatcctttaagagtggatacgtttcctcccagttggaggctcaggaacctaagagttctgaaagtacattaacttcgatggaagattctggatgtgatttgtcgaatgagcagagaactgaatcctcagacctgtcccagcactttgtggaaagctgtac

SEQ ID NO: 1314 - DNA, 504 bp, Homo sapiens
  CDS 105..503
ggaggagttcygggggccaggcggcgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtsgacaaactctcttcggctcatgtataccttcgattacataagggagagaatatagaagacawcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattag

SEQ ID NO: 1315 - DNA, 492 bp, Homo sapiens
  CDS 99..491
aaagcactaagcacatctacaatcaaggagaggggcaggctttaccttttgaaggaagaagtatgaaagtgtatcactgactgatcaagtagagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgagttatcatttcccatgtggacttcagagagaatgtattttccagtttactggcaattttgcgtcattttgttgggaccatcgacctgttcaaat

SEQ ID NO: 1316 - DNA, 333 bp, Homo sapiens
  CDS 13..333
gcggacggcgcgatggcggcggctgccgccgagacccccgaagtccttcgggaatgcggttgcaagggcatccggacctgtctgatctgcgagcggcagcgcggcagtgacccgccctgggagctgcccccagcgaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcag

SEQ ID NO: 1317 - DNA, 471 bp, Homo sapiens
  CDS 68..469
  misc_feature 428: n=a, g, c or t
agggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcagagctgacatggacccaaatacctcgggccgccctggagcgccasagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccanccccccagtcgtctgggaatggacaaccatttggaggagctga

SEQ ID NO: 1318 - DNA, 505 bp, Homo sapiens
  CDS 207..503
attttccagccctactccgactagagttgaggcagcggggagagtaaaatgtccgtgtcagggttcaaggccaagctgaagttgttgtcctctattttccacaagaaccaggagccgccgcggcagctcaggctccactgcaacatcacgtcaggttttccttgttcccgcatgttcagccaatcgtgtttaaggagaaactaacaatgaaaacgggcttgttgatggaggaaaagttggaatgcagcctctggtgctgtttgagcgatccctctatcccgggtcgctgctgtgttctggaaaggcacattgtaccctggatgcagcagcttcatcagcaatggaagtggctgatatgtggactctgcagattatataaccttcctaagcacccgaatgttgagataccagatcaaccactacccatgggtcagaatgggacaacagaagaagtgacttcaaaagaagaggaagaagaagagatggatgaagatwtagaagactt

SEQ ID NO: 1319 - DNA, 562 bp, Homo sapiens
  CDS 104..562
tttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcgggctttgattctacagatctttctcaaagga

SEQ ID NO: 1320 - DNA, 369 bp, Homo sapiens
  CDS 143..367
aatagaacacaagctttaaagtaagtgaatcatgtgtgcctcatttatttttaaaagcaacttctgagaagggctaagaacaaattttttccctgagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtg

SEQ ID NO: 1321 - DNA, 470 bp, Homo sapiens
  CDS 235..468
agtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgccttctccctggagtaccgagtcttcctcaaaaatgagaaasgacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctgggaactatggtgccatccctcagacttgggaagacccaggcacaatgataaacatactggctgttgtggtgacaatgacccaattgatgtgtgtga

SEQ ID NO: 1322 - DNA, 249 bp, Homo sapiens
  CDS 28..249
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaar

SEQ ID NO: 1323 - DNA, 204 bp, Homo sapiens
  CDS 28..204
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaaaaaaaaaaaaaaaaaaaaaaaaaaaaaaaaaaaaaaaaaaaaaaaaamaaaaa

SEQ ID NO: 1324 - DNA, 240 bp, Homo sapiens
  CDS 28..240
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaamcccm

SEQ ID NO: 1325 - DNA, 212 bp, Homo sapiens
  CDS 28..210
atggaatgtagcagactccttttatagatgagcaaattgagacccaaagccgttaaacaacttgcccccgacagtgtgatattctctccctatctcgttcgaatttccgtctcgattttaaaaattgagaagggagagaaaaaaaaaaaaaaaaawwwwwaaaaaaaaaaaaaaaaaaaaaaaaaaaaaaataaaaaaaaaaaaaaaaaaar

SEQ ID NO: 1326 - DNA, 511 bp, Homo sapiens
  CDS 154..510
gctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctatccagaagat

SEQ ID NO: 1327 - DNA, 480 bp, Homo sapiens
  CDS 208..480
ctttttcttccgcacggttggaggaggtcggctggttatcgggagttggagggctgaggtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagkatwtcatcaagtgactcatcttttgaaccaataccattgactataaaagctatttttgaaagattcaagaacaggaaaaaaaaaaaa

SEQ ID NO: 1328 - DNA, 472 bp, Homo sapiens
  CDS 294..470
aacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaattyctwgaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacc

SEQ ID NO: 1329 - DNA, 453 bp, Homo sapiens
  CDS 208..453
gacgatggcatgtgcatggtacatagaatggggcaaatctaaaagttctcagctacaaagctatagcagttgtatctatcaaattccagagactttgtgtaccaaacttaaaactttttttttttattggagaatttcacttaaggattctgatacatttgaaatacagtaaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaacccaaargctaatagtgaacacaatggcccaatggatggacagagtgga

SEQ ID NO: 1330 - DNA, 498 bp, Homo sapiens
  CDS 127..498
aagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacagtagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctg

SEQ ID NO: 1331 - DNA, 527 bp, Homo sapiens
  CDS 35..526
aaaaccctgcgcggccggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaw

SEQ ID NO: 1332 - DNA, 477 bp, Homo sapiens
  CDS 11..475
gagcgggcgcatgatggcggccgcggcggcagcggctgcggggagctccagcagcggcggcggcggcggcggcggcagcggcagcggywgcagcagywgcgacacgtccagcaccggcgaggaggaaaggatgcggcgcctcttccagacgtgcgacggcgacggggacggatacatcagcagaaatgacttgctaatggtctgtcgccagctgaatatggaagagtctgtggctgagatcatgaaccagttgggagcagatgaaaatgggaagatttcctttcaggatttcacaagatgccgcatgcagcttgttcgagaaattaggaaggaggaagtagatctttctgcaaagtcagacaactcctgtacaaagaagctgagggatagaattgcttcctggcccacgagcagtgacaacagtttgggtgccttatcagcagccagggasagctgggaatacgactctggtgccag

SEQ ID NO: 1333 - DNA, 349 bp, Homo sapiens
  CDS 3..347
aaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcaryggcagcggcaggaggagccgcccccgggtccgcagcgacccgaccagtcggccgccgvcgctggcccccggggatcccaabmggaagggccggtccgggctccacacttagcttm

SEQ ID NO: 1334 - DNA, 394 bp, Homo sapiens
  CDS 221..394
atatacctcaacttcgcacgactgcgtgcctcaagccgacgcagcggcctactctcgcactgcagacggggaaactgaggcccgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgamggg

SEQ ID NO: 1335 - DNA, 341 bp, Homo sapiens
  CDS 93..341
cacaaaagaargcasyaaaggaggaacmctacaaaaraaagtgacatagaaaaataccaaaatggccttttaaaatcccaactgtatcaattatgtatatatataatgystgtgtatatatatatacacatatatatataaatatttttttgagacagagtctcawaaaaatwtattyyattwkatttattattattattatttcyygagacggagtcttgctctgtcaccagactggagtgcagtggcgcgatcttggctctttgcaacctctgacttcctggwtcaagcgattctcctgcctsagcctsccaagtagstgwgattacaggcacgtacca

SEQ ID NO: 1336 - DNA, 318 bp, Homo sapiens
  CDS 39..317
agtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacs

SEQ ID NO: 1337 - DNA, 480 bp, Homo sapiens
  CDS 137..478
taaggaaaaacagaatatttgatggatttgccgcagtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagatctaatacattgcagcacaactga

SEQ ID NO: 1338 - DNA, 212 bp, Homo sapiens
  CDS 60..212
tggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactacaaaaaaaaaaaaaaaaaagct

SEQ ID NO: 1339 - DNA, 512 bp, Homo sapiens
  CDS 152..415
  sig_peptide 152..238: Von Heijne matrix score 13 seq LLLVLLLVTRXRS/MP
atgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggasccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagcaagcsgcgcccgagaacacgctggcggccattcggcaggcagctaagaatggagcaacaggcgtggagttggacattgagtttacttctgacgggattcctgtcttaatgcacgataacacagtagataggacgactgat

SEQ ID NO: 1340 - DNA, 509 bp, Homo sapiens
  CDS 200..430
  sig_peptide 200..259: Von Heijne matrix score 13 seq VVALLALLASARA/SE
atctgggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatataaaacaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtgcccaggtggcccagcaggccaggggctgggtgaccgatggcttcagttccctgaaagactactggagcaccgttaaggacaagttctctgagttctgggatttggacctgaggtcagaccaacttcagccgtggctgcctgagactcaatac

SEQ ID NO: 1341 - DNA, 452 bp, Homo sapiens
  CDS 105..395
  sig_peptide 105..161: Von Heijne matrix score 12.3000001907349 seq LLILALLAWVALA/DQ
  misc_feature 181: n=a, g, c or t
ctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaaggnccgctgcactgagggcttcaacgtggacaagaagtgccagtgtgacgagctctgctcttactaccagagctgctgcacagactatacggctgagtgcaagccccaagtgactcgcggggatgtgttcactatgccggagatgagtacacggtctatgacgatggcgaggagaaaaacaatgccactgtccatgaacaggtggggggcccctccctgacctctgacctccaggcccagtccaaagggaatcctgagcagacacctgttctga

SEQ ID NO: 1342 - DNA, 464 bp, Homo sapiens
  CDS 92..412
  sig_peptide 92..160: Von Heijne matrix score 12 seq RLLLLSLVSGALG/LG
  misc_feature 325: n=a, g, c or t
tgctgccttctctgatggcttctccagcggcctcagtaccaccttagcggtcttctgccatgagctgccccactaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctncaggggctggggctgctgctggggggcggcctcatgcttgccataaccctgctggaggagcggctactgcccgtgaccactgagggctgatggggccaattggaaaggggtcgggttgcccttccttccccccaaccac

SEQ ID NO: 1343 - DNA, 922 bp, Homo sapiens
  CDS 90..479
  sig_peptide 90..149: Von Heijne matrix score 11.8999996185303 seq LVLEFLLLSPVEA/QQ
aatcacggggaggcagggcctcgccacaccaaacctgtggacgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccytaaaagcagtgccctggacttgaagcccgtgaaatgactccatctgggattcagaatacagtgtttgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagcaaaaaaaaaaaaaaaa

SEQ ID NO: 1344 - DNA, 417 bp, Homo sapiens
  CDS 33..263
  sig_peptide 33..98: Von Heijne matrix score 11.8000001907349 seq LMIFLLLLGQIDG/SP
ttttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaaaaaaaa

SEQ ID NO: 1345 - DNA, 802 bp, Homo sapiens
  CDS 9..446
  sig_peptide 9..71: Von Heijne matrix score 11.8000001907349 seq LILALLSSLAASG/FP
attcagcgatggcatttgcatggtggccctgtctcatcttggctctgctctccagcttggcagcctctggcttcccgagaagccctttcggctgcttgggaaacggagcctcccggaagggtggccaatggcatcgaggtctacagtaccaaaatcaactccaaggtgacctcscgttttgctcacaatgttgtcaccatgagagccgtcaaccgtgcagacacgccaaggaggtttcctttgatgtggagctgcagacctcgatgccattggccagcccttccgccacggccgtctctggagagcagcagccatggccctacgctaccctatggccgtgggctccaacaagggccacaaaagtgaccaagaacgtgagcaaagcccagggcacagccgatcgccgcgggcgtctgacccaaacacaccaagttcgtgcgggacaatrattcgggaggtgtgtgggctttgccccgtacgagcgggcgcgccatggagtttactgaaaggtctccaagggacaaacgggcccctcaaattttatcaagaaaagggtggggacggcacatcccgcgccaagagggaagcggggaggagctggagcaacgtactgggcccgccatgaggagaagctgctgccaagaaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcct

SEQ ID NO: 1346 - DNA, 648 bp, Homo sapiens
  CDS 9..491
  sig_peptide 9..71: Von Heijne matrix score 11.8000001907349 seq LILALLSSLAASG/FP
attcagcgatggcatttgcatggtggccctgtctcatcttggctctgctctccagcttggcagcctctggcttcccgagaagccctttcggctgcttgggaaacggagcctcccggaagggtggccaatggcatcgaggtctacagtaccaaaatcaactccaaggtgacctcscgttttgctcacaatgttgtcaccatgagagccgtcaaccgtgcagacacgccaaggaggtttcctttgatgtggagctgcagacctcgatgccattggccagcccttccgccacggccgtctctggagagcagcagccatggccctacgctaccctatggccgtgggctcaacaagggccacaaagtgaccaagaacgtgagcaagcccaggcacagccgacgccgcgggcgtctgaccaaacacacaagttcgtgcgggacatgattcgggaggtgtgtggctttgcccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagccccgagtttaaaaaaaaa

SEQ ID NO: 1347 - DNA, 582 bp, Homo sapiens
  CDS 189..464
  sig_peptide 189..260: Von Heijne matrix score 11.6999998092651 seq FVLGLGLTPPTLA/QD
acactcacacaaggacgcsaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagatcaaggccatctgtgaaaacaagaatggaaaccctcacagagaaaacctaagaataagcaagtcttctttccaggtcaccacttgcaagctacatggaggttcccctggcctccatgccagtaccgagccacagcggggttcagaaacgttgttgttgcttgtgaa

SEQ ID NO: 1348 - DNA, 563 bp, Homo sapiens
  CDS 112..387
  sig_peptide 112..183: Von Heijne matrix score 11.6999998092651 seq FVLGLGLTPPTLA/QD
acacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcasatcaaggccatctgtgaaaacaagaatggaaaccctcacagagaaaacctaagaataagcaagtcttctttccaggtcaccacttgcaagctacatggaggktcccctggcctccatgccagtaccgagccacagcggggttcagaaacgttgttgttgcttgtgaaaatggcttacctgtccacttggatcagtcaattttccgtcgtccgtaacagcggccct

SEQ ID NO: 1349 - DNA, 489 bp, Homo sapiens
  CDS 56..214
  sig_peptide 56..109: Von Heijne matrix score 11.6999998092651 seq VLLLLLLVEQAAA/LG
  misc_feature 384,419: n=a, g, c or t
ctctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagttttatgggcctgagcaccaggaatcaggagacttacgagactctgaagcatgagaaaccaccacagtagctttagaatagatgcggtcatattcttctttggcttctggttcttccagccctcatggttggcatcacatatgcctgcdtgccattaacaccagckggccctacccctatnatgatcctgtgtcctaaattaatatacaccagttngttcctcctccctgttaaagactaatgctcagatgctgtttacggatatttatattctagtctcactctc

SEQ ID NO: 1350 - DNA, 509 bp, Homo sapiens
  CDS 132..443
  sig_peptide 132..245: Von Heijne matrix score 11.6000003814697 seq GLLLLQAVSWASG/AR
  misc_feature 383: n=a, g, c or t
tcttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgaagggtaagcatcatggctggcagctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcakkggncgacggatggagctgagtatggggcccatccaggctaatcaacgggcacaggcctgctactgaccctgcagccagaacagaagttccaaaaagtgaagggatttggagggggccatgacagatgct

SEQ ID NO: 1351 - DNA, 262 bp, Homo sapiens
  CDS 14..163
  sig_peptide 14..103: Von Heijne matrix score 11.5 seq ILLLPLWLSGLLA/SF
atttttcctccagatgtctgcttcccccacccctgaaccgttccttggcttccccatgccggaaatcctacttttacccctttggctgtctgggctactcgcctctttcggtaacttcaccctaggccttaagctcccggtagctgctcgccatgcggcgccctgaagcgtgaaccttcgtgggtcgcctctcggctgcttgggcgctccggttctgttgctttgtggtcccggggccaggccctgagtcgagtgcacctgt

SEQ ID NO: 1352 - DNA, 452 bp, Homo sapiens
  CDS 57..215
  sig_peptide 57..98: Von Heijne matrix score 11.5 seq SLFGLLLLTSALA/GQ
agtcgctgcttccaaagtgcccgccgtgagtgagctctcascccagtsmgagccaaatgagcctcttcgggcttctcctgctgacatctgccctggccggccagagacaggggactcaggcggaatccaacctgagtagtaaattccagttttccagcaacaaggaacagaacgatgacctgccgctcttcttaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtgg

SEQ ID NO: 1353 - DNA, 477 bp, Homo sapiens
  CDS 169..423
  sig_peptide 169..252: Von Heijne matrix score 11.3000001907349 seq SVLAGLLLGACQA/HP
  misc_feature 207: n=a, g, c or t
aaaaaaaacaagggtgttctgtcagctgaggatccagccgaaagaggagccaggcactcaggccacctgagtctactcacctggacaactggaatctggcaccaattctaaaccastcagcttctccgagctcacaccccggagatcacctgaggacccgagccattgatggactcggacgaraccgggttcgagcactcagggctntgggtttctgtgctggctggtcttctgctgggagcctgccaggcacaccccatccctgaytccagtcctctcctgcaattcgggggccaagtccggcagcggtacctstacacagatgatgcccagcagacagaagcccacctggagatcagggaggatgggacggtggggggcgctgctgaccagagccccgaaagtstcctgcagctgaaascttgaagccgggagttattcaaatcttgggagtcaagacatccaggttcctgtgcc

SEQ ID NO: 1354 - DNA, 511 bp, Homo sapiens
  CDS 183..398
  sig_peptide 183..251: Von Heijne matrix score 11.1000003814697 seq LFLLLLFLRRSLT/LS
atttctagttgccttcagtcacagcggggtggccaggggcgagtcacttaagcctccccaaggctcagtttcctcctttgtaaaagagggagaattatagtactcactgcctgcagttagttgtttggaggataaatgcaaaattcttcactgggagtctggcataaaacagcactccgcaaatgtctgttgatcttattattatagaattattatttttattattattatttttaagacggagcctcactctgtcgcccaggctggagtgcagtggtgagatcttggctcactgcaacctccgcctcccgggttcaagcaattctcccgcctcagcctcccgactagctgggattataggcacctgccatcatgcctggctaatttttgtatttttgtagaaatggggtttcaccatgttggccaggctggtcttgaactcctgacctcaggtgatccacctgccttggcctyccaaagtgctgggattacaggcatgagccaccgtgcc

SEQ ID NO: 1355 - DNA, 619 bp, Homo sapiens
  CDS 133..417
  sig_peptide 133..213: Von Heijne matrix score 11.1000003814697 seq LTSLLILVTLISA/FV
atttccagggagctgaggagctgagggcagagctagcttttggttatttgggatgttattgccagtttcctcccagggccattgttaccacctgatcatttgagttttagtttctctagcagatgctgactaatgactgaccaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcataatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgtta

SEQ ID NO: 1356 - DNA, 1108 bp, Homo sapiens
  CDS 310..906
  sig_peptide 310..357: Von Heijne matrix score 11 seq FPLLLLSLGLVLA/EA
atacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcaattttgggtgtcaccaggtaaacagagccctcagcatctgaatagaaactgaacaggaacagaagagattcactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaawcagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgaaaaaaaaaaaaaaatgcgaa

SEQ ID NO: 1357 - DNA, 380 bp, Homo sapiens
  CDS 39..212
  sig_peptide 39..173: Von Heijne matrix score 10.8999996185303 seq VRLLPLLLALAWA/RR
aatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggcctgggctcggcgttctacaccatttggagcggctggcaccgcagactgaggagctgccgctgggccgggagctgcgggtcccattgatcggaagcctccccgaagcccggctgcggagggtggtgggacaactggatccacagcgtctctggagcacttatctgcgccccctgctrgttgtdcgaaccccgggcagcccgggaaatctccaagt

SEQ ID NO: 1358 - DNA, 523 bp, Homo sapiens
  CDS 176..421
  sig_peptide 176..268: Von Heijne matrix score 10.8999996185303 seq LLLALSRAHLCWA/FS
ttgcttctccctttctgcggccttcgccagcccaggctcggctgccacccagtgsacagaaccgaggagctgccattaccccccataggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttatgctgggcctttagcctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaatttgtaatatt

SEQ ID NO: 1359 - DNA, 518 bp, Homo sapiens
  CDS 70..354
  sig_peptide 70..117: Von Heijne matrix score 10.8999996185303 seq PLLLALLFGAVSA/LH
aaaaagaaggacctgggctttgggaagatctaaagacccaggaaggtctctgggtgggataaagccaagatgaaactccccytacttctggctcttctatttggggcagtttctgctcttcatctaaggtctgagacttccacctttgagacccctttggtgctaagacgctgcctgaggatgaggagacaccagagcaggagatggaggagaccccttgcagggagctggaggaagaggaggagtggggctctggaagtgaagatrcctccaagaaagatggggctgttgagtctatctcagtgccagatatggtggacaaaaaccttacgtgtcctgaggaagaggacacagtaraagtggtgggcatccctgggtgccagacctgcgctacctcctggtgagaagtcttcagacgtttagtcaagcttggtttacttgccggagtgctacaggggcaactggtttccatccacaacttcaatattaattatcgaattccargtgttctttcagcg

SEQ ID NO: 1360 - DNA, 486 bp, Homo sapiens
  CDS 21..404
  sig_peptide 21..89: Von Heijne matrix score 10.8000001907349 seq ALALLSAFSATQA/RK
agacgtgagcagagcagataatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcasaactgaagccctacacgatggatctgatggagcaggtggccctgcgcgtgcargagctgcaggagcagttgcrcgtggtggggga

SEQ ID NO: 1361 - DNA, 822 bp, Homo sapiens
  CDS 264..701
  sig_peptide 264..317: Von Heijne matrix score 10.6999998092651 seq VCLLSCLLPSSEA/KL
gacatcttgagctgaagcagggttttgagccactgctgctgctgctgccattgtcaccatggtctcagctctgcgggagcacccctgatcagggtgcactcaagccctgtttcttctccttctgtgagtggaccacggaggctggtgagctgcctgtcatcccaaagctcagctctgagccagagtggtggtggctccacctctgccgccggatagaagccaggagcagggctctcagaaggcggtggtgcccagctgggatcatgttgttggccctggtctgtctgctcagctgcctgctaccctccagtgaggccaagctctacggtcgttgtgaactggccakagtgctacatgacttcgggctggacggataccggggatacakcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaaaaaaaaaaaaaaatgcgaa

SEQ ID NO: 1362 - DNA, 642 bp, Homo sapiens
  CDS 53..526
  sig_peptide 53..103: Von Heijne matrix score 10.6999998092651 seq VLMLLAVLIWTGA/EN
acttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtt

SEQ ID NO: 1363 - DNA, 469 bp, Homo sapiens
  CDS 137..454
  sig_peptide 137..187: Von Heijne matrix score 10.6999998092651 seq VLMLLAVLIWTGA/EN
atcctgtgaactacccaaaaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtaagaacagtgattgtctgtaaaaaatactgcatgttttgtcagacttttatgcctagtattaaaattgtcttttaaaaaaaaaaaaaa

SEQ ID NO: 1364 - DNA, 489 bp, Homo sapiens
  CDS 103..255
  sig_peptide 103..222: Von Heijne matrix score 10.6000003814697 seq LLLYLSAVGYCFA/QK
accctcactccctacctgctgccccttactgagcccatcactggcttctgagctacaacattcccctttctaaagacaagcccaatccattgagcaaagtgaatgactgaacctgttaaaaacaaaaggaacagtagaatgttcatcaagtccttcaagctccgtgagaaagagtttggattactactgctatatctgtctgctgttggatattgttttgcacagaaaagtttctccatcaaagctgttgtctattaattgtggaattagaacagattatacttaagatccatttcttctactggtccctagaaatctgtctgattacttctgcatcacccagctgacaaatatttatgtgtagtattgctgtcacctgttttataacattttttttaacttgagacctactttcaatagtcactatgttttctctgtgcctttctggttcatcgttaccacacatacatgggatgacccctacatctg

SEQ ID NO: 1365 - DNA, 567 bp, Homo sapiens
  CDS 230..400
  sig_peptide 230..340: Von Heijne matrix score 10.5 seq LLLALFSAHLSTC/SR
aacgtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaaaagacacattcatcattttattgtattttctcaactttagaacagttttcaaacatgtggaaacgttggaagaattttatagcaagcaccctttgccccatcaccgagactctcccagcacatcttcttctgcttgctttatttagtgcacacctatccacctgttccagagatcaccactgcggcagtgggttctcaaaggagaaccttccaaccttcccgcattgagaaagaaaaatatcagttttactaaatgaaatatcaacattggagattttataagccgagaatgttagtacatcaacattagaagccctaaaagataaaattgcattcaaaggccaaaaaagtcttaggcttgctagctctccaggaaaggcctgtgtgttcag

SEQ ID NO: 1366 - DNA, 639 bp, Homo sapiens
  CDS 185..613
  sig_peptide 185..229: Von Heijne matrix score 10.5 seq LLLWACIVCVAFA/RK
taggtatacagacagtagttaaatagcagggccaactattctgttaagggtcttcctagacagactaaaaaagccatgtattctttcgtttctctctaaaagaagaaaaatataatttaaaaatacattgcgtattttctaaaacaataaatttatagtgttaatattcatagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctscccacctattgcagctgagcctgctgcagctgcacctcttacagccacacctgtagcagctgagctgctgcagggggcc

SEQ ID NO: 1367 - DNA, 487 bp, Homo sapiens
  CDS 61..267
  sig_peptide 61..120: Von Heijne matrix score 10.3999996185303 seq VLFGLLLVLAVFC/HS
  misc_feature 147: n=a, g, c or t
agaagcggctcgaggctggaagaggatcctgggcgccgccaggttctgtggacaatcacaatgggaatccaaggagggtctgtcctgttcgggctgctgctcgtcctggctgtcttctgccattcaggtcatagcstgcagtgcthnactgtcctaacccaactgctgactgcaaaacagccgtcaattgttcatctgattttgatgcgtgtctcattaccaaagctgggttacaagtgtatacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggct

SEQ ID NO: 1368 - DNA, 498 bp, Homo sapiens
  CDS 118..399
  sig_peptide 118..363: Von Heijne matrix score 10.3000001907349 seq IILCSMFVSEVFG/GV
aacaattcatgaagttgaagaaaagacactgtcagaaatgaacacagaagcggasaacagcttctccatcacgccagaaatggcaatgctgaagaagtaagacaactattagagaccatggcgagtaatgaagtgattgctgacattaattgcaaaggaagaagtaagtctaacttgggctggacacccctacatctggcatgctattttggacacagacaagtggtccaggatctgttgaaggctggtgcagaagtgaatgtgttgaatgacatgggagacacgccgcttcatcgagctgcctttacaggacgaaaggtgaaaatcattctatgttcaatgtttgtaagtgaggtatttggaggagtagttaccattgttttctctgttataaccatctgaccagcaaccgagaaagccacacaaaaaaatgtatacaccagcactttgggtcaaaggccacaggatcttttgagtctgacagtgaggtccagtact

SEQ ID NO: 1369 - DNA, 617 bp, Homo sapiens
  CDS 87..329
  sig_peptide 87..134: Von Heijne matrix score 10.1000003814697 seq LLLQLAVLGAALA/AA
acctctctggcggsggggccgggtcgcgcgggcgcgttccgcctgtgtggaggtgcgggattgggcgggctgccacggcatggagaatggctccgcttctgttgcagctrgcggtgctcggcgcggcgctggcggccgcagccctcgtactgatttccatcgttgcatttacaactgctacaaaaatgccagcactccatcgacatgaagaagagaaattcttcttaaatgccaaagccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagcacaaagtttccagatgttgagaattagaaaag

SEQ ID NO: 1370 - DNA, 452 bp, Homo sapiens
  CDS 99..281
  sig_peptide 99..155: Von Heijne matrix score 10 seq LWLALVSCILTQA/SA
atggctggccagaggaggaacgctttgtgttctcatcggagctgcatgggaagtctgcatacagcaaagtgacctgsakgcytcaccttakggaaaggatggtgggctctggcctcctgtggctggccttggtctcctgcattctgacccaggcatctgcagtgcagcgaggttatggaaaccccattgaagccagttcgtatgggctggacctggactgcggastcctggcaccccagaggctcatgtctgttttgacccctgtcagaattacaccctcctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttc

SEQ ID NO: 1371 - DNA, 511 bp, Homo sapiens
  CDS 208..429
  sig_peptide 208..309: Von Heijne matrix score 10 seq FLCLLSALLLTEG/KK
acagtacctcacaggtctcttcccccgagcagtgcattgctggagcgaggagaagctcacgaatcagctgcaggtctctgttttgaaaaagcagagatacagaggcagaggaaaagggsactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaascaaaatgccctgccgtgtgtacttgtaccaaagataatgctttatgtgagaatgccagatccattccacgcaccgttcctcctgatgttatctcattatcctttgtgagatctgkktttactgaaatctcagaagggagttttttattcacgccatcgctgcagctcttgttattcasatcgaactc

SEQ ID NO: 1372 - DNA, 514 bp, Homo sapiens
  CDS 316..495
  sig_peptide 316..447: Von Heijne matrix score 10 seq LCLLIPSCHLSLG/SN
acacacgctctraggctttcaacagcggggcsccagggacaaacaagcgcggcaagccaaacagcctgctcaaacagggacggccagggtgttgtttgaccagcactggaattggaaactaggtttcgaagaagtcaaatcgaagtacaatattgtattttaaactgcctgttgttattacatccctcacaacgcacgctctacttgaaacttccagtggataccaactgcacttagaataaaaaatgaaactccttgcctaactctgggacctcatcagcacatactcaccatattttggtaacaaaggccttcatgctgttcccggaagtcgccaagttccatccatcattgttaataattccttttgctcgctcctcgcacaagaactgtttcttctgctcagtgctttgcctactgattccatcttgtcatttaagtctcggctcaaatgtcacctctgcaaagaacccttgtctgaccatacatctaaaatagccacaaacactctata

SEQ ID NO: 1373 - DNA, 453 bp, Homo sapiens
  CDS 32..277
  sig_peptide 32..121: Von Heijne matrix score 9.89999961853027 seq LLFGFTLVSGTGA/EK
acacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgcaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaagttctgcctgg

SEQ ID NO: 1374 - DNA, 514 bp, Homo sapiens
  CDS 99..356
  sig_peptide 99..167: Von Heijne matrix score 9.80000019073486 seq FLLFFFLFLLTRG/SL
ttttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgccggagaaggggtccgagggcagtctgtgtcaaacgcagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcaaaaaaaaaaaaaaw

SEQ ID NO: 1375 - DNA, 490 bp, Homo sapiens
  CDS 215..457
  sig_peptide 215..313: Von Heijne matrix score 9.80000019073486 seq LLVFSFILAAALG/QM
ctctctctctctcttttactcttaytctttctctctcactctctctcttttcccacccttaagccaagtacagggatagttgtctcatcattggtggcttaaaatgatgtttttgaacaagaagacrccccatggcctctaggtgctgtgctgtcctgaggcctgggccatggtgcccaaggaaagcccctgaagctcaccaggaggaagaagcatgcagggcacycctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggccagccaggcccagcctccctgtggatatgagagttcctttctctgaactgaaagacatca

SEQ ID NO: 1376 - DNA, 476 bp, Homo sapiens
  CDS 56..355
  sig_peptide 56..211: Von Heijne matrix score 9.69999980926514 seq ILHLLLLSPFSVG/LV
aattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcgtgctattctgcacctgttgctgctgagccctttctcagtgggactagttcgaactatgtggaggagatgtactgtgcttggctggaaaaccccaaaagtgtacataagacagggtcccactgttgtccaggctggagtgcagtggcgggatctcggcttgctgcaacctccgactcctgggttcaagtgattcttatgcctcagcctcccgagtaactgggactacaggtgcacgtcaycacgcctgactagtttttgtatttttastagagatgggattttactttgttggccaggctggtcttgaa

SEQ ID NO: 1377 - DNA, 487 bp, Homo sapiens
  CDS 53..247
  sig_peptide 53..106: Von Heijne matrix score 9.69999980926514 seq FISLLFLFSSAYS/XG
ctccgtttgtcctagcttttctcttctgtcaaccccacacgcctttggcacaatgaagtgggtaacctttatttcccttctttttctctttagctcggcttattccarggggtgtgtttcgtcggagatgcacacaagagtgaggttgctcatcggtttaaagatttgggagaagaaaattttcaaagccttggtgtttgattgcctttgctcagtatcttcagcagtgtccatttkcaagatcatgtaaaattagtgaatgaagtaactgaatttgcaaaaacatgtgttgctgattastcagctgaaaattgtgacaaatcacttcataccctttttggagacaaattatgcacagttgcaactcttcgtgaaacctatggtgaaatggctgactgctgtgcaaaacaaaagcatctcagcctaccatgacgaataagagaaagaaaatgaagatcaaaagcttattcatctgtttttctttttc

SEQ ID NO: 1378 - DNA, 511 bp, Homo sapiens
  CDS 201..491
  sig_peptide 201..290: Von Heijne matrix score 9.60000038146973 seq LFLLWLLICYALS/LE
attttacctggcccctactcaagatggggttgctctggttcaaacgcctctgacagggtgacaactgtgaccacaacagattcacaaacatgacattttcagagagaggaagcctcccctgctcttagtctatgtgattcggacacagccaactacattccccagatccagaaaagaacacgccattccaagtaaagccaatgagagacagctgcaggacttttgctggaactattgggaaagtggtgtttctttttctgctatggttacttatctgctatgctctaagcctggaactgctggaggtcatctttgctgcaaaaatgaagtcaatattgaggacagcagagatgtggaccctgagaccagggaggttgcgtggcatcattacatcagaaggggagtggtctgaatccactcctccccttccaggcaggaagtcaacagagaaggggctctgtggtggttgtgctcacccgcatcaaggttgctaagctgctgtgatggaatc

SEQ ID NO: 1379 - DNA, 570 bp, Homo sapiens
  CDS 189..452
  sig_peptide 189..257: Von Heijne matrix score 9.60000038146973 seq ILLVLGASLLTSG/LE
aagagaatgccaagcccggggagaaggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagargaagccatgggaacccctcgtatccagcatttgctgatcctcctggtcctaggagcctccctcctgacctcgggcctagagctgtattgtcaaaagggtctgtccatractgtggaagcagatccagccaatatgtttaactggaccacagaggaagtggagacttgtgacaaaggggcactttgccaggaaaccatactaataattaaagcagggactgagacagccattttggccacgaagggctgcatcccggaagggaggaggccataacaattgtccagcactcttcacctcccgtcctgatcgtgacctcctacagtaactactgtgaggattccttctgtaatgacaaagacagcctgtctcagttttgggagtcagtgag

SEQ ID NO: 1380 - DNA, 475 bp, Homo sapiens
  CDS 113..346
  sig_peptide 113..202: Von Heijne matrix score 9.60000038146973 seq GLCLCLLSHPLHS/SV
tacaatttattatattacattagattatattaaaataatgttttatggagaaggaaatacaattaaagagctcctcctcattgagtgttagcacagtgstaaagtgccggggatgacagtgctgcactggcgggccacagagggcagcttgctaaacccttcagggctgtgtctctgtcttctctctcatcccctccacagcagcgtcctccccagggatcctaggttcagccagagacttgttattcaacagaccaggtcctgtctgcccctgtggcatataaggtttgctctcctggaatgcccttttctccctccacacagcactggatcgcagcatctcaattagccctttccgtgtgttcccatttctctatttgcccatctcccccggtgaactgtgagcttcccatgagactgtatcttattcatcctgtgcttagcccagtgcttagctcagtaaatgtttgtggaa

SEQ ID NO: 1381 - DNA, 470 bp, Homo sapiens
  CDS 183..434
  sig_peptide 183..248: Von Heijne matrix score 9.60000038146973 seq ILLVLCIFIQSSA/LG
aaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggatggttacagaggaaggaagaaagccaccaaggccaatttgaagatgtgcagaaacccagaagtgaggatcgtgagtgctttgaaggcagagagaggctgggccttagtacagtctgtttgcagcacatggcatatagtggatgctggagaaatgttgatgactgaattgacatgattgattgattggatcaaatgaat

SEQ ID NO: 1382 - DNA, 579 bp, Homo sapiens
  CDS 40..246
  sig_peptide 40..90: Von Heijne matrix score 9.5 seq FVFLLFVISLAAA/AH
aaaaagtaggacaccggagctagcagtggcaacccacttatgtttcctggctttgtttttttgctctttgtaataagtcttgctgctgctgctcatctttgggtcctggccgcctttatgggccgtatcaccgtgaaggtctgcagcttcactcctgaggccagcaagaccgtgagcccaccagaaggagcgaacaactcgagacgcactgcttttaagagctgtaacactcaccacaaaggtctgtagcatcactcctgaagtcagcgggaccacgaacctaccagaaagaagaaactccatacagatctgaaaatctgaaggaacaaactccggacacaccatctttaagaactgtaacactcactgcgagggtccacggcttcatttttgaagtcagccagaccaagaacccaccaattccgcacacacttctgctgtttcgttccattctcaaggaaaactgtgatgggtccatttttaatcacatgcaaattcatgggcaaatctttgctatggttatgtactttgatttagtagagttgtatcacatgttcactcatgtgcccacaatagcag

SEQ ID NO: 1383 - DNA, 362 bp, Homo sapiens
  CDS 10..216
  sig_peptide 10..60: Von Heijne matrix score 9.5 seq FVFLLFVISLAAA/AH
  misc_feature 140: n=a, g, c or t
aacccacttatgtttcctgghtttgtttttttgctctttgtaataagtcttgctgctgctgctcatctttgggtcctggccgcctttatgggccgtatcaccgtgaaggtctgcagcttcrctcctgaggccagcaagwncgtgagcccaccagaaggagcgaacaactcgagacgcactgcttttaagagctgtaacactcaccacaaaggtctgtagcatcactcctgaagtcagcgggaccacgaacctacccagaaagwaagaaactccatacagatstgaaaatctgaaggaacaaactccggacacaccatctttaagaactgtaacastcastgcgagggtccacggcttcattt

SEQ ID NO: 1384 - DNA, 902 bp, Homo sapiens
  CDS 218..457
  sig_peptide 218..286: Von Heijne matrix score 9.39999961853027 seq SLLFICFFGESFC/IC
acaatgatcatcactgtatcctttgctgggcatattttgctgactggcaaggttatatgaagtgcttttattgaagcaccattttaactaatagctcctggtattttctgcttcccttcgtagggaatttagttattttattttattatttagctaatttagctattktaaaatagctaaaattttagctactttttttttcaattgacaaagaaggatgtctaatcaaagactaccgctgattttttctctgttgtttatctgcttcttcggggagagtttctgcatttgtgatggaactgtctggacaaaggttggatgggagattcttccagaagaagtacattattggaaagttaagggttctccatctcactgcctgccttatcttctggataaactatgctgcgactttgctaacatggatatatttcaggggttgtttatatctcatttataatttattacaagctgtcttcttcgtctgatktgkttkgtctgtgcattacctgtggaagaaatggaagaaacacccaaaaaaagctgaaaaagcaagcctccttagaaaaacctggtaatgatctagaaagcccattgatcaacaacattgaccaaacactccacagagtgcaaccacagcatcagtgatatacaagatctgggagcacaggtctcaccatccttcctctaagaaaattaagcactgcaaattaaagaagaagagtaaagaagaaggagccagaagatactaaataaatgcatatgcaaatgtagcttagtcaattatagatatcacaaaagaaatctatcatctaaggattaaaaattgttctttggaaacctttataaactttttgccacaatctttactaaaattttccaaaaaaaaaaaaaaatgcgaa

SEQ ID NO: 1385 - DNA, 504 bp, Homo sapiens
  CDS 42..440
  sig_peptide 42..122: Von Heijne matrix score 9.30000019073486 seq IICIFLFLSLAEG/MP
acaatttatgtgtttagtgtagtttgcagwgttcccttattatgttttgctgtgtgatatgccctgtttcatttctgatattgataatttgtatattcttatttctcagtcttgctgaggggatgccgattttattaatcttttcaaatacgcatgttgttcatcgatttctccctgttgtgctgttttcatttttgcgtacttgtgctcttattttctttctcttctgctttaggctgattttgctcttcttactcttgttttttgatattagacctttgattatagatttgagacttttcctcttttctagtttatacatttattgctattacttttgctgtgagcactgctgtagctgtgtcccacaaattttgatatgtggtattttcattttcattcactccaatttctttttctttcacttgagacttcctctttgactcattaattatttaggagtgtgttaattagtttccaagtgtttggagattttcctgttah

SEQ ID NO: 1386 - DNA, 372 bp, Homo sapiens
  CDS 70..252
  sig_peptide 70..123: Von Heijne matrix score 9.30000019073486 seq AALLVTFLAGCRP/RW
ctactcagccccagcggaggtgaaggacgtccttccccaggagccgactggccaatcacaggcaggaagatgaaggttctgtgggctgcgttgctggtcacattcctggcaggatgcaggccaaggtggagcaagcggtggagacagagccggagcccgagctgcgccagcamccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggamaactgaccccg

SEQ ID NO: 1387 - DNA, 508 bp, Homo sapiens
  CDS 37..429
  sig_peptide 37..84: Von Heijne matrix score 9.30000019073486 seq LFVAIFAVPLILG/QE
cttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataa

SEQ ID NO: 1388 - DNA, 492 bp, Homo sapiens
  CDS 37..474
  sig_peptide 37..84: Von Heijne matrix score 9.30000019073486 seq LFVAIFAVPLILG/QE
cttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggaagaaggctgctatgactctttggatgggagtctggcaagaggaaattggaagataaaataaataataagtgaaaaa

SEQ ID NO: 1389 - DNA, 613 bp, Homo sapiens
  CDS 56..601
  sig_peptide 56..103: Von Heijne matrix score 9.19999980926514 seq LLALLTELGRLQA/HE
aacgctgctcaacggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactaga

SEQ ID NO: 1390 - DNA, 467 bp, Homo sapiens
  CDS 97..381
  sig_peptide 97..150: Von Heijne matrix score 9.19999980926514 seq VFLCSLLAPMVLA/SA
  misc_feature 1..2,83: n=a, g, c or t
nnccaccgccctgcccccagccccgccactcccaggctcctcgggactcggcgggtcctcctgggagtctcggaggggaccgnctgtgcagacgccatggagttggtgctggtcttcctctgcagcctgctggcccccatggtcctggccagtgcagctgaaaaggagaaggaaatggacsmttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctgggaacctgaggcggctgcttgaacctttggatgcaaatgtcgatgcttaagaaaac

SEQ ID NO: 1391 - DNA, 803 bp, Homo sapiens
  CDS 142..354
  sig_peptide 142..204: Von Heijne matrix score 9 seq HGLCLLLLCQATG/RI
aacgggtgaaaataattttctaaatgctgcaaaagctgaatatttcaagtagtttctggttatatcaaaatggaatagagaaagaaaagctaaagattacttgatttagaagcagccagagagcacctggcccaacaaccgatgagaaatctttcgagtaatctacatggtctctgcctattgctcctttgtcaggcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttggataacttgctccattggctggctgaggagctctcagaagaaaatgctgagtctctttcctcaactctccctctgcgccgtagcaccattcagctcatcaaactcaagaccctgatgatctcacagaacagatcacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactaaaaaaaaaaaaaaatgcgaa

SEQ ID NO: 1392 - DNA, 540 bp, Homo sapiens
  CDS 322..483
  sig_peptide 322..363: Von Heijne matrix score 9 seq FFSFSLLLLLSFG/IF
ttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatctyttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaa

SEQ ID NO: 1393 - DNA, 498 bp, Homo sapiens
  CDS 198..482
  sig_peptide 198..269: Von Heijne matrix score 9 seq LLLGPGLLATVRA/EC
agaaatcagccctttgcagagggcgcagagggcctggaaacctctgggaccttttcccaggaactgtttatggtttccccctaggtctaggagacgtagatgcataggtggattggatacatcgatggtagctataagagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaagagctcctgcagctgtccaaaccagatcttcctcaagatggcaccagcaccctcagagaaaatagcaaaccggaagaaagccatttgctagcaaaaggtatggg

SEQ ID NO: 1394 - DNA, 223 bp, Homo sapiens
  CDS 7..162
  sig_peptide 7..66: Von Heijne matrix score 9 seq VCACVCLCACVCA/CV
catgtgatgtgtcttgtgtgtgtgtctgtgtgtgcatgtgtatgtctgtgtgcatgtgtgtgtgcatgtgtgtctgtgcgtgtgtgtctctgtgtgtctgtgtctgtgtctgtgtgtgcatgtgtgtgtctgtgtgtctgtgtgtctacgtgtgtgtgtgtgtagacgtgggggggggtgtgcactttatttcctcacgtgcccccgctgcctccagcaagag

SEQ ID NO: 1395 - DNA, 340 bp, Homo sapiens
  CDS 55..297
  sig_peptide 55..99: Von Heijne matrix score 8.89999961853027 seq FTTLLFLAAVAGA/LV
attccccagaccttctgcagattctgtggttatactcactcctcatcccaaagaatgaaatttaccactctcctcttcttggcagctgtagcaggggccctggtctatgctgaagatgcctcctctkacwtcgacggkygcctgatcctgcccaggaagctgggacctctaagcctaatgaagagatctcaggtccagcagaaccagcttyacccccagagacaaccacaacagcccaggagacttcggcggmagcagdwcaggggacagccaaggtcacctyaagcakgcaggaactaaacccccctgaaattccatwgtggagaaaagtatccttact

SEQ ID NO: 1396 - DNA, 510 bp, Homo sapiens
  CDS 90..326
  sig_peptide 90..170: Von Heijne matrix score 8.89999961853027 seq CLLLFGSVPSLRA/VT
aagaaagggaacatgggcagggacaaataagggaataaaagctggccaccccagccagcagtggtaaccggtttgggtcctttttcgcaatgtggagtcttcgtccttttgctcttcccaaaaaaccttgctgcctcttactttttgggtctgtgccatctttaagagctgtaacactcaccgtgaaggtccgtggcttcattgatgaagtcagtgagaatcatgaagtcagccagagtactgccctggagggaatcgactgccagtttaaggagtcattgtccagttcagactccagaatacgaaacgtagaaactgacaggaaatgaccaagtataaattgcaacttgtaaagaatcatcttaaatcctggcactgcgttcaagggggagtttgagcaaggaatgttgctaaaacggctaaaaccaggaactcagaatatcgttctacaatagaacctaaaaactgtttccaacccatcacgacatcaccctgaaaaatgagtgagca

SEQ ID NO: 1397 - DNA, 493 bp, Homo sapiens
  CDS 76..273
  sig_peptide 76..123: Von Heijne matrix score 8.89999961853027 seq FLLSLPTPPSASG/HE
agttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcaggaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctc

SEQ ID NO: 1398 - DNA, 490 bp, Homo sapiens
  CDS 225..428
  sig_peptide 225..356: Von Heijne matrix score 8.89999961853027 seq VIMTSLLLCPATA/VI
attccagagccagcagcgcgtcctggccgctcctgcgctctcccgcctcccggggctcggaggagcggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtwatcatctatcgcatgcggactcatccgatccttagtggggctgtttgwgagcctcccaagagggccgggtgagggatgaggacaggcatcctatccccagcctcttcctgtcttcagaaaagcagcaggag

SEQ ID NO: 1399 - DNA, 477 bp, Homo sapiens
  CDS 111..371
  sig_peptide 111..290: Von Heijne matrix score 8.89999961853027 seq NLLLLAFHHDCEA/SP
acatctaggctgtatagtatatagcctatggcccctgggctacaaacctatacagcgtgctactgtactgagtactgtaggcaattgtaacacaatgatggagtctcgctatgttgcccaggctggacttgaactcctgtactcaagccatcctcccgcccctgcctcttgaagtgctgggattacagaacaagggggagtctccctgcacaagctctctctctttgcctgctgtcacccacctaagatgtaacttgctcctccttgccttccaccatgattgtgaggcttccccagccacgtggaactgttcaaatttccatctggtgtcatttttcttctacccgaagaattttcttgaatattccttatagcataggtctgctggcaataaattatcagttttggcttgtctgaaaattttttgttttgctttaattttttaaaccacttttttgagatataattgatatacaa

SEQ ID NO: 1400 - DNA, 428 bp, Homo sapiens
  CDS 40..189
  sig_peptide 40..138: Von Heijne matrix score 8.89999961853027 seq LCLLALSDSYASA/SR
cctgctgcctcttttattttattttttattttttttgagatggattcttgttctgtcactaggctggagtacagtggagggatctcggctcactgcaacctctgcctcctggctttaagcgattcttatgcctcagcctcccgagtagctgggattacagacatgcaccaccacacccagctaattttttaatttttagtagagacagggtttttgctgtgttggccgggctggtctcgaactcctgatctcatgtgatctgcccacctaggcctcccaaaagtgctgagattacaggcgtgasaccacggctgaccaatgacctgcagttttaaaaggaaatattttggtattattttattgaataacacttaaggaccccctttccacctaccgstccccccaccaagttcctgcataaatctcaa

SEQ ID NO: 1401 - DNA, 426 bp, Homo sapiens
  CDS 38..262
  sig_peptide 38..241: Von Heijne matrix score 8.80000019073486 seq WMLLLLWLPRLMP/CS
gtcggatagttggcgggtggttgagtaagcggtcgccatgtccgcggggagcgcgacacatcctggagctggcgggcgccgcagcaaatgggaccaaccagctccagccccacttctcttcctcccgccagcgscccaggtggggaggtcaccagcagtgggggaagtcctgggggcaccacagctgctccttcaggasccttggatgctgctgctgctgtggctgccaagattaatgccatgctcatggcaaaagggaagctgaaaccaactcagaatgcttctgagaaggtatttgaagttgaagggtctccactaattgcgaatttaatagttgttttgchgggcgcgggtggcttacgcctgtaatcccagcactttgggaggccgaggcggggtggatcacgaggtcaggagtttgagacc

SEQ ID NO: 1402 - DNA, 496 bp, Homo sapiens
  CDS 113..319
  sig_peptide 113..220: Von Heijne matrix score 8.80000019073486 seq LSFLLQLAALLGA/KE
aatgtttctgcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccctagatccagttttccccatttataacatttcacttagtccattttcggaaccagaaaattaacattggcataatgctattaactaaactacagaccttttttcaatttcgccagtttttccacacatattcatttagttgctggatacttttaattct

SEQ ID NO: 1403 - DNA, 524 bp, Homo sapiens
  CDS 10..504
  sig_peptide 10..99: Von Heijne matrix score 8.80000019073486 seq ALLLALGVERALA/LP
gaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaaggcaaaagracctttgcaataacactggggaccagaaatgtgtcctgagaatggatcttgtgtac

SEQ ID NO: 1404 - DNA, 484 bp, Homo sapiens
  CDS 101..442
  sig_peptide 101..142: Von Heijne matrix score 8.69999980926514 seq LVALALALIVAVA/SX
attcaatccggccgggtccgcgcgcaaggrgcagcgagcgagccacgtacgagtagtacgtgctgccgccaagctagtgccaatrgcgarggcggtggcgatgctcgtagccctrgccctggcgctgatcgtagcggtdgcgagcrcggrcrgcgcggcggcgcasagtgcagcgcggcgcactggcggcgtgcgccccggcgatcatcagcgggtcgccgcccacggcgtcgtgctgctccaacctgcrcgcgcaggarccgtgcttctgccagtacgcdcgcaacccggcgtacagcagctacatcaacagccccaacgcmcgcmgcacgctcacctcctgcggcatcrmmgtcccgagctgctagggcgctactcgtrcctcgtggtgtgggtgaataaaaagatgcatgtmgatctctgcttactgttatcgtatctgtagtacctcgtgtgatatgaacaatatggtattatttaccaa

SEQ ID NO: 1405 - DNA, 481 bp, Homo sapiens
  CDS 94..441
  sig_peptide 94..156: Von Heijne matrix score 8.60000038146973 seq FTMLLAMWLVCGS/EP
agttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggtctccgcgtgagatgatcagagatgaggggtmctcagctcggtmaagaatgtt

SEQ ID NO: 1406 - DNA, 769 bp, Homo sapiens
  CDS 155..340
  sig_peptide 155..292: Von Heijne matrix score 8.60000038146973 seq AVLLLILFAIVFG/LL
cttttcctctcaacagttgcttctttgagtcagggtgcagctctggtcacctggcggcctcttcagctcagccctccacaaagtgtgagcctgaaggaccaccctgaattgcccttgtaggacccagaacagcwaccagcagaatcagattctcatggaccaaytggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagcctggtgtcttcctttcccaccaggaaaaagtctagtaaaatactgtatctggcttagggttggtcagactagtaagatggggaggctggtctgagaccaattctggctccttgaccctattgtttttaggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctaaaaaaaaaaaaaaatgcgaa

SEQ ID NO: 1407 - DNA, 568 bp, Homo sapiens
  CDS 30..527
  sig_peptide 30..74: Von Heijne matrix score 8.60000038146973 seq PLLIICLLPAIEG/KN
actggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaaatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggagatgtbwcttttactggcaaaggaagaaggaggcagtaaagcaggaacagggcagcccgcatgtcttccagaagtga

SEQ ID NO: 1408 - DNA, 532 bp, Homo sapiens
  CDS 106..453
  sig_peptide 106..186: Von Heijne matrix score 8.60000038146973 seq IVLALGCVTGAPS/DP
acacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacacccatctctcttccttaatccctcc

SEQ ID NO: 1409 - DNA, 475 bp, Homo sapiens
  CDS 169..381
  sig_peptide 169..231: Von Heijne matrix score 8.60000038146973 seq FTLCLLLSEMASG/GN
acccttgactgtggcacctcccttcagttccgtcgacgaggttgtgcaatccaccagtcttataaatacagtgacgctccagcctctggaagcctctgtcagctcagcctccaaaggagccagcgtctccccagttcctgaaatcctgggtgttgcctgccagtcgccatgagaacttcctaccttctgctgtttactctctgcttacttttgtctgagatggcctcaggtggtaactttctcacaggccttggcacagatctgatcattacaattgcgtcasagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaarwamaaaaaaaaaaaggc

SEQ ID NO: 1410 - DNA, 552 bp, Homo sapiens
  CDS 180..362
  sig_peptide 180..248: Von Heijne matrix score 8.5 seq PLSLLLSLPKSLG/GC
tataacatgaccccagaccgacacttagggtaagtaggctgaggtgtctttttgtcccgggggcccccctggagctcaggacccttgcaggtgtcagggtgccagcccttgagtggccagcctggcagtgtctcccatgtcctgtgcggcctggagagcccccttcgttctgggcccaaatgcgcgaaggcacagggtccaggcaggggcctctgtccctccttctctctcttcccaagtctctgggtgggtgcctctgtctcggstcttccgaagtgtctgggtgggtgcctctgtctctcctctctcttcccaagtgtgctgcccacagcattttaccagctggctctttccagccagagtgacctaggaaggcggctgggcgtggtactggggtccagcttgtcacacccagccctgcaaccgtggggacagtgcatcgtggctcacacccccacccccgtgttccagagctgcctggattgacaagtgcmgccccaacctgctcatcacagagtccacgtacgccacgaccatccgtgactccaagcg

SEQ ID NO: 1411 - DNA, 470 bp, Homo sapiens
  CDS 241..402
  sig_peptide 241..351: Von Heijne matrix score 8.5 seq ILLKACLLLLASG/LH
actctttccttggctgctcaggtcataggtgctgtgatctagagacaaaatgttccttacactggcagatacttgcaaactaaggggaatgagcttccttctgaatgtttatgaaggagaggccactgtgtcatctgtcttagagctattggaatcctggatcattgtgggaaatgaaagatacttcgatggaatcagcagccattgatccaatgccaactccaagactggaacgtcgcaatgatagttccaaggcggaaatttgacgtaattcttttcgacacagttttacaggtctggatgcccattttaattcttctgaaagcatgcctyctccttctggcttcaggactccatctscagcctcttgatctaaaaataatccccaaaccaaaaaaaaattagatactatttcctcaaaattaggtattttaatcaaaaacatcttaacataaatacattattatcac

SEQ ID NO: 1412 - DNA, 475 bp, Homo sapiens
  CDS 69..356
  sig_peptide 69..179: Von Heijne matrix score 8.5 seq LLVLLLYAPVGFC/LL
aagagcccctgcgccgggcgcgaaaatggcggcggcggcgacggccgggcgctcctgaagcagcagttatgsagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggccsggcagaggactccggactccgggatcacagtgtcagggtcctcatttccaaccatgtgacacctttcgaccacaacatagtcaatttgcttascacctgtagcacccctctactcaatagtcccccagctttgtgtgctggtctcggggcttcatggagatgaataggcgggggg

SEQ ID NO: 1413 - DNA, 273 bp, Homo sapiens
  CDS 18..257
  sig_peptide 18..158: Von Heijne matrix score 8.39999961853027 seq LCLFFCLGCLVFA/LL
caagtgctctrgkkkacatgtcaaaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttsttttgkccagccttycttgattagccttcttyctcty

SEQ ID NO: 1414 - DNA, 504 bp, Homo sapiens
  CDS 140..472
  sig_peptide 140..211: Von Heijne matrix score 8.39999961853027 seq FVVFSLFLICAMA/GD
atttttttttcatatctgacatttctatgtcctatgacggtttcacagctatcctactttggagaagatgctggaaattcagagtttccgccagagaatatatgcctgaactaaaagaggaagtggtctataggagaaaatgaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtt

SEQ ID NO: 1415 - DNA, 583 bp, Homo sapiens
  CDS 95..346
  sig_peptide 95..139: Von Heijne matrix score 8.39999961853027 seq VLTPLXAAGLAQA/RP
caggggcagaacttccggccagcgcacgcatttttggcttcctgaccttgggctaacggctgaccgttttttttgtggtgtactccgtgccatcatgtccgtcctgacgccgctwvctgctgcggggcttgcacaggctcggcccggcggctcccagtgccgcggcgccaagatccattcggttggccgccggaggdggaagctttgggatcatgggaattggccgttgggctgtacctcctgctttcgtgacctttcctcctgccagcgggctgggatcctgtcacgacctggagacctacaakgaggccagagtgaagggggtccgttcgtgtccctcacactgtgaacctgaccagcccccaccgggcccatcctsggtcatgttaactgcatttggtggccgggcctcccctgggatcatgtcattcaatttccagtgcacctcttctggcaatcatgacctcttgatgtctccatgggtgaccctccttggggggtcactgaccctgcttgggtggggtccmcctttgtaaacaataaaaatctattttaaactttactccaaaaaaaaaaaaaaatg

SEQ ID NO: 1416 - DNA, 404 bp, Homo sapiens
  CDS 67..390
  sig_peptide 67..126: Von Heijne matrix score 8.39999961853027 seq AVVGCLLVPPAEA/NK
gggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcasaccaccaccatcaaggtcatcattgtcatctacctgtccgtggtgggtgccctgttgctctacatggccttcctgatgctggtggac

SEQ ID NO: 1417 - DNA, 420 bp, Homo sapiens
  CDS 56..217
  sig_peptide 56..133: Von Heijne matrix score 8.39999961853027 seq AAILLLTVPVAEG/VT
aaaactgaaaacagaacaaacacaaacacaaacagagaatcaacgaagaagaaaaatggtgaaggtgatgtgggtttccgttttagctctggcggcggcgattctccttttgacggtcccggtggcagaaggggtgacgtgctcgcctatgcagctggcttcatgtgcggcggcgatgacgtcatcttcgccgccatcggagggtgttgcacaaagctgagagagcagcagccatgcctttgtgggtacatgaggaaccctaccctccgccaatacgttagctcccctaacgcaaggaaagtctccaacagttgcaagattccttccccaagctgttaaggaaatgttaatcatgattaattagtgacaagtttcgctgattatagtggttaatgctggtcttatcttcgtcagtactac

SEQ ID NO: 1418 - DNA, 531 bp, Homo sapiens
  CDS 204..353
  sig_peptide 204..266: Von Heijne matrix score 8.39999961853027 seq LAISLSVVGAAWG/IY
gagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaargaacctggtcagcatcatcttctgtgaggctgtggccatctacggcatcatcatgggcaattgtcattagcaacatggctgagccctttcagtgccacagaccccaaggschtcggscmtcggaactaccatgcaggctactccatgtttggggctggcctcaccgtagcctgtctaacctcttctgtggagtctgcgtggg

SEQ ID NO: 1419 - DNA, 525 bp, Homo sapiens
  CDS 261..425
  sig_peptide 261..338: Von Heijne matrix score 8.30000019073486 seq SVLLLAIVLISWG/CI
agttcaagaacatcagacacgctcaacaaacacttgttgcttgactgatacattatggcgggcgggcaaggccccgatcacgtgataccgccccccaactccgggcggaagaggccagcgacagcttgcacgaagcgagtgggcgggcgctcgtgcccggctaaaagatggctgctggcgcctggcagccaccgcctgggaggttactgtaaggcccgcagctcccgccagctcccgcggactgctgccgcctccttaccatgaagccagtaagtcgtcgcacgctggactggatttattcagtgttgctgcttgccatcgttttaatctcctggggctgcatcatctatgcttcgatggtgtctgcaagacgacagctaaggaagaaatacccagacaaaatctttgggacgaatgaaaatttgtaactcttctggatttaattatctgaaaatacagttctttccctcatgcttatgtagatataaaaataaaattcataatgcaaaaaaaaaaaaaaaaagg

SEQ ID NO: 1420 - DNA, 490 bp, Homo sapiens
  CDS 57..320
  sig_peptide 57..251: Von Heijne matrix score 8.30000019073486 seq LLWFIHLVFVVLA/FL
acaggtccaggtggagaggccgggctggccagggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgcttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcamcaaggcatctcaagagacttgcgttgatgatacagtcctct

SEQ ID NO: 1421 - DNA, 539 bp, Homo sapiens
  CDS 243..467
  sig_peptide 243..437: Von Heijne matrix score 8.19999980926514 seq LEFLIQLVTVARG/CW
aaaaacttccgccgccggtccgccgcctccggaactaaacgsggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagtwctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatc

SEQ ID NO: 1422 - DNA, 520 bp, Homo sapiens
  CDS 68..334
  sig_peptide 68..253: Von Heijne matrix score 8.19999980926514 seq LISFLTLVQIAHA/NG
agttatgaagttctaaaagcaagtcttaatcaggaagtgtccttgatcaccaacggctcgcccaggcatgctggctctcttccacttccaccttccaccatgggatgacgcagtaagaaggccatcagtagatgccagtccctcaaccttgaactttccagacgcagaactttatgcctccattttcctctgctgcatggccccaggagagattttaattagctttctaaccttggtccagattgcacatgcaaatggtagaggatgcaacacccccgcttgtggagctgccgcttgtgtctggcatgaaaattcacaagaagagaggaaatactgaggagaaaatggcagattgtgtttgctgaatttgattgacgaagaagtcaccatgaaaatcacagtgaaccatttggaaagcaaactgccaaaaaaataatagttagtcatgctctcaggctggttgttttggctgttgtgggtttcttgcatttccagatgattgcaaagagctgtttctcaa

SEQ ID NO: 1423 - DNA, 476 bp, Homo sapiens
  CDS 33..218
  sig_peptide 33..212: Von Heijne matrix score 8.19999980926514 seq LLCPLSLWPGTYP/RR
gaacaagcgtccctgatccagaaggtgttcagatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacgtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtgg

SEQ ID NO: 1424 - DNA, 430 bp, Homo sapiens
  CDS 31..207
  sig_peptide 31..87: Von Heijne matrix score 8.10000038146973 seq LCPSLFSVSLCLC/LP
  misc_feature 229: n=a, g, c or t
ctcttggtatctggctctggttgtgtctgtatgactgtgttttggtctctatgtccctctctcttttctgtctccctgtgtctgtgtctcccccgtctctgtctctgggtctctctgtggccatctctgtcaccggtgtgtctcaccctgcatctctttgcctgtctttctctctgggtctctgcctcagcccttcctcatcactactgaacacaccccgtgaggktgnggtggggagcacccagaaaaaggaaggactttaagctcaatgtgtgtgcatgtgagggggtgcctgtcattgcacagcactctctgcaggacatccctccaccctggggagacacagggagggctggtttcagctgtagctgggtgcacagttgaggagggaggaaggagaaggggaaacaagaaaggaggggaaggtggc

SEQ ID NO: 1425 - DNA, 544 bp, Homo sapiens
  CDS 172..447
  sig_peptide 172..237: Von Heijne matrix score 8.10000038146973 seq SPGLLLLWTVAFA/AE
  misc_feature 522: n=a, g, c or t
aacacacttcaggcggcgctgcccctggccggcctggctggcgggtgggcactgccggggggccccactgccaagctatctacttctggcctccgtgctggagagtctggccggcgcctgtggcctgtggctgcttgtcgtggagcggascaggcacggcagcgtctggcaatgggmatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccagtgaacttgctgactgagaaggcaccttggaactctctggcctggactgttaccagttacgtcttcctcaagttcntccaggggggtggcactggcag

SEQ ID NO: 1426 - DNA, 670 bp, Homo sapiens
  CDS 454..615
  sig_peptide 454..564: Von Heijne matrix score 8.10000038146973 seq VLILILLLYSLRC/AM
tagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaatattatctgatgtttggagcttgagtatacagactgtaaatatagttcttgtatttgtactaattctgattcttttgctgtatagccttagatgtgcaatgcagacactatctaactgtgtgtggtaccttgcgtcacggagctgttagtgaacgaggtaaaaataataaaggtacagccagtgcaaaaaaaaaaaaaaaa

SEQ ID NO: 1427 - DNA, 429 bp, Homo sapiens
  CDS 43..225
  sig_peptide 43..117: Von Heijne matrix score 8.10000038146973 seq ATLLLVLCLQLGA/NK
amcamttyycytgggrmmmmwttscytyytgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagyactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaa

SEQ ID NO: 1428 - DNA, 325 bp, Homo sapiens
  CDS 18..314
  sig_peptide 18..131: Von Heijne matrix score 8 seq AFLQLCLLRQIHQ/IP
ttgccatcctccctagaatgagaatgcacagcaagcggcagacaatcacccggcattcggcatctctttcttttcacgcgctccctcgctccgcctttctccagctctgccttctcaggcagatacatcagataccttgtttatccatcttcagctccactctgagggcgcagacgcacgattccgggatcgggtgcaccacggcgaascaggcgggagacggcaggagcagctcaggtaaccaggggaagcttgcgtgcccacggagatgcagccgtggagctgtcgaggaaagacggtctggcttcagaatttaaaaaaaaaa

SEQ ID NO: 1429 - DNA, 540 bp, Homo sapiens
  CDS 210..386
  sig_peptide 210..329: Von Heijne matrix score 8 seq HFFLLGLWAVIRG/AA
aaccaccacccgcggccgccatggccggacgggctccctaagcccaacttttcaagaatagtcagtacaataagatataaatagaaacaacaaaaagttaaaaagcaggagaacgaaattaaggctcaacaccacatggaaactgccaaggcttgagacttgcagcatctgaagccacggcccaagctctacattggcccctttcatccatggctggagtggctgcaacctacggcaccaagcccctaagctgcagacagcatgggcaccctgggcttggccagraakrccactttttcctcctaggcctctgggctgtgatcagaggggctgctgtgaagacctctgacatgccctggagccattttccccattgtcttggggattaatatttgactccttattaattatgcagatttctgcaggcttgcatttctcctcagaaaattgatttttcttttctatcgcattgtcaggctgcaaattttctgaacttttatactctgctttcctaataaaactgaatgcctttaacagcaa

SEQ ID NO: 1430 - DNA, 495 bp, Homo sapiens
  CDS 206..355
  sig_peptide 206..256: Von Heijne matrix score 8 seq SLYLSLALRSCYS/KY
aaaagcttgtcaccccaaattccacagggtggtaaaaagttctcctgggtatcctgggtgggaatgtgtcccttttttatagtcttgtagcccaggttgctgttttttaatggggaaaaatggctattcagagagaaattcaggaattgacatgactcttattatttccttgtaggtaagtggggtgagggtggttcctgataaaatgtcatgtgattctctttaccttagtttagcactaagatcttgctactcaaaatatggcccatggatcagcagaattagcattacttgggtgctttttaaaaatgtgggctttcaagcacatcccataccaggtggtttgtatacaaattagagtttcagaagcactgacctaagagactgtctcccaatttaagcctgtatttgttatgtctgcttctgactaatcccaaaatttcagacagtagcctgccaccattcttttacttgcaccatgactggatttttcat

SEQ ID NO: 1431 - DNA, 592 bp, Homo sapiens
  CDS 10..273
  sig_peptide 10..90: Von Heijne matrix score 8 seq LCRLFLCSPLASS/WY
cagatccctatgggcagccacctttgccaggttttgactcctgccttccggttgtgcagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctag

SEQ ID NO: 1432 - DNA, 553 bp, Homo sapiens
  CDS 72..287
  sig_peptide 72..137: Von Heijne matrix score 8 seq LLTVILLLICTCA/YI
  misc_feature 64: n=a, g, c or t
agacgggacatgcagcctcttccgcctgagccccggaaggtgatgtggctgcggcatcgccggncctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaattattacattctgcaaatgttattctgttgtatc

SEQ ID NO: 1433 - DNA, 389 bp, Homo sapiens
  CDS 69..305
  sig_peptide 69..146: Von Heijne matrix score 8 seq LFVTSVLLCFIFG/QH
agacctgcgcccaccatctccctccaggcagcccttggctggtccctgcgagcccgtgggacagccagatggtcatcatagtcacggtggtgtcggtgttgctgtccctgttcgtgacatctgtcctgctctgcttcatcttcggccagcacttgcgccasagcggatgggcacctacggggtgcgagcggcttggaggaggctgccccaggccttccggccatagcaaccatgagtggcatggccaccaccacggtgtcactggaactcagtgtgactcctctgggttgaggtccagccctggctgaaggactgtgacaggcagcagagacttgggacattgccttttctagcccgaatacaaacacctggactcaaaaaaaaaaaaa

SEQ ID NO: 1434 - DNA, 500 bp, Homo sapiens
  CDS 17..259
  sig_peptide 17..112: Von Heijne matrix score 8 seq LSVCLIALLVALA/FV
ttccatagaatgggagatgtcaccagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaacctta

SEQ ID NO: 1435 - DNA, 510 bp, Homo sapiens
  CDS 218..418
  sig_peptide 218..361: Von Heijne matrix score 7.90000009536743 seq ICLLLPCLLPVLL/QM
ctaataaaaccagcagagccttgactattctggcctggcaagaaactcagatgagaaatgctatatatcaaaatagattagccctcgactacttgccagcagctgaatgaggggtctgcaggaaatttaaccttactaattgctgcctacacatagataatcaagggccagttgttgaagacatagttagagatatgacaaaactggcacacgtgccatgcaagtgtggcatggatttgatcctggggccatgtttagaaaatggttcccagcgctaagaggatttaaaactcttataataaaagttataatagtaataggaatctgcttactgctcccttgtttgctacctgtacttcttcagatgataaaaagcttcattgttaccttggttcaccaaaatgcttcagcacaagtgtaatatatgaatcactatcgatctgtcttgcaagaaaacataggtagtaaaaataaaagtgagactcccactattgagagtctcaaagtggg

SEQ ID NO: 1436 - DNA, 583 bp, Homo sapiens
  CDS 332..574
  sig_peptide 332..412: Von Heijne matrix score 7.90000009536743 seq ILGLFCCLPLAIP/AV
aatcccctgtggttggtgatcaaggaagagcatagtgccagacctaggwgccctcctgggaatgttccaggagggcagaagtaggaggaggagtgttagagtagaggggaaatgatgagagcagaaaggagagtctcgctctgtcacccaggctggagtgcagtggcaggatcttggctcacttcaacctccacctcccgagttctgcctcagcctcccaagtagctgggattacaggtccagtcactccacgcttgcagagtccaattaacaagagcaagttctggtagaaagaaggtgactttattccagagctcaggtgtttgaactgatgtctgatgaggatgaatccagcgactacctctgcctgtccatcctgggcctcttctgttgccttcccctagccatcccagccgtgatcttttcttgcctgacaaagaactacaataaatccagtgactatgagctggcagccaagacctccaaacaagcctactactgggccatcgcgagcatcactgtgggaatcttaggtaccatcttgtacacctacctgatatacttacttagattgtaaactgct

SEQ ID NO: 1437 - DNA, 497 bp, Homo sapiens
  CDS 229..429
  sig_peptide 229..276: Von Heijne matrix score 7.90000009536743 seq LLSFSVLWDYISG/QR
agcctaccgccctactgcgggcgctcccctgtctggggggtgcttggctgggtgtggagaaggatcaatcacagctgactcctcagaggtgacagcccctgcccccttaaaaacaagaaaagacctagcagtgtgaagccaaactgcacccccagccccggtgacatgagaaaaccgtgagcgctcagctgaggttcatcgttcatctccttcctgcttggaatcagaatgtcctcactgctgagtttctccgttttatgggattacattagtggacaaaggaggaagtcccagccggaaacacagaaaggatatggagaaaattattattctgcccctacagtttcggtgacccagatgggatctctgggacaccctgcctgctctacaattgggatccctggaaaagtgacagaatctggcaacagatgagtaagaaaggtcacttcctggcagacctcaggtatattggggacatcaagaaaagaataattcat

SEQ ID NO: 1438 - DNA, 336 bp, Homo sapiens
  CDS 77..247
  sig_peptide 77..139: Von Heijne matrix score 7.80000019073486 seq SVLIFCLLNLAIS/DR
  misc_feature 301: n=a, g, c or t
atctgagctagggaagaatgtgtattctgttgttggatgaagtagtctacagatgtcagttatatccagttgagtaatggtgttgttgagttcaacaatgtctgtactgattttctgcctgctaaatctggccatttctgatagaagggtaatgaagtctccaactataatagtgattcatctattttttcctcacagttctaccagtatttgcattgagaatttggtcactctgttattaggcacataagaatcctcagctgcattttgcattatttccagagttcttggttgtaatcantggatatacaggctgtggaagacttaccccatttc

SEQ ID NO: 1439 - DNA, 352 bp, Homo sapiens
  CDS 83..259
  sig_peptide 83..130: Von Heijne matrix score 7.80000019073486 seq PLLISGLSILALA/QL
cattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgataatgatgaataactgaagtgaagtgatggactccgatttggagagtagtaagacgtgaaaggaatacacttgtgtttaagcaccatggccttgatgattcactgtt

SEQ ID NO: 1440 - DNA, 587 bp, Homo sapiens
  CDS 254..529
  sig_peptide 254..418: Von Heijne matrix score 7.80000019073486 seq MVMLSVSLPSLSA/ER
ttcccgagggcggcacgagggctgggcggtggggtgcgggtgcccgggtgaggggcggastgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgagatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctsccsagtctggtgaagcttcctgtatggtccatgaccgtattccaccccaggctctgggaggctccctgagatgtgctgtccactaagcactgcacaaacaagcaatcaaattatgaataaacataataaatatcaaaaaaa

SEQ ID NO: 1441 - DNA, 343 bp, Homo sapiens
  CDS 39..284
  sig_peptide 39..158: Von Heijne matrix score 7.80000019073486 seq SLCLPSLPHLTLC/SP
acagtctcctgcccacagagcggaccagagatccacacatggctccaaatgagggagcctccttctctattgtgtcccctcccccaaccaagggccaaagccaccttccatttttttcctctttgtgccttccaagcctcccacatctcacactgtgctctcctgggccctacaaactggctcctgcctcagtttccctgtccagtttcttttgttgttgtttagtttttttttctgtggtaacatctaacgtaaaatttgctgtcttaactattttaactgtatagttcagtggtattaaatacattcataatgttatgctaccaccaaaaaaaaaaaaaad

SEQ ID NO: 1442 - DNA, 523 bp, Homo sapiens
  CDS 188..472
  sig_peptide 188..295: Von Heijne matrix score 7.80000019073486 seq CFVLLFFLRWSLT/XC
  misc_feature 20,444: n=a, g, c or t
atttctttttmtagtttttntttttttgttamtgagttttgagagttmtttatgtattctaggaggaagtascttatcagatagatgactcacaaatattttmtcctaatgtgtgscttgtmttmttattmtmttaatagtgmscttcagagagctcaagtgttaaatttttactattcattmttttatggatcatacttttggtatcatatctaaaaatctgtctaaaacgcsttgtmatggaggtgttattttatgttttgttttattattttttttgagatggagtctcactmamtgtgtsgmtcaggctggagtgmmgtggcgtggtcttggctcactgcaacctccacctcctgggttcgggcgattcttgtgcctcagcctccaaggaagttgggattgcaggcgtgcgccacgatgctcagctagtttttgtttttncgtgttggccaggctggtcttgagctactgacctcaggggattcacmtttccggcctcctaaggtgatgggattcaggc

SEQ ID NO: 1443 - DNA, 466 bp, Homo sapiens
  CDS 157..318
  sig_peptide 157..273: Von Heijne matrix score 7.69999980926514 seq FVLVIPALWEVRA/RG
ataactctgtgaggattctagcgatggagagcacggaacccagaaccacattgtctcaatgatatcatcaagttgaatcgaaaggaagggaagaagcagaattttccaagactaaatagaagactcctccagcaaagtggtgcccagcaattcaggatgagagtgcgatggggaatccaacagaattctgacacaaaaactttggagtcctcaattgttaagcatatgaagaggttcgtgcttgtaatcccagcactttgggaggtgagagcaagaggattgcttaagccaaggacttcaggaccagcgtgggcaacatagggagaccccgtctctacaaaaaaaaagaaagagtataaagaggttttggtaagactagtctgaatcatagaggaagagtaatgcctggaaagagacgtcctaatggagttatcactggccttgcagctaggaaaacgactggaat

SEQ ID NO: 1444 - DNA, 510 bp, Homo sapiens
  CDS 58..363
  sig_peptide 58..111: Von Heijne matrix score 7.69999980926514 seq LLFLALLTGLLLL/LV
aggataaaaggcccagttggaggctgcagcagggtgcagggcagtcagaccaggaccatggaactcagcgtcctcctcttccttgcactcctcacaggactcttgctactcctggttcagcgccaccctaacacccatgacctcctcccaccagggccccgccctctgccccttttgggaaaccttctgcagatggatagaagaggcctactcaaatcctttctgagggtaagacacagacgaatggggtctgagggtgagctgcttcttgccttggtacttggggaagcttcaccaaacagaatgaggcagacttccagagtcaggggtggcacgggcatggttggtgagtacggagcatggtgaagcatgatgggtggtattattaggagaaaagcatcaaattaaatttagcagagtttatttgagcaaagaagtgactcatgagttggacagctccctaaaccaggaaagacaccacacggcagtatggtcaagtggtatttacag

SEQ ID NO: 1445 - DNA, 239 bp, Homo sapiens
  CDS 6..164
  sig_peptide 6..86: Von Heijne matrix score 7.69999980926514 seq LFLFVCGFFFCFC/FF
tcaaaatggtcctatgcaataacaatgctagaattattatgttttttctttttttgtttgtttgtgggtttttcttttgtttttgtttttttgagacagagtgtccttctgtcatccaggctgaggcaggagaatggcttgaacctgggaagcagaggttgcagtgagccaagattgagccactgcattccagtctgggcaacaagagcaaaaatccatctcaaaaaaaaaaaaaaaaa

SEQ ID NO: 1446 - DNA, 484 bp, Homo sapiens
  CDS 155..334
  sig_peptide 155..271: Von Heijne matrix score 7.69999980926514 seq IHCLSCSCHLVTA/GD
agacaaaacaggtcaggggagataccaaaaagaaggcttcttatttcaggtcagccccactgccccttagaagtggacaggacaggcgagcctctctgggggccacctactcaagtgacatcgttgtcctctcatctccagagtcctggattcgatggaatccacagtgaagcccctgggtgtggccggtgtgtgttaccaagtgcaatccctggagaggaattctgctgccatccactgtctctcatgcagctgccaccttgtgactgccggggacctggttcagatgctgagtgagggtttatgggctccatcaatgtactggatgacaacttaaaaaaatatcactcaaccacaggagaggctcataatccccagattcagcgattgcagtttttggatatttgctgtcagtgaagtgggatgctgcagcccctcccaaggcctttgaggtcaatggatagcattgtctggaagagtctcc

SEQ ID NO: 1447 - DNA, 470 bp, Homo sapiens
  CDS 78..248
  sig_peptide 78..131: Von Heijne matrix score 7.69999980926514 seq WLLYLCNFPGIQC/IA
cattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatatttttt

SEQ ID NO: 1448 - DNA, 461 bp, Homo sapiens
  CDS 50..304
  sig_peptide 50..148: Von Heijne matrix score 7.69999980926514 seq LLFISLFFLSTYS/LI
ttaccttttgccagcttggcaacttctcaatctatttggctaaggcataatgtttaaaataccaagcataatgcctgacatctatttaatatttaacaaatgtcatttcttgttatttatttcccttttcttcctctctacttattctctgatacctaggacagagcaaatagtaaatacaattttttcctgctgttcaattaaattcaaagaaagttataggaggactaactcagatatcttgtccagtaaatttttaaggtttaagaaatcaaaatacccacctggcagcatttggaattattagctctgtccttactatcacatgacaacttcacattgttaactataatgacaaaatttggaggtactgtcaggcactgtgccaagcactttttatacattatttcatccctacattaacctcaagaagcagaggttatcatcacatccaggactcc

SEQ ID NO: 1449 - DNA, 240 bp, Homo sapiens
  CDS 6..164
  sig_peptide 6..86: Von Heijne matrix score 7.69999980926514 seq LFLFVCGFFFCFC/FF
tcaaaatggtcctatgcaataacaatgctagaattattatgttttttctttttttgtttgtttgtgggtttttcttttgtttttgtttttttgagacagagtgtccttctgtcatccaggctgaggcaggagaatggcttgaacctgggaagcagaggttgcagtgagccaagattgagccactgcattccagtctgggcaacaagagcaaaaatccatctcaaaaaaaaaaaaaaaaag

SEQ ID NO: 1450 - DNA, 239 bp, Homo sapiens; identical to SEQ ID NO: 1445
  CDS 6..164
  sig_peptide 6..86: Von Heijne matrix score 7.69999980926514 seq LFLFVCGFFFCFC/FF

SEQ ID NO: 1451 - DNA, 240 bp, Homo sapiens
  CDS 6..164
  sig_peptide 6..86: Von Heijne matrix score 7.69999980926514 seq LFLFVCGFFFCFC/FF
tcaaaatggtcctatgcaataacaatgctagaattattatgttttttctttttttgtttgtttgtgggtttttcttttgtttttgtttttttgagacagagtgtccttctgtcatccaggctgaggcaggagaatggcttgaacctgggaagcagaggttgcagtgagccaagattgagccactgcattccagtctcgggcaacaagagcaaaaatccatctcaaaaaaaaaaaaaaaaa

SEQ ID NO: 1452 - DNA, 239 bp, Homo sapiens; identical to SEQ ID NO: 1445
  CDS 6..164
  sig_peptide 6..86: Von Heijne matrix score 7.69999980926514 seq LFLFVCGFFFCFC/FF

SEQ ID NO: 1453 - DNA, 686 bp, Homo sapiens
  CDS 21..380
  sig_peptide 21..116: Von Heijne matrix score 7.59999990463257 seq VTLGIGFFALASA/LW
attggttagaactcagtcatatggcttcacctaaaggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaaaattaaatctcattctcagtgtgtttttatttctcgaaattttcatactgggagattccaattacagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaacagaaaaaaaaaaaaaaatgcgaaaagctt

SEQ ID NO: 1454 - DNA, 457 bp, Homo sapiens
  CDS 121..288
  sig_peptide 121..165: Von Heijne matrix score 7.59999990463257 seq LCRSLALLGGSLG/LM
tttttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggcaacagggcatggggacatcatatcaggctacatccacgtgacgcagaccttcagcattatggctgttctgtgggccctggtgtccgtgagcttcctggtcctgtcctgcttcccctcactgttccccccaggccacggcccgcttgtctcaaccaccgcagcctttgctgcagcgagcggtgggaccagcctccacacccccagatc

SEQ ID NO: 1455 - DNA, 506 bp, Homo sapiens
  CDS 41..286
  sig_peptide 41..136: Von Heijne matrix score 7.59999990463257 seq VTLGIGFFALASA/LW
atcacttccactcaaattctattggttagaactcagtcatatggcttcacctaaaggtttttttaattacttgacctattttcttgctgctggtgctgtcactttgggaattggtttctttgctttggcatcagctttgtggttcctgatttgcaaacgaaggccgggtgccgtggctcacacctataatcccagcactttgggaggccaaagcggacggatcacctggggtcaggagtttgagactagcctggccaaaatgagaaatatttcaaaattccaaatttaaagcaattgatgagagatgcaggcaaagaccatcaatggcgaagattaaatctcattctcagtgtgtttttatttctcgaaattttcatactgggagattccaattacagcaattaaagatcattctaaagatgaaccccaacttgcaacaaaaaatatcatttgtgatccctcagagaccagctccacaacaaatcgcagcagtgttacatttaagc

SEQ ID NO: 1456 - DNA, 491 bp, Homo sapiens
  CDS 153..335
  sig_peptide 153..203: Von Heijne matrix score 7.59999990463257 seq LFFLLRIVLAIWA/LF
caagtttgtcaaagatcagatggttgtagatgtgtggtgttatttctgaggcctctcttctgttccattggtctatatctctgttttggtaccagtactgtgctgttttggttactgtcaccttgtagtatagtttaaagtcaggcaacgtgatgcctccatctttgttctttttgcttagaattgtcttggctatatgggctcttttttggttccatatgaaacttaaagtagttttttctaggccagacgtggtggctcatgcctgtaatcctagcactttgggaggccaaggtgggcagatcatgatgtcaggagatcaagaccatcctggctaacacagtgaaaccccatctctactaaaaatacaaaaaattagcwggrsgtggtggtgggcacctgtaatcccagctgctcgggaggctgaggcaggagaatggtgtgaacccgggaggtggagcttgcagtgagctgagatcgcgccactgtac

SEQ ID NO: 1457 - DNA, 487 bp, Homo sapiens
  CDS 153..335
  sig_peptide 153..203: Von Heijne matrix score 7.59999990463257 seq LFFLLRIVLAIWA/LF
caagtttgtcaaagatcagatggttgtagatgtgtggtgttatttctgaggcctctcttctgttccattggtctatatctctgttttggtaccagtactgtgctgttttggttactgtcaccttgtagtatagtttaaagtcaggcaacgtgatgcctccatctttgttctttttgcttagaattgtcttggctatatgggctcttttttggttccatatgaaacttaaagtagttttttctaggccagacgtggtggctcatgcctgtaatcctagcactttgggaggccaaggtgggcagatcatgatgtcaggagatcaagaccatcctggctaacacagtgaaaccccatctctactaaaaatacaaaaaattagctgggcgtggtggtgggcactgtaatcccagctgctcgggaggctgaggcaggagaatggtgtgaaccgggaggtggagcttgcagtgagctgaagatcgcgccactg

SEQ ID NO: 1458 - DNA, 437 bp, Homo sapiens
  CDS 121..375
  sig_peptide 121..165: Von Heijne matrix score 7.59999990463257 seq LCRSLALLGGSLG/LM
cttttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggcaacagggcatggggacatcatatcaggccacggcccgcttgtctcaaccaccgcagcctttgctgcaggtaaggactctggactggactggggcatcgcgagccagcgaattcctgccgaggagctgagccatctctcttgtccttgtccccagccatctccatggtggtggccatggcggtgtaca

SEQ ID NO: 1459 - DNA, 522 bp, Homo sapiens
  CDS 153..335
  sig_peptide 153..203: Von Heijne matrix score 7.59999990463257 seq LFFLLRIVLAIWA/LF
caagtttgtcaaagatcagatggttgtagatgtgtggtgttatttctgaggcctctcttctgttccattggtctatatctctgttttggtaccagtactgtgctgttttggttactgtcaccttgtagtatagtttaaagtcaggcaacgtgatgcctccatctttgttctttttgcttagaattgtcttggctatatgggctcttttttggttccatatgaaacttaaagtagttttttctaggccagacgtggtggctcatgcctgtaatcctagcactttgggaggccaaggtgggcagatcatgatgtcaggagatcaagaccatcctggctaacacagtgaaaccccatctctactaaaaatacaaaaaattagctgggcgtggtggtgggcactgtaatcccagctgctcgggaggctgaggcaggagaatggtgtgaacccgggaggtggagcttgcagtgagctgagatcgcgccactgtactccagcctgggctacagagtgagactcatctc

SEQ ID NO: 1460 - DNA, 379 bp, Homo sapiens
  CDS 17..187
  sig_peptide 17..64: Von Heijne matrix score 7.59999990463257 seq IKLLLFIVPLVIS/SR
  misc_feature 150,284,286,291: n=a, g, c or t
gaaaatcaagataaaaatgttcacaattaagctccttctttttattgttcctctagttatttcctccagaattgatcaagrcaattcatcaktkggattctctatctccagagccadaatcaagatttgctatgttagacgatgtaaaanttttagccaatggcctccttcagttgggacatggtcttaaagactttgtccataagacgaagggccaaattaatgacatatttcaaaaactcaacatatttgatcagtctttttatgatctatcgctgcaaacnanmtganatcaaagaagaagaaaaggaactgagaagaactacatataaactacaagtcaaaaatgaagaggtaaagaatatgtcacttgaactca

SEQ ID NO: 1461 - DNA, 474 bp, Homo sapiens
  CDS 21..266
  sig_peptide 21..116: Von Heijne matrix score 7.59999990463257 seq VTLGIGFFALASA/LW
  misc_feature 451: n=a, g, c or t
attggttagaactcagtcatatggcttcacctaaaggtttttttaattacttgacctattttcttgctgctggtgctgtcactttgggaattggtttctttgctttggcatcagctttgtggttcctgatttgcaaacgaaggccgggtgccgtggctcacacctataatcccagcactttgggaggccaaagcggacggatcacctggggtcaggagtttgagactagcctggccaaaatgagaaatatttcaaaattccaaatttaaagcaattgatgagagatgcaggcaaagaccatcaatggcgaagattaaatctcattctcagtgtgtttttatttctcgaaattttcatactgggagattccaattacagttttgaaggctgagaagtccaagatcaagatgctgaaagatccggttctggtgaaggccctcttcctgatttngagatggcctttttcttctgtgt

SEQ ID NO: 1462 - DNA, 469 bp, Homo sapiens
  CDS 133..336
  sig_peptide 133..282: Von Heijne matrix score 7.59999990463257 seq FWLAFCMFSDCLG/NV
  misc_feature 426..427,429..430: n=a, g, c or t
tcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaannannrataaaacacactattctctggcaaaaaaaaaaaaaaaa

SEQ ID NO: 1463 - DNA, 830 bp, Homo sapiens
  CDS 138..671
  sig_peptide 138..416: Von Heijne matrix score 7.59999990463257 seq LPDLLLLAGPAXX/ER
atcacaaatcaggagcccgctcttgtgtgacgtcataaagcccgctccgcatcatgacgtcacagtgcgcgtagtcccgccccctcgctttctscctctgctcctccgtccgctcccgtcggacggggacattwrcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaawkgagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcccttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaaaaaaaaaaaaaaaa

SEQ ID NO: 1464 - DNA, 496 bp, Homo sapiens
  CDS 279..458
  sig_peptide 279..401: Von Heijne matrix score 7.59999990463257 seq LFCNISFLPFAVA/SP
atttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaacctcctccatcttttttgcaacatctcatttcttccttttgctgttgcttcccccctcacacacttggttttgttctatcctacatttgagatttctattttatgttgaasttgctgctttttttcatattgaaaagatgacat

SEQ ID NO: 1465 - DNA, 623 bp, Homo sapiens
  CDS 21..584
  sig_peptide 21..164: Von Heijne matrix score 7.59999990463257 seq FLLVRKLPPLCHG/LP
agtggccgttacgcgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacactgtacagggctaaattttgggaaggtkgatgttggacgctatactgatg

SEQ ID NO: 1466 - DNA, 457 bp, Homo sapiens
  CDS 64..213
  sig_peptide 64..141: Von Heijne matrix score 7.5 seq LAVHSLLAALVQS/GS
caagaggtttaaaagacggtggatggtcagaaagatgaaaactaagaagtaaatcaatgctaaatgaagaatctgtacttttgttcttgccacagtctctccttagctgttcactcattgcttgcagctctcgtccaaagtggatcattctttctatggcggcctgacttcctccacacaactggcgtctcaactgacttgaatcaacttctgtaagaaaaacagacaagtattttactaccttatggaatggagtataatgaggacacgaacatacatttcttataccattttgtacatttagtaactattccctaatatttcatctaaatatgcagattgttaaaaattcatttttaatatgaaactgcagctaaaagatatactttatttagctctcaagagtctaggatccagtattcagcatgcagttgagaggggacaacctttcagtgtt

SEQ ID NO: 1467 - DNA, 510 bp, Homo sapiens
  CDS 250..408
  sig_peptide 250..372: Von Heijne matrix score 7.5 seq ILFLFMAASSVSS/TM
  misc_feature 149: n=a, g, c or t
ttcaacttttattataggttctggggtatatgtgctggatgttcaagtttgttacataggtaaacgcatgcatggtggtttgctacacagatcatcccatcacctaggtattaagcccggcatctgttagctactctccttggtgcacnccctccccgacctcccccacctgacaggccctagtgtctgttgttccccgtgatgtgtccatcttttctcatcatttagctctcacttctaagtgagaacatgcagtgtttggttttctgttcctgcgttagtttgctgaggataacggcttccagctccatccatgtccccgtaaaggacatgatcttgttcctttttatggctgcaagctcagtatcttcaactatgactcctcatagggtcatcgtaaggatccaatgagaactgggcgcagtggctcacgcccataatcccagcactgtaggaggctgaggcgggcgaatcacttgaggtcagaagttagcctggccaacatggtga

SEQ ID NO: 1468 - DNA, 487 bp, Homo sapiens
  CDS 204..431
  sig_peptide 204..257: Von Heijne matrix score 7.5 seq LFFALFFLGQLST/SG
atgtcataatgggatctaaacaaataggaggtgtacagggcttgtggggagttggctgcccagaaatcagagagaaaataagacatgtaaagtcctgctcacccatgaaagtttctaaatacaggagctctgattctaaaatcatctccatttatattggtttatctttttaagacactttgttgtttcagagctaccttgccatgaagattcattaccttttctttgctcttttcttccttggccagctgtctacctcaggaactgaagatgcttatgaagtcattagtatcatggactgtaaaaatcaaacactgtgtaattctcagaatacaactagacactgctctcatgggaaggagattgaactatgtgtcttgcgtcttggaaaaaatgcaaagcgactcactaaccatgaagaaacagcaaattaggaagacaggatgatcaatttccttgtcttattaaaaaataaagtctgctttct

SEQ ID NO: 1469 - DNA, 481 bp, Homo sapiens
  CDS 100..441
  sig_peptide 100..303: Von Heijne matrix score 7.5 seq VLMFSQVISICWA/AM
ataccaggcactttagaaccagagactctgctgcttttcctgggcagggcctgcttgctccagctctcaagtctgacttgcatctacactgcgggcaagatgcggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaatgctcaacggagccatgttcttcaaccgcctgtccttggagtttctggccatcgagtaccgggaggagcaccactgaggcctggggagtcggaacagggctaaggagggggaagcaaaaggctgcctcgggtgttttaat

SEQ ID NO: 1470 - DNA, 505 bp, Homo sapiens
  CDS 158..442
  sig_peptide 158..301: Von Heijne matrix score 7.5 seq FVILLLFIFTVVS/LV
aaaaacagacgataccatcgcttcagcagcatcctctcagacaagagccactatttctgattcagatcacctgtcatcgaagtttaaagaaggggaaacaggagacagaaatacactgaaccaaaaagattcaaaagagcaagtggaatctctaagaatggcttccagccactggaatgaaaccactacctctgtttatcagtaccttggttttcaagttcaaaaaatttaccctttccatgacaactggaacactgcctgctttgtcatcctgcttttatttatatttacagtggtatctttagtggtgctggctttcctttatgaagtgcttgactgctgctgctgtgtaaaaaacaaaaccgtgaaagacttgaaaagtgaacccaaccctcttagaagtatgatggacaacatcagaaaacgtgaaactgaagtggtctaacactctatagaagatgaacaaaatctctgaagcagctcaacctcttctgagaaaaaaata

SEQ ID NO: 1471 - DNA, 603 bp, Homo sapiens
  CDS 68..235
  sig_peptide 68..229: Von Heijne matrix score 7.5 seq LLTTATFLPQGQG/KS
agtaactagcacgygrctcccgcccccagactgcttctttattcattcctaacctttaccttggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaaggttcggtcattcattaattaattayatctataattgmgggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcamcctccctttagaggtggggcttattgggggtggaaaaaggtgtgtgtatctctgttgtttaatgtctggttttttgttgctgttgttgttgtttgtt

SEQ ID NO: 1472 - DNA, 486 bp, Homo sapiens
  CDS 144..464
  sig_peptide 144..203: Von Heijne matrix score 7.40000009536743 seq LVFCVGLLTMAKA/ES
atgggtggcgtggggctgggaggggaggctgctgggggcggcgcgtccagctctgggccagggggtccaaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaaccgatgaagaggagggaactttccgcagctccatccgccgtctgtccacccgcagcggtagaaacacctggagcgatggaatccggccaggactcccctggcacctgacatckcccacgctccacct

SEQ ID NO: 1473 - DNA, 387 bp, Homo sapiens
  CDS 11..331
  sig_peptide 11..265: Von Heijne matrix score 7.40000009536743 seq LVFIIGLVGNLLA/LV
aaaaaacaacatgccacagttaaaacttacttcagtttggacaactactcacagctactacacagagacccgaacgagktcacctggdtakamacctggaccaccaccaatggatatacaaatggcaaacaattttactccgccctctgcaactcctcagggaaatgactgtgacctctatgcacatcacagcacggccagtatagtaatgcctctgcattacagcctcgtcttcatcattgggctcgtgggaaacttactagccttggtcgtcattgttcaaaacaggaaaaaaatcatctcaccttgrgcccamccccaccccattgkctaatctgtagaagctaataaataatcatccctccttgcctagcaaaaaaaaaaaaa

SEQ ID NO: 1474 - DNA, 520 bp, Homo sapiens
  CDS 204..443
  sig_peptide 204..350: Von Heijne matrix score 7.40000009536743 seq FPLLIQCFHVVLA/SH
cagagcacgtcaggcggcgccatgctcagcgcccaggagcgcgcccaaatcgcgcaggtctgggacctgattgcgggccacgaggcgcaattcggggcggactgctgctcaggctcttcacggtgtaccccagcaccaaggtctacttcccgcacctgarcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgarccctgtrctgcgcaggccttggtctgtrcctgtcaataaacagaggcccgaaccagcaaaaaaaaaaaaaaaa

SEQ ID NO: 1475 - DNA, 472 bp, Homo sapiens
  CDS 273..437
  sig_peptide 273..356: Von Heijne matrix score 7.40000009536743 seq LFLLSLYINYVTS/FP
agacctaggtgatggaggaagactgggaggcgctaaaatgagacagacggagtcccctctcctgtccacaaactacaatgcctacaatgcctcggtgtcagcatttactgtgattcaagcactgtgctaaagtgtttttcatatgtcatgaaaagttgtgccagaaaattatggtttgaacatgggcagttttctcctaccgtcagctatatccacaagcatcacatgaagtggagatctggcagctctgtgtatttcagtcaagttccacaatgaaacctgacaataatggtaaaaaccaatgtaagtgccagtgtttgtttttactctccctatatattaactatgtaacctcttttcccaaatatgacaattatatttcctccaaattatcttttttcccctaccaaagagtttcctcatcaagtctcctgtactaggttattcaaattctgcttcttttgtttcaatt

SEQ ID NO: 1476 - DNA, 486 bp, Homo sapiens
  CDS 47..280
  sig_peptide 47..100: Von Heijne matrix score 7.40000009536743 seq ITLCIFLVLVLHG/DT
attagtcgattccacaacgtatatcttagatagtttaattttgataatggatccaagatatatcaccctatgcatcttcctagtacttgtcttacatggagatacaactttggcagaaacttgcaggcagtttgttaaatgggatccattctgctttagtgcaatgtgcaaggcaagttgttttatagagggaaaatcctccgatggttcctatgtaaaggggcacagatgtgaatcaaatggatatcacgctgtgtgtgtttgttttctgtgtaaaaattaggtatctattgacatgcgaatctatcttcttttgttcctctctgtcatctaggagtgttatctaaataattatttggtaaaatagtgaactagtatgttcactattagagttatgtagcactagttaactagtcgttatttcttcaatttcttatatctagaaacatgtttttagttgtcaagcacttcaataatatatgtttg

SEQ ID NO: 1477 - DNA, 1111 bp, Homo sapiens
  CDS 312..497
  sig_peptide 312..392: Von Heijne matrix score 7.40000009536743 seq FIFLHLLHSGSAG/FS
aatgtttttgagattcatcgagggtggtagcatgcattggtgcctcatttctttctacagctgaatgatatttcattgtatggagggaccacattttgtttattcattcatctgttgatgggcgtttgtgtccatcttttggttacagggaaccatgcagctatgaacgtgcgtgtacagggatttgcttgagttgccattttcacctctttggagtatatccttaggagctgagtggttgcttggaaaggtaattgtatttgactttgagaagaaccgccatactgttctccccatcattagtggtgagaatgaagacgtgccggccgcttacattttgtcgggttgatttcttcattttcttgcatctccttcacagtggcagtgctggcttttccctcggtgcttgtwggaggcagtgggggagggagggttggggagggtgcgctttctactccaccattctagtgtcttctagaggtagagtcgagtgtatctgagagtgcttctctcttagaataaatgacattaacatatgaaaaaacagctacttgtgcctgactatgggcattttcatgtacaggagttcttgaagctgagtttattgagaatggttttgttacctgcatagctatctttttgtgtttagttctttttgacttctttggcctctaatgttttgacagtggcacttagatgacagtcagcaattgcaacagtgaatgaaatcacacagcttgagttcaaggtggaaagagaaaaaaatctagagaggatgttatctgacctggcatgagaggtgatcatcctgtctctgagcagtgggttcttgctctcgaccttagggtgtaatgtggccctgctccttgtatggtgaataacttgtgactgctgtgtttaccacatggcttgacagtttacaaagcacttttgtgtatattattgcacactctgatccttacagtaatcccgtgaggtgtggagtggaggctttttaagaaacagagactgctttgggaggcataggtcggtggatcacctgaggtcaggagttcgagactagcctggtcaacatggtgaaaccccatctcaagcaaaaaaaaaaaaaaaa

SEQ ID NO: 1478 - DNA, 516 bp, Homo sapiens
  CDS 144..461
  sig_peptide 144..203: Von Heijne matrix score 7.40000009536743 seq LVFCVGLLTMAKA/ES
atgggtggcgtggggctgggaggggaggctgctgggggcggcgcgtccagctctgggccagggggtccaaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaaccgatgaagaggagggaactttccgcagctccatccgcsgtstgtscacccgcagcggtagaaacacctggagcgatggaatccggccaggtgctgcagctctgacacggcggtgggagggaaggagggaggaaggaaaggcgggagagggaggggg

SEQ ID NO: 1479 - DNA, 532 bp, Homo sapiens
  CDS 206..358
  sig_peptide 206..349: Von Heijne matrix score 7.40000009536743 seq LLWASASCSESEG/GV
attttacagatgagaaagctgaaaactcaagtaggaactcaagatcccacagccaatccccataccgagtgtgcctacgttccagccgtctacacctgtccctgagcgcctggaagctgtgcagcgctacatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatgtatccttcctcacctgaaggggaggggtccgggcttctctgggcctcagcttcctgctctgaaagtgagggtggggtaggttgaatgggctccagggctctcccatatgcagtcatctgcttggccccaagatggagaagcaccccactaaagtggaagaaccccccaaaatggaggagccccgaggtcccagtaccccacatctcagttgctaccttcccaggcttactgggcagctcttttttgagtcacgtg

SEQ ID NO: 1480 - DNA, 468 bp, Homo sapiens
  CDS 13..216
  sig_peptide 13..117: Von Heijne matrix score 7.30000019073486 seq RTLLLVLWLATRG/XL
aggtggagcaagatggctgtggagctgggcgtgctgctcgtccggccccggcccggaaccgggctgggtagagtgatgcggaccctcctgctggtgctgtggctggcgacgcgcggaatkctytactttcacatcggagagacggagaagaagtgctttattgaggagatcccggacgagaccatggtcataggaaactaccgggacgcagctgtatgacaagcagcgggaggaktaccagccggccaccccggggcttggcatgtttgtggaggtgaaggacccagaggacaaggtcatcctggcccggcaktatggctccgagggcaggttcactttcacttccmatacccctggtgagcaccagatctgtcttcactccaattccaccaagttctccctctttgctggaggcatgctgagagttcacctggacatccaggtaggtgaacatgccaatgactatgc

SEQ ID NO: 1481 - DNA, 444 bp, Homo sapiens
  CDS 102..326
  sig_peptide 102..140: Von Heijne matrix score 7.30000019073486 seq MALLLLAVPPVKS/FL
  misc_feature 390: n=a, g, c or t
tttttttctatttattgtaccaaagacagtggtggtccggtggagggaagaccccccctcaccccaggaccctaggagggggtgggggcaggtagggggagatggccttgctcctcctcgctgtacccccagtaaagagctttctcacatgcctgcctgagcgtttgcagggcctcggctcccctcacccgaccctcagaggcatggtggggaagggggtttgcggagggggtgctggaggagcctggtgtggagacttctcgtggggaagctgtggcgcgtgttgcaggcatgagtctgcaggtctggggcatcagcattctagatagatcgtggacaggatcctggcctacatttgccttttcctgggtaaatagaccctsaaagtanaaaggttcagctctggcctgtctctgggaaacaggtgccctaataagccggggc

SEQ ID NO: 1482 - DNA, 415 bp, Homo sapiens
  CDS 125..316
  sig_peptide 125..184: Von Heijne matrix score 7.30000019073486 seq LRLAACLLNVSEA/GR
acactccacccaggaacctagtcggcaccgcgcagggaatcccagcagcggggttctggccccagcacgcgttgcggcasctggcgagcgtccttgcggcctccahgtgccggtgggaaaaatcatgtcttcttccagagtggggctccgtttggctgcctgtttactaaacgtttcagaagccggaagaaaatacattgttgagaacatagcaaaagcagctcttcytggacmaaaatggaaaggaaacatcctccaagtttcagtgctcaaatatattttcscgatcaagactacaagagatcagtcattacaatagcaacttctgttgataagttgggccttgctgaggatctgggtgctgcatgttcctggctgcagcgtgtttctctttgggcgaastgacctgcctgag

SEQ ID NO: 1483 - DNA, 612 bp, Homo sapiens
  CDS 191..355
  sig_peptide 191..310: Von Heijne matrix score 7.30000019073486 seq LLFCFSFPRVCLS/DL
agtatatgttcctgggagtgaaagagtacaactccatctttttctggggctttagagattatcttatccagcattttcaatattgcagatatagagcataggtctcgaagtgaagtaacttactccaggtcattcattaagttgatggtaaagccaggatgagcaaccagatgttctaatttcctgtgctatgctctttccacaagccaatgctaccttctctcacaaggcagacttcacatattttataacacttgaaaataccattagacttctgttctgttttagttttcctcgtgtgtgcctctcagacctgccctttgcccaacacattttgcatactgcaagtactttatagatggtttttattcaaatgagatttgtgcagtttatataagcaatatgctatacagttattattcaactgttttatacagttatgcaaatatttttgtatgtacatcacgtaaagcactgtgacaggtgatcataaagaaaaaatgaaatttgagaaggctttgaaatgacctacytagccctcattgacataggcaacaatggctcagtcttctcaaggacagctaaacacattgaatagttctgctgagtcta

SEQ ID NO: 1484 - DNA, 450 bp, Homo sapiens
  CDS 77..235
  sig_peptide 77..175: Von Heijne matrix score 7.30000019073486 seq XFFMCLLLGMVSS/CV
ttaatgtggtatagtttcactttcacaacatcttcattaatgcttgttttttcactttttaatttttgtcagtctgatgggtaaggtgggatttcatggtattgttcttttccgattgctagtgaggttaagcgamsacttcttcatgtgcttgttgctcggtatggtttcctcttgtgtgaaagacatgcctgttcatgtcttttgtacatttttaaaatttcttatttattcatagacttccctcttacgttctgaatacaaattctttgttggttatgtgtgatttaacaaagtaccttttttggcttatatttttgtgcttaagaattttttcttacctctcattcataaggataattcacccaaatttccctataaaagtggaataattttgccttttagaagcctggagttgattctgtggatttttggagagggatttaatta

SEQ ID NO: 1485 - DNA, 512 bp, Homo sapiens
  CDS 59..319
  sig_peptide 59..127: Von Heijne matrix score 7.30000019073486 seq LGLCSLLVGEAEA/PS
agacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcgagccggccgtacgcggtgctgcgagggcagaacctggatcaaactcttcattgaagtactcatcaggcgtgatggctgtggggttgtttgcagtagcacattccgtggtgaggtcctgctgagccagaactcaggagagtcagaaatgccaaatgatgttcacaagtgaaggcctgtggcactcagtgtctgaggtggacgtgttaaccagctaaagaccgggaagttctattcactaacttttttgcatggaacaagaaaatctatgaggatatcaccaaactacacaggaagtgtaatggatttcttcattttaaaatatttctctactctcctttacatttttatctcctgattat

SEQ ID NO: 1486 - DNA, 480 bp, Homo sapiens
  CDS 209..475
  sig_peptide 209..319: Von Heijne matrix score 7.30000019073486 seq LELLGSSSPPTLA/SQ
tttgaattatagttttaggtatttggacaattttcttcctttgctttcctctccagggattcctacttttttttctttcttcttttagttttgagctttgtcacccaggctggagtacagtagcatgatcttggctcgctgcaacctgtgcctcccaggttcaaacgattctcatgcctcagcctcctgagtagctgggactacaggcatgtgccaccacgcctggctaatttttgtctttttagtagagacagaatttcgccatgttgaccaggctggtcttgaactcctgggctcaagcagtcctcccaccttggcctcccaaaatgttgggattacaggcgtgasaccgcacccggccaatattttcgaaagacacattttaaaggactgttatcagttggaatggtggctggtgtctgtaatcccagcactttgggaggccaagatgagaggatcactgagctcaggagtttgaga

SEQ ID NO: 1487 - DNA, 485 bp, Homo sapiens
  CDS 14..478
  sig_peptide 14..88: Von Heijne matrix score 7.19999980926514 seq LLPLPQFHSASLA/RP
  misc_feature 473,476: n=a, g, c or t
gaaaaggagcaagatggctgactccaaagagggtgttttgccgctgacgctgcttccactgccccaatttcattcggcttcactcgcacgtccgcacggaggcggctggccgactcgggagacggcgcggggccatctccggagaaaggatttcttgaaaaccgtggaagggagggagctgcagagtgtgaagccccaggaggcccccaaggaactcgtcatccctttgatccagaatggccatcgcaggcagccaccagcccggccccctgggcatccacagatactggggccttggcgatggggtggtgtcccaggctgtgaaggagytcattgcggaatccaagaagtctctggaagagagagagaatgcgggtgtcgaccccacgctcgctatccccatgatccagaaaggatgcaccccagcgggwaagggyscagacagcgaaccccgggcagagacagtgccagangangctaattat

SEQ ID NO: 1488 - DNA, 520 bp, Homo sapiens
  CDS 142..354
  sig_peptide 142..186: Von Heijne matrix score 7.19999980926514 seq LVALLFTGIAVLG/IV
caatttcttcgttttcttcttcattttcttcgtccaggatgtgctctttgtcctccaggccattggtatcccaagttggggattcagtggctggatctctgctctggtggtgccgaaggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgagctgccaatgcagccgctggggctgctgaaaatgccttccgggccccgtgamccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagtcactgtgac

SEQ ID NO: 1489 - DNA, 436 bp, Homo sapiens
  CDS 32..217
  sig_peptide 32..169: Von Heijne matrix score 7.19999980926514 seq SLLIFFSLRFIFG/RF
tttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcatttttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaggttgaggcagggggattgcttgagcccaggagtttgagactagcctgggcaatacagtgagacctcatctttaaaaataattaaaaaggtca

SEQ ID NO: 1490 - DNA, 678 bp, Homo sapiens
  CDS 69..383
  sig_peptide 69..125: Von Heijne matrix score 7.19999980926514 seq VSIMLLLVTVSDC/AV
acaaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgagatgtccagtgtggggcaggcacctgctgtgccatcagcctgtggcttcgagggctgcggatgtgcaccccgctggggcggaaagscgaggagtgccaccccggcagccacaagatccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgcactcaaaaaaaaaaaaaaatgcgaaaagctt

SEQ ID NO: 1491 - DNA, 453 bp, Homo sapiens
  CDS 83..316
  sig_peptide 83..256: Von Heijne matrix score 7.19999980926514 seq LVFLGPFTGLTAG/AP
  misc_feature 29: n=a, g, c or t
atcagtccctggcagcagcagccccagantattacctttttgcttttatgctcgtgtttctactttatctatcaccatccttatggttgttttggagtgtgtgaccttccagcgatctgtcctaccaaggacaacagcggccctaagacttttgccgggatggccaagaaactgggaggctgaagagagctcgaagtatggagcatcctgccctcagctggtttttcttggtcctttcacgggactcacagcaggggcgccccgtctactcagctcactgtgctcaaccccttgtgggagggagcatgtgagcatgtgagtgtgggatccggccggccattccaagtgcagacacaggagcaagctccatgcaggacccgtggccagactaggcgtgttgcagcacccagggtaaatttcttgacgtgaaggaacagaactcctacgtactgt

SEQ ID NO: 1492 - DNA, 483 bp, Homo sapiens
  CDS 167..379
  sig_peptide 167..277: Von Heijne matrix score 7.09999990463257 seq ILSLPLAWLPARG/WC
cctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacactt

SEQ ID NO: 1493 - DNA, 496 bp, Homo sapiens
  CDS 186..368
  sig_peptide 186..311: Von Heijne matrix score 7.09999990463257 seq LLPCSSVLTCGQA/SQ
cttcttcagtcagtggctggataatctaattataatgttataatccatcatttctctttttgaacagtcaatttagtttaacatttgcttaacagccattatgtatgccaggtaatgtgctagatgctggtggttcaaagaaaggaacgatgtggacctgacctcaaagaaatccattggagaatatgacagatttagatttaatgatcaactttacttttcctatacagtgggtcaaccaaaaccgcatggcgtactactctctgaagcctctactaccctgctcctccgtgttgacatgtggtcaggcaagccaggacttactcacatcagctacatcagttactgggatggagaaaattgaagcctagaaagatcaagaaactttctccaggccataaatagaggaatcaggattcaaatcagatagaccccagggcttgttctcttcaacaccacattaccctacattattattcaattattaaataaaacc

SEQ ID NO: 1494 - DNA, 470 bp, Homo sapiens
  CDS 38..283
  sig_peptide 38..82: Von Heijne matrix score 7.09999990463257 seq TWALLLLAAMLLG/NP
  misc_feature 327: n=a, g, c or t
aacagggtgtgaaaggcatctcagcggctgccccaccatggctacctgggccctcctgctccttgcagccatgctcctgggcaacccaggccttgaggtcagtgtgagccccaagggcaagaacacttctggaagggagagtggatttggctgggccatctggatggaaggtctggtcttctmtcgtctgagccctgartactacgacctggcaagagcccacctgcgtgatgaggagaaatcctgcccgtgcctggcccaggagggccccagggtgacctgttgagcaaaacacaggagctgggccgtgactacaggacctgtctnacgatagtccaaaaactgaagaagatggtggataagcccacccagagaagtgtttccaatgctgcgacccgggtgtgtaggacggggaggtcacgatgggcgcgacgtctgcagaaatttcatgaggaggtatcagtctagag

SEQ ID NO: 1495 - DNA, 499 bp, Homo sapiens
  CDS 42..491
  sig_peptide 42..200: Von Heijne matrix score 7.09999990463257 seq IAVGLGVAALAFA/GR
agtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagggactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgctt

SEQ ID NO: 1496 - DNA, 510 bp, Homo sapiens
  CDS 293..502
  sig_peptide 293..343: Von Heijne matrix score 7.09999990463257 seq HILFLLNLQFTHT/QQ
aaaaatcattctgccctcaatattgggatggttgcttaagggaaaccagccactgcgaaatgaggaaaccaaagtaggtggtgtgacaagactacatgaagaggcctaatggagagtaaccgaggtatcagctgacagccagccttggtggccttattttcttatcattggccttcaacatttttatcaggatatatctgtgtatattgcagattttacaaattgaaggtttgtgacaactccctcaaggaagtctgttggtgttatttttccaacagcaggtactcacttcatgtctctgtgtcacattttgtttctcttgaatttgcagtttacccatacccaacagccttattggaaggactatacacaattttcatgtggctcacacctgtggtcccgacattttgggaggccgaggcgggcggatcccctgaggtcaggagttcgagaccggsctggccaacatggtggagccccgtctctactaaaaaatacaaaatagtagcc

SEQ ID NO: 1497 - DNA, 540 bp, Homo sapiens
  CDS 273..452
  sig_peptide 273..326: Von Heijne matrix score 7.09999990463257 seq TWMLLVLSPGSVT/EN
ggagagagaagcgctttcgggaaggaaagtgtgatctaggaggtggaatagtcctctccaaactttgacctgaggtgtgactattgaatgaccctctatttggatttggattacacaaagtttaacgttttttggaaaaatcctacctaggtaatgtgtagttctcaatgcatcatgtcaggcagcttatgatgccaatttgtcccatgcctcgaggtctttaggaaaacggtgactctggagcacagccctggatccctgatggcaggtggatgaatctgctccccacctggatgctgctagtcctttctccaggctccgtgactgaaaatgtgctttacttggcaaaagctgtttctcctcagaactctagaaatcagatcttggcccacctctttcagagattcttcaggcctgacctccactttaatttacttgaagagcatcgaatatgaatctgcagaatttcagtgaaactatagaggaagaatggaggaggtggagctgaggcagtaatgcgagtgatggggagcagctgta

SEQ ID NO: 1498 - DNA, 776 bp, Homo sapiens
  CDS 148..474
  sig_peptide 148..462: Von Heijne matrix score 7 seq ILLIVLLTHLLVS/AR
gttcttcggctgcgcttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgctttcatgacgctggtcattatcttgctgcatgtattctggggcattgtattttttgatgtctgtgagaagaaaaagtggggcatcctccttatcgttctcctgacccacctgctggtgtcagccagaccttcataagttcttattatggaataaacctggcgtcagatttataatcctggtgctcatgggcactgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgaaaaaaaaaaaaaaatgcgaa

SEQ ID NO: 1499 - DNA, 334 bp, Homo sapiens
  CDS 73..267
  sig_peptide 73..219: Von Heijne matrix score 7 seq LLLLDTVTMQVTA/RS
  misc_feature 173,177: n=a, g, c or t
aaggaaacgttcaccttgtctaccatcaagacacttgaagaggctgtgggtaatattgtgaagttcttgggaatgcacccttgtgagaggtcagacaaagtgccggakaacaagaacacccacacgttgctcctggctggtgtgttccggggtggtcatgacatcctggtgcnyksncggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctca

SEQ ID NO: 1500 - DNA, 454 bp, Homo sapiens
  CDS 71..385
  sig_peptide 71..202: Von Heijne matrix score 7 seq LLMXSLXAPXLGA/SE
  misc_feature 14,16..17,183: n=a, g, c or t
acttagggcgggangnncgaggsgccgttgctttgttctgtctgaggccaggaagtttgaccgcgctgccatgccgaaccgcaagccagccggaatgcttactatttcttcgtgcaggagaagatccccgaactacggcgacgaggcctgcctgtggctcgcgttgctgatgsbatcccttrntgctccgcractgggcgcttctgagggaggaagaaaaggagaaatacgcaaaatggctcgagaatggagggccgctcagggaaaggaccctgggccctcagagaaggcagaaacctgttttcacaccactgaggaggccaggcatgcttgtaccaaagcagaatgtttcrcctccagatatgtcagctttgtctttaaaaggtgatcaagctctccttggaggcattttttattttttgaacatttttagccatgggcgagctacctcctc

SEQ ID NO: 1501 - DNA, 435 bp, Homo sapiens
  CDS 53..334
  sig_peptide 53..283: Von Heijne matrix score 6.90000009536743 seq SLMCLLQTHRAWS/SM
acggacgccgtccctcctcggcgcggcctgagcgcccggcccgaccccggccatggggtgctgctacagcagcgagarcgaggactcggaccaggaccgagaggagcggaastgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccamcgctgccgtctcttaccagccagccccascaagtgctggscagtgagcccatcccgttctctgat

SEQ ID NO: 1502 - DNA, 485 bp, Homo sapiens
  CDS 137..286
  sig_peptide 137..214: Von Heijne matrix score 6.90000009536743 seq LLSMLSCCQGACC/PS
atcctggattcgtttacccaagagggaacagttttgagaccccccggattcactgcggagtggccgcagaggcggggtcggctttgcgccgtggcttcgggtgttgtggaggcgcacagagggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactgg

SEQ ID NO: 1503 - DNA, 372 bp, Homo sapiens
  CDS 72..296
  sig_peptide 72..128: Von Heijne matrix score 6.90000009536743 seq LTPVILALREARA/DG
tcaagaaaaaaaatttttttttttttggaagaatttgaaagctgctgatccagagtcattcctttaagaaaatgggccgggcatggtggctcacacctgtaatcctggcacttcgggaagccagggcagatggatcagttgagctcaggaatgtgagaccagcctgggcaatgtggcaaaaccccgcstctacaaaaaatacaaaaactaggtgggcatggtggcatgcgcctgtagtcccagctactggggaggccgaggtgggaggatggcttgagcccggaaggcagaggttgtagtgagctgagattgcagcactgcactccagcctgggcaacagattcaaaccctgtcccaaaaaaaaaaaaaaaa

SEQ ID NO: 1504 - DNA, 374 bp, Homo sapiens
  CDS 72..296
  sig_peptide 72..128: Von Heijne matrix score 6.90000009536743 seq LTPVILALREARA/DG
tcaagaaaaaaaatttttttttttttggaagaatttgaaagctgctgatccagagtcattcctttaagaaaatgggccgggcatggtggctcacacctgtaatcctggcacttcgggaagccagggcagatggatcagttgagctcaggaatgtgagaccagcctgggcaatgtggcaaaaccccgcctctacaaaaaatacaaaaactaggtgggcatggtggcatgcgcctgtagtcccagctactggggaggccgaggtgggaggatggcttgagcccggaaggcagaggttgtagtgagctgagattgcagcactgcactccagcctgggcaacagattcaaaccctgtcccaaaaaaaaaaaaaaaaag

SEQ ID NO: 1505 - DNA, 559 bp, Homo sapiens
  CDS 30..242
  sig_peptide 30..128: Von Heijne matrix score 6.90000009536743 seq LCLLGSSDSPSSA/SR
tacaacttttttttttttttttttttgagatggagtctcgctctgttgccgggctggagtgcagtggcgtgatcttggctcactgcagcctctgcctcctgggttcaagcgattctccttcctcagcctcccgagtagctgggactataggcgcatgccaccatgccccgctaatttttgtatttttagtagagaaagagtttcaccatgttggccaggatggtctcgatctcttggcctcatgatctgcccacttcagcctctcaaagtgctgggattacaggtgtgagccaccgcacccagcctactctttgattcttaatatagttacttaagcatttcctagatagtagtgaatctggcataatgaaatacgagggtataaaataatactttagttatttaacaatagatcccattgggctttatgcaggtattgtccatttaggccaggttggagaaagtaaggtaaacttatgttcaatgactgcctgttcttacctaaaatcttttgtgattcaaactgtggggaaaagcaagagagatcagatgtcactgt

SEQ ID NO: 1506 - DNA, 524 bp, Homo sapiens
  CDS 76..234
  sig_peptide 76..123: Von Heijne matrix score 6.90000009536743 seq SLLTATSALRVQA/IV
  misc_feature 484: n=a, g, c or t
agtgttttgtttcaaaaactgaatcccaagcacacactttattatgctgtgcttcttaaaataagctggagtacaatggagccatctttgctcactgcaacatctgccttacgggttcaagcgattgtcctacctcagccacccaggatggtcttgatctccccaccttgtgatgctcttgccttggcctccaaaagtgctgggattacaggcctgagccaagatacatatttttaaaaggaaaaaaatttcaaaggctggagtacaatggcgccatctttgctcactgcaacatctgcctcacgggttcaagcgattgtcctgcttcggcctcccaggtagctgtgactacaccgcactgggactacatcagctgccaccatgcctagctaattttttggatttttagtagtgacagcgtttcactgtattggccaggatggtcttgatctcctcaccttgtgatcctcttgccttggcctvnaaaagtgctgggattacaggcctgagcaagatacatactg

SEQ ID NO: 1507 - DNA, 505 bp, Homo sapiens
  CDS 36..404
  sig_peptide 36..95: Von Heijne matrix score 6.90000009536743 seq FLLMGTFLSVSQT/VL
agaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgt

SEQ ID NO: 1508 - DNA, 692 bp, Homo sapiens
  CDS 238..480
  sig_peptide 238..393: Von Heijne matrix score 6.90000009536743 seq SPLFLSWFPSVLS/KS
  misc_feature 539..541,543: n=a, g, c or t
tcctacacttacgggtgtatctccaaatcctctcccaattttattcccttattcatttcaagagctccaatggggtctccagctgaaasccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtannncnttctgcagatactctaatcactacattgctttttctataaaactacccataagcctttaacctttaagaaaaatgaaaaaggttagtgtttgggggccgggggaggactgaccgcttcataagcagtacgtctgagctgagtatgttca

SEQ ID NO: 1509 - DNA, 459 bp, Homo sapiens
  CDS 96..359
  sig_peptide 96..272: Von Heijne matrix score 6.90000009536743 seq LCLSLIAISPSFT/LS
tcattgttccattatcttgcttgakacctaatggtttagacattcatatagacctactagcaaatacaacattcttcctttagtttttgccaagcatgatggtactatctgggcctgctgctttgtggggatcaatgggttggaaggaagcaacctgccctaatcccaaaagactcttaggagagaatttctccaatgaggccaacaccagcagtggcttatggccttccagcctatgtctgtctctgatagccatatctccatcattcactttgtctaacttgagaagctctataaagaagctaaacctttggccgagcacagtggctcacgcctgtaatcccaccactttgggaggctgaggcagatggatcacgaggtcaggagatggatcacgaggtcaggagatcaagaccatcctggctaacacggtgaaacccatctgtactaraatacaaa

SEQ ID NO: 1510 - DNA, 433 bp, Homo sapiens
  CDS 125..415
  sig_peptide 125..373: Von Heijne matrix score 6.80000019073486 seq SVRLSCLFSRTFS/CI
attcttagcaataggattgctctgtcagagaacatgtgtgatttggattgatagtgtcaaactgccctccataatggcctctattatggaggctagtggggctatgagttcccactaggagtgtatgcaagtgcctgtctccccacagcttcaccaatgttgtaaatatatgtctaacttttggatttgtgccaaaccaatagacaagaagtggaaatgcggtttggttctaattagtatttctctgataaaacatttgaacatgttttcatgtttaagggtcagttgcattaatttttctgggaactatctactcatgttttttgaccattattctgtcaggctatcctgtttgttttctaggaccttctcatgtattaaaatgattaatggtgggtgtagtagttcatgcccataatcctagcagtttggg

SEQ ID NO: 1511 - DNA, 537 bp, Homo sapiens
  CDS 138..338
  sig_peptide 138..260: Von Heijne matrix score 6.80000019073486 seq LLPVCCTIKPAWG/SR
agcgccgcctgctggtggagccccgccagaactgacatagactcgtccagcctccaggtgcacccacgcccttttcttgcaccaagaagctgagcagcctctctctactctctgtgaccgtcctctttggcctccgcatggttcagcctggaatcctgaagagtgtgactgcaccgaaacctggatattgcccagagtttactctatcctgccctttcaccctcttacctgtgtgctgcactataaagcctgcctggggatcgagaagtattgcttcttcaactgtcaacatcagtgtacagagccttggtggactttggattgaggtggaaactccttagccaagcctgaggagacgctggtgctacaggctctgatttggataactggtctccaatttgtccatgatcttcccaggcccaagatgtcatttcagagttaaatgcttgttaatatgacaagaagacaaagagataaagcattgtatatttaaaaccacagaaaaatctgtaagactgctggatctctctctctctc

SEQ ID NO: 1512 - DNA, 456 bp, Homo sapiens
  CDS 190..393
  sig_peptide 190..345: Von Heijne matrix score 6.80000019073486 seq SAFPLQFLSFSQG/RT
attggggatcacattccatcctgagatggacaaacatccaaaccatgtcagtgaatatattacatttatcattaaaactttgttattgttggattccagatacattaaggacctggtattgaaagtaaggcttaaacatgtatatgtggttgcttattgttaaatgttttcatctttttgtgtgaagaaatgttgctctttggtgagagtacagagccttcagaaaagctgcagcatgtaagggaaggtgagatccagtttccacacgactttgtgagcactcctttccccttcctcccaactttttccgcatttcccctccagtttctatccttttcccaaggaagaacaggacatatgactaggttgacagatcttgaaaggcaacttcactaggatctcaggtgagataataatgaatgggaattgtgctgccaggatgcctgtacctggagt

SEQ ID NO: 1513 - DNA, 484 bp, Homo sapiens
  CDS 77..457
  sig_peptide 77..133: Von Heijne matrix score 6.80000019073486 seq AIVALAVCAALHA/SE
aaggacacctttagcctcatttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaakaaaaatggtaaaggaaatgtttgccacaggaagaaacaccatggcaagaggaacagtaacagggcacatcaggggaaacacgaaacatacggccataaaactccttattagagagtctacagataaaatctacag

SEQ ID NO: 1514 - DNA, 509 bp, Homo sapiens
  CDS 279..473
  sig_peptide 279..377: Von Heijne matrix score 6.80000019073486 seq AAPMCLXFLVCQC/HY
agatggaggaggggtggcaggggaagacgggagaagaggaagggacaggacattccacttagacaatcaaacttgaagtgtttacggtctagggtagatgtccaacagggagcagggactatcaatctggaactcagagacgaaaccatggagtgacaggtgcaggttaagagcctgttaggtccaaaatggtgccccagaaattcaagttaagtcaagcccatgttggaagaccaccagatgttcttctctaatgacgagctctgagcaatccccaaatgatgtcctccttgttctcccctggtacactgagtctgcagaccatccagaaggatcctgctgcccccatgtgcctttkgttcttggtatgtcagtgccattatactccaaattctccatttgatggagagaatctgtccctctggaattacgagatttatatgcacagtttgcaaatwaagcatcatagcctttaattttctgtatcaaaatcaaaaaaaaaaaaaaaa

SEQ ID NO: 1515 - DNA, 358 bp, Homo sapiens
  CDS 27..278
  sig_peptide 27..269: Von Heijne matrix score 6.69999980926514 seq VAALALFLISSST/SK
gtggccaaggcggcgaccggagcgcgatggcgggggcggcgggactcacggcagaagtgagctggaaggtcttggagcgaagagctcggaccaagcgctcaggtttggctggctggggcgccgcccccacccgagtaccttgggtggtgcttcgcctcaagcgccttggcgggaggcaggtgggggccctgggaatgaacctgtgccccgagttcctccttagaaagcaggtggcggccctggccttgtttctaatatcttcctccacctctaaaaattaggtggcagagcagctccactctgcgtgtgcccccgactctattccgcttgtgagccccactcggaaagtaggcagcgg

SEQ ID NO: 1516 - DNA, 543 bp, Homo sapiens
  CDS 257..505
  sig_peptide 257..325: Von Heijne matrix score 6.69999980926514 seq LCPSICMCSVSLA/CV
gatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggtgatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgc

SEQ ID NO: 1517 - DNA, 752 bp, Homo sapiens
  CDS 342..581
  sig_peptide 342..497: Von Heijne matrix score 6.69999980926514 seq PWLLALFIFVVCG/SA
acattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttcagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtsattccaagttttctagtccataccacagtgccttgcaaaaaacaccacatg

SEQ ID NO: 1518 - DNA, 453 bp, Homo sapiens
  CDS 77..367
  sig_peptide 77..154: Von Heijne matrix score 6.59999990463257 seq LFWLASGWTPAFA/YS
agttcgcccgttcctggcctgacccccaccaaggcccataccgcagtaggctcatcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgcaggccccgagtggaaatatccagctcaccaggccatgaatcttgtgggccccagagcattgaaggtggagctcatgaaggacttcagcatttgggtccttttggcaacatccccaacatcgtgtcagagttgactggagacaacattcctaaggactttagtgaggatcaggggtaccagaccctccaaatcctgtcctgttggaaaacagatgat

SEQ ID NO: 1519 - DNA, 509 bp, Homo sapiens
  CDS 165..443
  sig_peptide 165..236: Von Heijne matrix score 6.59999990463257 seq KMVHLLVLSGAWG/MQ
attattggttgggggaaaccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgcttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtggg

SEQ ID NO: 1520 - DNA, 426 bp, Homo sapiens
  CDS 16..297
  sig_peptide 16..93: Von Heijne matrix score 6.59999990463257 seq FCGSACLLAVIRA/FF
ttacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggt

SEQ ID NO: 1521 - DNA, 532 bp, Homo sapiens
  CDS 52..264
  sig_peptide 52..123: Von Heijne matrix score 6.59999990463257 seq FTLASQVAGTTFA/HQ
ctccaggagccgggaccaaaataaccgggcgggaggggacacctcgcagagatggatctcgaactcctgggctcaagcgatcctttcaccttggcctctcaagtagctgggaccacatttgctcaccagctggcccaagaccagactgggcaacatgatggagtcttgttctgtcacccaggctggagtgcagtggcacaatctcagctcattacaatctctgcctactgggttcaagttattctcccacctcagcctcccaagtagctggaattacaggcacgagccaccacatccagctaatttttttgtatttttagtagacatggggtttcaccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcaga

SEQ ID NO: 1522 - DNA, 501 bp, Homo sapiens
  CDS 1..495
  sig_peptide 1..117: Von Heijne matrix score 6.59999990463257 seq LLPLLSLLVGAWL/KL
atgagggcgcaygcgcagcggggccgtgggtgtacgcggcgcagsgsggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggattgagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcaccagtgttacacgtgagct

SEQ ID NO: 1523 - DNA, 498 bp, Homo sapiens
  CDS 192..476
  sig_peptide 192..326: Von Heijne matrix score 6.59999990463257 seq FILLLLLSGPAEM/SA
acttttattgaaaaagactacagcaaatcatactgaggtgaatgaagacagtgaaatgaaggagaaggcaggtcctctttatgttttcgcagctggttcaaggggtttggggttttctatctaggttaaagattgcgtaatacacagctggagccatagacattaatgcatgtttatcacacgcaacaacgatgctgcatcatgtgattacagctgggcctgtgctgcttctacacctccctcgccctgacacttccaccaggttgctcctcacctccgtctctgcttttatcctcttactgctcctttcaggaccagcagaaatgtcagcttcccaggaatccttccctggatctctgcagcaagaaatagcttctctgatcactgtagcacttggttctttaatatctttatcttgctctaccttgttatatttttcttgtgaacttaaaattccctgtgaggacgtaaacctttgaaggtatgtctcatatctct

SEQ ID NO: 1524 - DNA, 444 bp, Homo sapiens
  CDS 156..422
  sig_peptide 156..287: Von Heijne matrix score 6.59999990463257 seq FFLPLLTFFLLFS/NP
cttgatatcatcatgcacattctcttctcagactgggaacagttttctttggcttaactaggagaccagggatcttgctggagttccagatttgagctctctgcccttcctgactaagcagccccacagtgtcctcacttgacacatgctgttttatggggcgccacgtcttcttcgttccttctctctcctctgatccacttttttccttgaccctattcttctccttcgtttctttcttcctcattttctttttgccccttctcactttcttccttcttttctccaaccccctaggacacacacaagacttgttcttatgtgctgtaattggaagttgtaaatcaatggggttgcaggtgggagccaccaaattggattcatttatgagttgggatagagagttggtggcgggcctgagctgatggtatactggggactgat

SEQ ID NO: 1525 - DNA, 512 bp, Homo sapiens
  CDS 77..472
  sig_peptide 77..229: Von Heijne matrix score 6.59999990463257 seq NLLFLTGLSLIIG/LR
atgtaccagctgcgtcctctgggccacgctccacttgcccgcttccacccggaaagccccccaggctgagtgcggcatgatctccatcaccgaatggcagaagattggtgtggggatcacyggtttcggcatcttcttcatcctctttggaacactmctgtactttgattccgtgctcctggcctttggaaacctgctgttcctgacgggcctgtccctcatcattggcctgagrragaccttttggttcttcttccaacggcacaaactcaagggaaccagcttcctcytggggggtgtggttatcgtgctcctacgctggcccctcctcggcatgttcctggaaacctacggattcttcagcctctttaagggctttttccctgtcgccttcggcttcctgggcaatgtctgcaacatccccttcctgggtgcgctgttccggagacttcaaggcactagctcgatggtctgaaaacagagatgagctccttgaacttggatcattggtt

SEQ ID NO: 1526 - DNA, 589 bp, Homo sapiens
  CDS 56..505
  sig_peptide 56..115: Von Heijne matrix score 6.59999990463257 seq LLPLLSLLVGAWL/KL
atgagggcgcaygcgcagggggccgtgggtgtacgcggcgcasgsggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccggtaccag

SEQ ID NO: 1527 - DNA, 566 bp, Homo sapiens
  CDS 179..433
  sig_peptide 179..265: Von Heijne matrix score 6.59999990463257 seq RLSDCLLVPLGQA/SQ
tgagtagatgttcaatgagtgtgggtaagtgagtgaataaataaagaaatccatcctggtgtgtctatcacaggtataatgaagtgctgattagacactgttgctgggtatggaatgattctgtttgactatttgttccaaccaaatcgagagattgttttttcaaacaggatttcccatggcaaatctgatgaagtgttgcatgtccatgagagcacacaggactaggcttagtgactgccttctcgtccctctgggccaggcttcccagtcttgctttcctgtaccctggactcctggtggtatttctgaaaagctctggcaatatctcggcacaaacaagtcattgtgtataagccagcagtgcctggaagcccctggaggcataggggccccagctgttcttacttgcagaagtgactctgagggacaatgaccctggagggccatgcaaaatgcattccagttgtaacttaagctctggagctgagctgtttgctttgttgattctccccgaagtgcaggatggaaaggaggggaccactttagcaaaaaaaaaaaaaaaa

SEQ ID NO: 1528 - DNA, 349 bp, Homo sapiens
  CDS 107..298
  sig_peptide 107..172: Von Heijne matrix score 6.5 seq SCLCPALFPGTSS/FI
cagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccawaaaaaaaaaaaaaaaa

SEQ ID NO: 1529 - DNA, 511 bp, Homo sapiens
  CDS 237..398
  sig_peptide 237..377: Von Heijne matrix score 6.5 seq FILFVVVLCWVWL/SC
  misc_feature 46,470: n=a, g, c or t
aattctagctccaattctcactagctttgcaaactgaggtttattntacctatacaacaaccctgcatgacaggcaacatttcaggtcctcatgtctcaaccacatctactctgtgaaccctggcttagtctgtctgctctgcagcatctgctgtggggatcatctcacagtgaccagaatggcttctcastcttaastctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttstccttttagaatgatgaacaggaagcagggcaaactcttgaagatttccagctttcagtttttgtttttgttttttanrcattatttacctgagttttcatccttgaggaggtgaagta

SEQ ID NO: 1530 - DNA, 547 bp, Homo sapiens
  CDS 237..398
  sig_peptide 237..377: Von Heijne matrix score 6.5 seq FILFVVVLCWVWL/SC
aattctagctccaattctcactagctttgcaaactgaggtttattctacctatacaacaaccctgcatgacaggcaacatttcaggtcctcatgtctcaaccacatctactctgtgaaccctggcttagtctgtctgctctgcagcatctgctgtggggatcatctcacagtgaccagaatggcttctcactcttaactctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttctccttttagaatgatgaacaggaagcagggcaaactcttgaagatttccagctttcagtttttgtttttgttttttaaccattatttacctgagttttcatccttgaggaggtgaagtagtcaggaccatgaagtcagacctcatgcctcttcct

SEQ ID NO: 1531 - DNA, 520 bp, Homo sapiens
  CDS 117..467
  sig_peptide 117..341: Von Heijne matrix score 6.5 seq RLLLAAFPAEASP/VD
aaatgtagcctggtggtgttcccaggaggaaaagaacgagagactggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcac

SEQ ID NO: 1532 - DNA, 459 bp, Homo sapiens
  CDS 8..343
  sig_peptide 8..214: Von Heijne matrix score 6.5 seq LLWCPFPLPCARC/SV
accgtgtatgtttacaatgttgtgtataaatgggacaactcctcgccctctacctgtcccctccccctttggttgtatgattttcttcttttttaagaacccctggaagcagygcctccttcagggttggctgggagctcggcccatccacctcttggggtayctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccactcagcctctgctgagaaccattcctgggattagagctgcctttcccagggaaaaagtgtcttctcccc

SEQ ID NO: 1533 - DNA, 509 bp, Homo sapiens
  CDS 14..247
  sig_peptide 14..229: Von Heijne matrix score 6.5 seq LMLFRCCSCCSIG/RR
actgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacggtyccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggacccatctcgcatattaagccacttgcagcaagacagcctgaaacttcgtgactccctgggagcttttgggtggtgg

SEQ ID NO: 1534 - DNA, 502 bp, Homo sapiens
  CDS 229..456
  sig_peptide 229..288: Von Heijne matrix score 6.40000009536743 seq IVLVLGLKQSINC/IF
ttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaamaggttatcaaccacacatccagtcc

SEQ ID NO: 1535 - DNA, 597 bp, Homo sapiens
  CDS 129..554
  sig_peptide 129..185: Von Heijne matrix score 6.40000009536743 seq SVFLLMVNGQVES/AQ
cttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacytctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagatctgcaagctgctccacccactgaggacaaatagaaacaggtcccctgggagtgctgagtcacg

SEQ ID NO: 1536 - DNA, 492 bp, Homo sapiens
  CDS 176..424
  sig_peptide 176..310: Von Heijne matrix score 6.40000009536743 seq LHLLGSSNSPASA/SQ
attttttggcctgtcaggtccatccggcgrtgctgggtctggacgagctcgggaggagtggttgtggccattgcacacaggcggatctgaggttcggcgacgcsctggtcgcgacccgggacaggacaacgacaggaacaccgccgagcccgcgttcccccccccgcccagagtcatggcggcasagccgtctgagggcgcctgctcagatggagtttcgctcttgttgcccaagctggagtgcaatggtgccatctcagctcactgcaacctccacctcctgggttcaagcaattctcctgcctcagcctcccaagtagctagtattacaggcacctgccaccacagcaggctaatttttgtattttcggtagagacagggtttcaccatgctgaccaggctagtcttgaactcctgaccgggtgatctgcctgcctcggcctcaaagtgctggaattgcaggcgtgasacttgtgccttggccagttgtt

SEQ ID NO: 1537 - DNA, 452 bp, Homo sapiens
  CDS 111..272
  sig_peptide 111..161: Von Heijne matrix score 6.40000009536743 seq LTFAQLLFATVLG/IA
aattgtagacgtcagtgttggtgttaacatttcagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactaaaaatacaaaaatcagccaggcttggtggcatgcgcctgtaat

SEQ ID NO: 1538 - DNA, 496 bp, Homo sapiens
  CDS 281..430
  sig_peptide 281..418: Von Heijne matrix score 6.40000009536743 seq GIGLCSVLPLVLS/AQ
atagcaggagttctccatggctgtgcttcagtgaaggggcttcgtgcctccggctgtcgtgcaggagttttaatatccttcccatcctgtgctgcctccttgctaggaagacgactgcaccccagccaaggacaaaggcctcagaggtgctcattgtccacctgcaggagtgtgcccacagagcttcaagaagatggttctcactcctctcgccctttgccctcattgagaaagctacccacagctatacactgggacggagaaggaagctggctacaagatggggcaagcatgtctgtcactcaaacgctggccttcctggcctagtcacccatttggcacattttcccggatgcccgtgatagtggcattgtgctgtggcattggcctctgctctgtcctccctcttgttctgtctgcccagttcctgtgaagcctagaggcttcttagtctggctcaatgtcttcaacaaagaacacttctcagtccattaag

SEQ ID NO: 1539 - DNA, 501 bp, Homo sapiens
  CDS 289..462
  sig_peptide 289..420: Von Heijne matrix score 6.30000019073486 seq LFFSFFFLRKSLA/LS
accgctgggcgcctgaggcccctgagattccgaaatttttaacctctgaagctgtgccttcacatgatctaggacagcgttcagaagatggctacagtctgttggtttgtattctgtgaaaatagaaaaaaaaatccggaaatgaccataaccgtggggaaatgatgtaactgctaagaattgaatgtgatggcccagcttgagtgatcttctgctcagaccacaccctggactgaaccagcctcctgtttccctcaggcctcctgagtccctgatctccggcaagtgatgctccttctcaccatcgtctgtgccattgccttgaaaactcccttcctggcctcgccctactacatgagccagggacaaccagctgtccttttattcttttcttttttttttttgagaaagagtcttgctctgtcgcctaggctggagtgcagtggctcaatctcggctcactgaaacstccaacctccsgggttcaagtaattcttctgc

SEQ ID NO: 1540 - DNA, 524 bp, Homo sapiens
  CDS 216..380
  sig_peptide 216..359: Von Heijne matrix score 6.30000019073486 seq IVCVLSTQPCCLC/ES
tcattagtgcccccctagaatgaagcagccaagtcttgggttatcacaaatataaacataatttttatatcatattcttttgctaaggtgatctggatatcaattaatttagcattaattattatactgtatgctgtcattagtcatgttacattattaggtattagtcacattacatcataattattttatgcagcctcaacttctttactaaaatgtgcagtagacatcagatcacaaatatcaagacttttgaacaggtgttggcaaattttttttgtaaagggccagaaacaagtacttttggctttatgggttttatagtctgtgtcttatctactcaaccttgctgtctgtgtgaaagcagccatttatgtaaatgaatgggcatgactgtgttctagttaaactttattttgcaaaagcaggtcatgggactgatttgcctgtgatctctgcaacccagctcttgagtaagggtcacagactttgctgtggttaggcaggtactcaatgagtaagtg

SEQ ID NO: 1541 - DNA, 536 bp, Homo sapiens
  CDS 239..394
  sig_peptide 239..334: Von Heijne matrix score 6.30000019073486 seq TVVLCVGCSTVLC/QP
tacgctgatcgctcccctctcctcgcaggaggatggatttttaaatctgggaagtcttgtgctacaggcaaagaccaagtgaagagatgtgtgagatttttttcgagctggcaaaaaggagaccctatccaggagactaggctttaagttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaactaatttaccaagataatgtaattacatttggttttgtaaggtaaaaaaaaaaaaaaatgcgaa

SEQ ID NO: 1542 - DNA, 451 bp, Homo sapiens
  CDS 90..290
  sig_peptide 90..281: Von Heijne matrix score 6.30000019073486 seq TVVLCVGCSTVLC/QP
agaagttgatgcccagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacatgaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttgg

SEQ ID NO: 1543 - DNA, 923 bp, Homo sapiens
  CDS 174..527
  sig_peptide 174..341: Von Heijne matrix score 6.30000019073486 seq RVLFTQLLLWVWP/GD
attttcctgttaggccaagagagaagaggatccttcctcagagcctccagcctcccttgatcccttgcttgtgggcatatgtgggtcatatttccctcccatcaccctctgcacgccacccccatcaccgccacagacccccagcccttcagttgccctgcacctccttggtgatgcagccgtccttgttaaggtcatacaggttgaaggcccaattaagcctgtcatctacagttccccgaagaatcacggacaaaccagccacaaagtcctgggaaggaggcaggagggagctgtgtcctcgggtactcttcacccaactccttctctgggtttggcctggagatcctggccctgaactccaggaaacaggcttccctggcccacctcgcccagctcacctcaaaactgaccgagccatcatggttggtgtcaaaggcattgaagagaaaagtggcataggtgctggagtctgcagggtgagtgtggagaagttggcttccacacaggagaggacttcctccctctaaggagctccccataccccccatcaccttggcattcccagctcctccagaatccctccctccctcagcctagagaaggacaactgcttccccttgggccttgtcccctcacctccttgaggaaagaactgggagtaaatctgcttgaagttctcctcattgacaattccgctgggacattcctggaaggagagggcaccaggctgagggcagagacaaaatccccttccgttcaccgcccccaccctccatggcccaagactcccagggagggggataatcttcaagcctccagaggactcaccacgtggctcatgtgatgggagggaagacttctttcccagtgcacaaataaaaaacatggaacgaaaaaaaaaaaaaaatgcgaaaagcttt

SEQ ID NO: 1544 - DNA, 463 bp, Homo sapiens
  CDS 121..390
  sig_peptide 121..306: Von Heijne matrix score 6.30000019073486 seq LPTASTLFSLVLC/DV
aattattctgcaatcttcctggtcctgccattaatttatttaagtcctggaagaatacttaaattggtctcaagttccatcagcaagatgggacgactccattgaaaagaaacataatatatggaaaaattactagaaaatctaggaaaactgactgaatgctttggaaagacacagtcaagattaaaaaaaatgtgtcacaagaaagtttacagaacctactcaaactcaaagagaaatcagagactaaattctcaaaactggaagctccctacagcatccacactcttcagccttgtactatgtgatgtgtattacgaatggagccaccggcagtatttgtatgaacatgagacaatgtgtggcagatgcttggtgctttgtaatatttagtaaaataaaacaataataatgtaaaaaaaaaaaaaaaaaaaaaaaaaataaaaaaaaaaaaaaatgcgaa

SEQ ID NO: 1545 - DNA, 480 bp, Homo sapiens
  CDS 93..344
  sig_peptide 93..284: Von Heijne matrix score 6.30000019073486 seq TVVLCVGCSTVLC/QP
  misc_feature 458: n=a, g, c or t
cccggaagttgatgcccagcgcagatcgcttgcagcttgctagctgtgtgggctgggaggtctggtagggctgagcttgcaagaggatcaasatgccyttggskagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggtttngtaaggtatacagcagtaatct

SEQ ID NO: 1546 - DNA, 535 bp, Homo sapiens
  CDS 88..339
  sig_peptide 88..279: Von Heijne matrix score 6.30000019073486 seq TVVLCVGCSTVLC/QP
aagttgatgccsagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaaaaaa

SEQ ID NO: 1547 - DNA, 465 bp, Homo sapiens
  CDS 133..339
  sig_peptide 133..291: Von Heijne matrix score 6.30000019073486 seq KILLILWSLLLDS/QT
aaaaaaaggtataattacaaacatgaataccaaagaaaacgggaaaggaggcatcaacaaatgagatatataactctttaggaagaggggattgattttacagatgagacgggttgaaaagccctagcctaaatgtactgcaaagaggtttctgaagatatgcaagttttcagaaaaactgacttctttagacatgagacgaaattcagaaaactaagactcctgatgatatggattttgatgttgcacaataaaatccttctcattctgtggagtctactgctcgatagtcagactgttttckgttcatatcaagtaaagcctgcctattggggcaaatagagttcagaattcccccttaagggaggaggccctcccccaaaatatgccaactgacacgagtggaggagaacagttcccahtctcctggtgttactatcttaaagaacacataaccaagaggtw

SEQ ID NO: 1548 - DNA, 496 bp, Homo sapiens
  CDS 139..426
  sig_peptide 139..195: Von Heijne matrix score 6.30000019073486 seq VLMRLVASAYSIA/QK
agggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaagkcttcttgacaatgtaacagttcttattggaattgcttatgaaggaaaagccatagcaggagttattaaccagccatattacaa

SEQ ID NO: 1549 - DNA, 468 bp, Homo sapiens
  CDS 84..326
  sig_peptide 84..146: Von Heijne matrix score 6.30000019073486 seq LGLSVLLTAATVA/GV
agtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcata

SEQ ID NO: 1550 - DNA, 544 bp, Homo sapiens
  CDS 205..354
  sig_peptide 205..306: Von Heijne matrix score 6.19999980926514 seq VISLIFFLQTTIS/FG
tctagcacagtgttatttaatctggacaatcttaaatctaggtatgtattctttatatacagctaatatgcaattctaaaaccaaagcaaattcacagattctattcaaacaaaactacaaacccagtaattctaattagcaacattaattaacatgacaaaggatcttgttttgctaatgtaaatcatagcttgaaacataaaatggaactcactgctatggcttttttgccttgcctttacttccatatgtggggttttgaccttgttatctcactgatattctttcttcaaactaccatttcatttggactgtgcgttgtaatatcatttggccttcacttgactcaaacttaatataaaacccattgtaagctctggccaggcacagtggctcatgcctgtaatcccaacactttgggagatccaggcaggaggatcgcttgaggccagtagttcgagactagcctgggcaatatagtaagaccctctctctataaaaaatttgaaaattagctttgcatgctggtacatgcctgtagtc

SEQ ID NO: 1551 - DNA, 508 bp, Homo sapiens
  CDS 43..360
  sig_peptide 43..144: Von Heijne matrix score 6.19999980926514 seq LCLWTGECAPVLG/SP
aggaggaatgaaggagagcagagaggagaggcttggagaaaaatgagaagtctctccagccccaatgacggcaagcaccctggagctgagggggctgagtggcggctgtgcctttggacaggtgagtgtgctccagtcctgggctccccacctgctgcacacatctggagtctacctgggccggagagacatttgactttaagacctctgtgtctctctcactgggtcctgtggaatttgcccaggaatggctgtgaaatacccctactccttttgctcccattaaagggggcatatcagaatgggagtggcagttgtaaaagtaataagtcatttacaataatcagcatttatatgaaatgactgtgacacatctcccacatgactgggtcacctgcatgtgatgtgactccagggctcttagcacaaagcgtcatggcaaactatgcctggctctaactctcactggcattttgggggacatcaaagctcagtacagactctgccc

SEQ ID NO: 1552 - DNA, 537 bp, Homo sapiens
  CDS 252..461
  sig_peptide 252..443: Von Heijne matrix score 6.19999980926514 seq FILGLHWVLTLRA/VI
aaaacacatccaagcttaagacggtgaggtcagcttcacattctcaggaactctccttctttgggccacggaattaacccgagcaggcatggaggcctctgctctcacctcatcagcaagtgaaccagtgtggccaaagtggtcagggtggcctctggctctgccgtagttttgcccctggcacaggattgctacagttgtgattggaggagttgtggccatggcggctgtgcccatggtgctccagtgccatgggcttcactgcggcgggaatcgcttcgtcctccatagcagccaagatgatgtccgcggcggccattgccaatgggggtggagttgcctcgggcagccttgtggctactctgcagtcactgggagcaactggactctccggattgaccaagttcatcctggggctccattgggtcttgacattgcgggctgtcattgcgaggttctactagctccctgcccctcgcccttgcagagaagagaaccatgccaggggagaaggcacccagccatcctgaccagcga

SEQ ID NO: 1553 - DNA, 679 bp, Homo sapiens
  CDS 240..443
  sig_peptide 240..320: Von Heijne matrix score 6.19999980926514 seq ALLLLPFMLGVKP/EA
ccccggtgtgtgatgttccccttcctgtgtccatgtgttctcattgttcaattcccacctatgagtgagaacatgcggtgtttggttttttgtccttgcgatcgtttgctgagaatgatggtttccagtttcatccatgtccctacaaaggacatgaactcatcattttttatggctgcatagtattccatggtgtatatgtgccacattttcttaatccagtcatgtagattttcttgatgtgcagacactcctcccacatagcagtgctccctgctctggctttactgttgcttcctttcatgctgggggtaaagcctgaggccctgtgggcagaggcagcacatgcgggtacccgtgtgctgtacagcatcacctggtcagcccggggaccttggcccactctcctacttacacttgaaaatacaaactttcacaaaggttaagtgagttcttcaaagttatctgaaagttaatgtcatggccacaggtggagccaggtctcctatctcctcacctctcagtgataaaggataggtttttaggccgggaacagtgctcacgcctgtaatcctagcactttaggaggctgaggtgggtggatcacttgaagtcaggagtttgagaccagcctggccaacatggtaaaatcctgactctactaaaaaaaaaaaaaaaa

SEQ ID NO: 1554 - DNA, 357 bp, Homo sapiens
  CDS 107..298
  sig_peptide 107..172: Von Heijne matrix score 6.19999980926514 seq SCLCPALFXGTSS/FI
  misc_feature 160: n=a, g, c or t
cagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccmnggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaaaaaaaaaaaaaaadraaaaar

SEQ ID NO: 1555 - DNA, 546 bp, Homo sapiens
  CDS 202..510
  sig_peptide 202..273: Von Heijne matrix score 6.19999980926514 seq LLLMHSPLPAAPG/FP
ttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaaaaaaaaaaaaaaatgcgaa

SEQ ID NO: 1556 - DNA, 430 bp, Homo sapiens
  CDS 224..382
  sig_peptide 224..274: Von Heijne matrix score 6.19999980926514 seq LVLILHCVSLSKC/VH
atctttaaaatgaatagacagctcactctatagaaaaaaactctactccctcccctcatctgcctcctgcagagtcattcaaagtaaaccccacatctaccacataatcccatattcatagcaaatcagatcatccctgacattatctccaaatttggtgaaaggtccattgggcctgttaaaatatcttaactttattgaactataatttacacggaatgatatggatccatctttagtgctcattttgcattgcgtgagtcttagcaaatgtgtacaccaccaccacaatcacaatttaggacctttctggcaccccagaaagcttgttccagtcttcttgaagtccatttttcccaaccccttggccccaggcaactactagtctgctttcctgtcacttttagattctttttgctctctctgggat

SEQ ID NO: 1557 - DNA, 492 bp, Homo sapiens
  CDS 151..363
  sig_peptide 151..282: Von Heijne matrix score 6.19999980926514 seq LMLLSLTRXFVQC/LA
atttggggcttgataaagagactaagaggcagcttctcagcatgtttatttttaatagacataaaaaatgaaaacaaaaacaggctttctcactccttggaactctcgttgacagaaaagtactgagtacacagaagtggcgacgggcaaatggagatcctggaaaaggaggttttctaccmaaatatccttgtgaacatgrggacagcttccaaactgagaaagagtgggctcgagaaagctctaatgcttctttccctgacacgaakcttcgtgcagtgtttggcatcaacatgtcggagccgtggcaacgttctccgtgcatccccgcttgggcgtcattttggatgtatgaatatggactgaaggtcaaactcagaccagaggcaggacccaggatcagaggccaggctgatgccaagggtaaaggacaggatgagaggactctgcaaaattgttctcctttggccggtaccctgccttggtttctct

SEQ ID NO: 1558 - DNA, 540 bp, Homo sapiens
  CDS 50..520
  sig_peptide 50..445: Von Heijne matrix score 6.09999990463257 seq SSLLLYLQHASWA/VT
agttgcgtcatatccggcccttgcgatcagggcttgaggaacccgcgccatgaagtgcgtgtttgttaccgtaggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgraagaagacattcagaaagcagatcttgttattagtcacgcaggtgcaggragctgtttggagactctggaaaarggaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattwcaaa

SEQ ID NO: 1559 - DNA, 490 bp, Homo sapiens
  CDS 92..310
  sig_peptide 92..262: Von Heijne matrix score 6.09999990463257 seq LMLRIQFCILVLC/SF
tggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgmwagggatttccagagaatgctctgtgtattgaagcacagaaggtgtttctgtgtctcagtgtgtttctgtccctaggtttaaggcttcatgtcatggaggagattttatagat

SEQ ID NO: 1560 - DNA, 584 bp, Homo sapiens
  CDS 233..454
  sig_peptide 233..370: Von Heijne matrix score 6.09999990463257 seq FTLLTWCLPACQP/ML
tttgtttttcctatcccaagttgtattactagttttggggagtttgcagacaattgaatattctataggctgtgttgcagctttagatggatcgacctgtcatgtttttgaggttatccaggctgtatatctctggagagaagggaatggcaaagagtgggagtctgagtcaagtttggttttgtttttttaagagacaaggtctctgtaatccaggctgcagtacactggcatgaccatggctcactatagacttgggctcagccaatcttcctgcctcagcctcctgagtagctgggtttggttttccccagggccatatgtcagcttatttaccctcctcacttggtgtctcccagcctgccagcccatgctgttcatccagtatctgctgaatggtgattacctattaagtggaactaacacaaaagtcttatctaaaagcaattattggtgattatttccttgcagtggcccactagagggcgccattgttaagtgtaattccagtaggtgttttgtgtgtttttttttttaatggaataaactgaaatctttacatggtcaaaaaaaaaaaaaaaaav

SEQ ID NO: 1561 - DNA, 466 bp, Homo sapiens
  CDS 179..397
  sig_peptide 179..352: Von Heijne matrix score 6.09999990463257 seq ECLYLLCLSWSLS/WT
  misc_feature 412: n=a, g, c or t
aaaaggcccattcacctcttcaagaaaccagggaaggggaaaatgaagctgttgggacacacttcggcacctgctccattcccatcaagaaagacaactacaaagtctcatctggtaaattgcattaggagggcccagaagttcagggtgatgtgagtcatttctatcaggtttggaaatggaaagatgtgctgagctctacttcaaacttggtgtcggtgagaacaaaagatgcatgcaaggacaactgaaatccaacacttttgaaaaccacgttggtcttcacctgctaaaatatacactgtttggcacagagtgtttatatctcctgtgtttatcctggagcctgtcatggactaattgctcaagtaatcattgctgcatgtggatgactgaatgaaagactgaaganacatttcaacatggcagcatcctagacttgggaaagaatgagtagtccctggag

SEQ ID NO: 1562 - DNA, 525 bp, Homo sapiens
  CDS 179..397
  sig_peptide 179..352: Von Heijne matrix score 6.09999990463257 seq ECLYLLCLSWSLS/WT
aaaaggcccattcacctcttcaagaaaccagggaaggggaaaatgaagctgttgggacacacttcggcacctgctccattcccatcaagaaagacaactacaaagtctcatctggtaaattgcattaggagggcccagaagttcagggtgatgtgagtcatttctatcaggtttggaaatggaaagatgtgctgagctctacttcaaacttggtgtcggtgagaacaaaagatgcatgcaaggacaactgaaatccaacacttttgaaaaccacgttggtcttcacctgctaaaatatacactgtttggcacagagtgtttatatctcctgtgtttatcctggagcctgtcatggactaattgctcaagtaatcattgctgcatgtggatgactgaatgaaagactgaagaaacatttcaacatggcagcatcctagacttgggaaagaatgagtagtcctggaggctggccttctggtggctaaagtgtttctgcatgttctacagccatgggtcaggagagcc

SEQ ID NO: 1563 - DNA, 515 bp, Homo sapiens
  CDS 28..363
  sig_peptide 28..315: Von Heijne matrix score 6.09999990463257 seq LEMLTAFASHIRA/RD
acgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgakaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgcaaaaaaaaaaaaaaaaaacc

SEQ ID NO: 1564 - DNA, 522 bp, Homo sapiens
  CDS 28..363
  sig_peptide 28..315: Von Heijne matrix score 6.09999990463257 seq LEMLTAFASHIRA/RD
acgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgakaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaatgtttctggaacaagacaa

SEQ ID NO: 1565 - DNA, 478 bp, Homo sapiens
  CDS 90..257
  sig_peptide 90..179: Von Heijne matrix score 6.09999990463257 seq ILPLLWKFFACRG/AC
  misc_feature 99: n=a, g, c or t
aagttttcgctgggcaactgagaaggtcgctgtcaagatggagtttccaacccagtaaatccaagggccagaccgtgacctcataaagcatgatcttsnttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctsagaaagaccagctgtagc

SEQ ID NO: 1566 - DNA, 474 bp, Homo sapiens
  CDS 4..339
  sig_peptide 4..291: Von Heijne matrix score 6.09999990463257 seq LEMLTAFASHIRA/RD
accatggcagctgccttggctcggcttggtctgcggcctgtcaaacaggttcgggttcagttctgtcccttcgagaaaaacgtggaatcgacgaggaccttcctgcagacggtgagcagtgataaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaacccctgcaa

SEQ ID NO: 1567 - DNA, 521 bp, Homo sapiens
  CDS 22..327
  sig_peptide 22..87: Von Heijne matrix score 6.09999990463257 seq LVVVLLWEAGAVP/XP
acagagacgcggaccccagacatgaggaggctcctcctggtcaccagcctggtggttgtgctgctgtgggaggcaggtgcagtcccascacccaaggtccctatcaagatgcaagtcaaacactggccctcagagcaggacccasagaaggcctggggcgcccgtgtggtggagcctccggagaaggacgaccagctggtggtgctgttccctgtccagaagccgaaactcttgaccaccgaggagaagccacgaggtcagggcaggggcccatccttccaggcaccaaggcctggatggagaccgaggacaccctgggccgtgtcctgagtcccgagcccgaccatgacagcctgtaccaccctccgcctgaggaggaccagggcgaggasaggccccggttgtgtgatgccaaatcaccaggtgctcctgggaccggagaagaccaagaccacatctaccacccccagtaggctccaggggccatcactgcscccgccctgtcccaaggccaggctgtt

SEQ ID NO: 1568 - DNA, 499 bp, Homo sapiens
  CDS 281..451
  sig_peptide 281..409: Von Heijne matrix score 6.09999990463257 seq LSLKLVFLPQCKA/IL
tatgtgctacaaatgtgctttggctttagaaagggatggatgagaagacagacctgagaccagtctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgattatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaacta

SEQ ID NO: 1569 - DNA, 673 bp, Homo sapiens
  CDS 201..578
  sig_peptide 201..323: Von Heijne matrix score 6.09999990463257 seq CMLGCVSWFTCFA/CS
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggagattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggtgtgtcccagggccctgccagtcccaggtggaggtatccctgggccctggcactgattataggacactgggcaaracactgcaccgcacgtgactcagttccccatctgcctgatgggtgttgctgtgagaattatgaaatgaaatgatgaccatgaaaatattgtagaagccaagaaatgcttcagaagttataaagctctccccaaaccgtgttatgaaaaaaaaaaaaaaatgcgaa

SEQ ID NO: 1570 - DNA, 509 bp, Homo sapiens
  CDS 109..381
  sig_peptide 109..351: Von Heijne matrix score 6.09999990463257 seq LLNSCQMAXATWG/EE
  misc_feature 430,442: n=a, g, c or t
aaaggcattcaaggttggtctggccccaagaactgtacagcagcagcagcagttcagctggcagaggtgctgttgctgagctgggagtggaaagcacattttctcttcatgatagatggtgtacctgcacgtgggaaggtgagaggtggtgacagtgggggcggggactccaccatgggacctattgagctggggtcttcatccgttccagctcctggcccagaaggagcctcaccatggcttcatgatggcctcaccatggaacccaagaacacagctgccacaggactgctcctaccctcccaagagccactcttaaacagctgccaaatggcascagcaacctggggtgaagaggtgggcagtaaatggatgtggtcctagtgaagtcttctaacaagatttctgacagtcttactctgtcacccangctggagtgcantgccacaatcttggctcattgcaacctctgcctcccaggttcaagcgattctcatgcctcacctccg

SEQ ID NO: 1571 - DNA, 482 bp, Homo sapiens
  CDS 23..370
  sig_peptide 23..229: Von Heijne matrix score 6.09999990463257 seq SILLMGIVGPITA/GI
gattgctgtttgctgtaaagtgatggggaggccctggatggtgatgatattggagtcaaaatctgaagaaaagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaagggaagcaacttggatg

SEQ ID NO: 1572 - DNA, 322 bp, Homo sapiens
  CDS 72..296
  sig_peptide 72..128: Von Heijne matrix score 6.09999990463257 seq LTPVILXLREARA/DG
tcaagaaaaaaaatttttttttttttggaagaatttgaaagctgctgatccagagtcattcctttaagaaaatgggccgggcatggtggctcacacctgtaatcctggsacttcgggaagccagggcagatggatcagttgagctcaggaatgtgagaccagcctgggcaatgtggcaaaaccccgcstctacaaaaaatacaaaaactaggtgggcatggtggcatgcgcctgtagtcccagctactggggaggccgaggtgggaggatggcttgagcccggaaggcagaggttgtagtgagctgagattgcagcactgca

SEQ ID NO: 1573 - DNA, 502 bp, Homo sapiens
  CDS 267..479
  sig_peptide 267..374: Von Heijne matrix score 6.09999990463257 seq LTLWTTSHSVTQA/GV
cccttccagcctcagggcccgcctggcaggactactgagcaaggccttggaaaatcggagcgattagagcggttcaaacaatacagaagtgtataaagtaagaattggaagtctcttcgctgctctaatctcactcctcagaggtgatcactgtgtggaagatgatcaaagtatgacatttcttctaccccagaggctggcatttctgcaggcacaaatgagcttggttttcaagcactgctctttgaacacaaggaattcctttaatgatcacgccggactatatagactttggaatcagactctttgaattccagctctgccatttaccaactttgacactttggacaacgtctcattctgtcacccaggctggagtgcaatggcacaattatagctcactgcagcctcaaacacctgggctcaagcaatccttccacctctgcctcctgagtaattgggactacagggatggggaatgactatctccaattaaaacttc

SEQ ID NO: 1574 - DNA, 566 bp, Homo sapiens
  CDS 176..439
  sig_peptide 176..247: Von Heijne matrix score 6.09999990463257 seq AALVSLFAPAAPC/SI
  misc_feature 525: n=a, g, c or t
agaatcgctcagctggttgacgttatccaggagaatcgcgttggactcagggaagacctgcacaggatccggttgttgctgggtccgagggctgtagggagtggagaaagggccgggaatcgttaagcggggtctgggagaacgacttgcagattcacatttcctccgcccgcggatgtcctccggggaattgaggcttccttcctcagctgcccttgtttctctctttgctcccgctgccccttgttctatttcgtttcttactatttatgtagtctcattgcttgcggttataatggccaccactttattgagcattcactgtacaagcatctcgcagcaggcgctcataagcgtctggcaattcttggccactgctggaagcccaatcattcttttaccatggaagggatttgagagcctacataatcctgtactctaatagccacatggtactcttggggctaggaagataaagtagaaattgaaattgctgttgtattagttttctgaagctgccayganccaagtactcacactggatagcttaaacaacagatatattt

SEQ ID NO: 1575 - DNA, 503 bp, Homo sapiens
  CDS 33..224
  sig_peptide 33..188: Von Heijne matrix score 6.09999990463257 seq LLLLKVQPRRTQA/FD
  misc_feature 338: n=a, g, c or t
catcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctccactactttagttgaaatgggagcatgctggagtcggcgttctgttgcttctggtgagaaggacatcccattgacccctggccaccaggtccagtattccatccttccttctgtcccagcctatcnccctccccactaggcccacccccacaacttctcctcaagggaggttgctcccgcagctggagggcttgcacagaccagcagtcacagaaatcattcttcctgctgtactgggccttaactgcctgcaaatgtccagcactactgcataggatgccagagccaccg

SEQ ID NO: 1576 - DNA, 529 bp, Homo sapiens
  CDS 114..332
  sig_peptide 114..260: Von Heijne matrix score 6.09999990463257 seq LLCCVYSLPLVTL/QE
aatccctttcattctgtatctgaaaaattggcactaaaagatttgcagttcatctctcaacacagatgtgcagatattaggttcaaactgatactaattgagacttaaattggatgggttctcccagaaaggaagcagcagttggtgggataggtagatctggggcagtcctggcactgcctgacaagtgtttggctattctaggccaggtccacacaggcctcctgtgctgtgtatattccctgcctctggtgaccttgcaggaaatagagtcatttttcagcaatacgattttttttcctgctcctgtttttgtggatatccttgtattctgaactaaattggaattccctgctctgagattaattcctagggcacatctttccacatacatgtcaaattgggcaagctgacttgtgtggatataaagaagggaggaatgagaagttcagaaagtttgacctgtcaaattataaaattcgtcagcaactctttcaatgtttggttgcaatagggaggtagagaggaa

SEQ ID NO: 1577 - DNA, 468 bp, Homo sapiens
  CDS 21..179
  sig_peptide 21..137: Von Heijne matrix score 6.09999990463257 seq AIARLFLSPAASC/LV
  misc_feature 450: n=a, g, c or t
ttcgcccctcggagctggaaatgcagctattgagatcttcgaatgctgcggacgtggaggcgaggcagctggggaggtccgagcgatgtgaccaggccgccatcgctcgtctcttcctctctcctgccgcctcctgtctcgtaaataacttttttactctaaagaaagaaagacaaaagtagtcgtccgcccccatgcatcccttctacacccgggccgccaccatgataggcgagatcgcgccgccgtgtccttcatctccaagtttctccgcaccaaggggctcacgagcgagcgacastgcagaccttcagccagagcctgcaggagctgctggcagaacattataaacatcactggttcccagaaaagccatgcaagggatcgggttacsgttgtattcgcatcaaccataaaatggatcctctgattggacaggcagcacagcgnattggactgagcagtcag

SEQ ID NO: 1578 - DNA, 404 bp, Homo sapiens
  CDS 51..254
  sig_peptide 51..203: Von Heijne matrix score 6 seq RQSLLCLGPWCXG/WG
cactgacctattaaattggggcttggtgcttttccaccttccccctctgaatgaaagccaaggaatgggggragagcgggraactctgccgcgggaggtggagcaagaacggtgaagggccctggtcccagagaggctggtgggtccctctcccaaaggaaggcagacagtctctgctttgccttggaccttggtgcwgggggtggggaggcctgggggggacactccccactcccattccccttcctktgtcctaatcctggarsttaagtacaggggtttataggttctatttcttcccaaagagccctgcaaagaaccccagtttcctatttggatgcccctacactgttgtgtttcagtggaatgtattttcatttaaaaacaactttgaatggggcact

SEQ ID NO: 1579 - DNA, 494 bp, Homo sapiens
  CDS 75..332
  sig_peptide 75..215: Von Heijne matrix score 6 seq RLLLPCLVRMALC/XL
agtacggtggccgacgggagtcagacgctggggatgaatgaaggtgctgggtgcaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtsacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttagaccgagtcttgccctgttgcccaggctggagtgcggtggcgtgatctcggctcactgcaacctccacctcctgggttcaagtgattcttctgcctcagtctcccgagtagatgggactacaggcacgc

SEQ ID NO: 1580 - DNA, 510 bp, Homo sapiens
  CDS 275..448
  sig_peptide 275..343: Von Heijne matrix score 6 seq LPLLITLEISAWG/HL
aaggaagagagttcaaggaactaatagctggtgtttaccacactcacaaaaatatacaaatgaatgaaaatggttatgacccacccatgactgcagtgggttcactgtcatctgatgtgatctataccacctgttcctatgtgactgagaggaccactggccatccatagcctgggaggttacatcatcactttgcacctcacactctagaaccagataaggaagaacagtgtcacatgagggaaaacttcctagcagttggagatgcccaacaatgagtgatcacattgttttaaaagtgagactcccattgctgatcaccctggagatttctgcatgggggcacctgaacttgaaaatctctgaagtgcctcgcaagattcagggcactaaggtccaaaggagtgaagattggcaaactgataataactccccaaatctattacactgacatgtatcatcaaattaataaattccataaaaataaaaaaaaaaaaaawtsccaaaatt

SEQ ID NO: 1581 - DNA, 435 bp, Homo sapiens
  CDS 21..377
  sig_peptide 21..101: Von Heijne matrix score 6 seq PCLYILMFGCVFA/KV
taattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaa

SEQ ID NO: 1582 - DNA, 487 bp, Homo sapiens
  CDS 272..481
  sig_peptide 272..457: Von Heijne matrix score 6 seq LSLRICTSPWVSG/SS
atgaatgagattagagacacaggagacataatctttctttctctttccatcttgtacggatatgacaagaaaatggctatgtgacccaggaggatagccttcacgaagaacctcaccatgctggtaccttgatcttggatttccagcctcsagactgtgcatcatgcacgatagaactgctgtaccccaaagcaagccataaaatctrggaagactatctgaccctctcttctcctccctgaagacccttacatgacaagtgtcatgccctatgcccagaggaagaaatgctacacagagaggcsaagaaaaatctgaacacacaggacttgttggaattcccctmaagttattatcattacatsatgccttttttgtcsagtcatatttctacacagctgtccattcttcatcgaacctaagcttaagaatatgcacttctccctgggtctctgggtcttcatttctgagcgctcccatgtgatgt

SEQ ID NO: 1583 - DNA, 455 bp, Homo sapiens
  CDS 143..433
  sig_peptide 143..217: Von Heijne matrix score 6 seq LLGLLVAVATVHL/VI
ctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttttactctcagctaatagttagaggagtgcttgg

SEQ ID NO: 1584 - DNA, 501 bp, Homo sapiens
  CDS 225..458
  sig_peptide 225..266: Von Heijne matrix score 6 seq ALLGFLAAQWLSS/RG
aggggtgggggcagtctccacagcctcccacaagggagttaccaccttcccgcacttctgggtacaagtctcctgctctggctgtattccacagttagaacttcatatctttggcttagagctgaattttctgttaccatgtggatgctccagatgaaggagcctttgatgaagtgacctcatgcctggtgaaggtgccagagaagacagaaggtggcaacaacatggctctgctgggcttcctggcagcacagtggctgagttccagagggaaaaagtggaagcttccagtttccttaaggactagtccaggaactgcccagcatcacttctacattattctgctgttcaaagcaagttgtaaaatgagccaagattcaagaggaatctgtcctttggataggaggagcagaaaagaacttgcagccattttcaatatgccacacacctcatcaaattaacttgtattttcttctttactataaaaaaaaaaaaaawtcc

SEQ ID NO: 1585 - DNA, 492 bp, Homo sapiens
  CDS 229..465
  sig_peptide 229..408: Von Heijne matrix score 5.90000009536743 seq LTSIAVLPRNASA/WS
  misc_feature 65: n=a, g, c or t
cttgaactcctacctcgtratctacccgccttggtctcccaaagtgctgggattacaggcgtaanaccgcgcccagcccctctgcctcttttaagtgcttgcatggctgaccatagaaggttctcttcagaaagaattttccccattacaggcagatattttcccccaagatttattttgaaaatttgtaaacagagtgaagtgcaaacaactgtggcatgaaaacccatgtaccaaccacctaattccacctttggtgctttgcagctcccctttgtccgtccatccatccctctgtctgtccatccatcctgctatctgtccatccatccagccctctatccatcaatccatctggtttcagagtcactgaccagcattgctgtgcttccccgaaatgcttcagcctggagcacaggacttaactgttgctggtttttctccccagccttattgaggtgtgattgacaaataaaaattgtatatatttaa

SEQ ID NO: 1586 - DNA, 499 bp, Homo sapiens
  CDS 69..443
  sig_peptide 69..398: Von Heijne matrix score 5.90000009536743 seq WTLILQLSMFLRS/WI
atattaatcacggagttccagggagaaggaacttgtgaaatgggggagccggctggggttgccgcaccatggagtcaccttttagcccgggactctttcacaggctcgatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctccctttccttatatggtgaaactctaatagtctctcttcagcggmscactgaaggaagataagcctgtcact

SEQ ID NO: 1587 - DNA, 492 bp, Homo sapiens
  CDS 261..452
  sig_peptide 261..329: Von Heijne matrix score 5.90000009536743 seq SALMLLPCRPVLT/SV
acagtcaacgtcatctaggagcaccgagcagcttggctaaaagtaagggtgtcgtgctgatggccctgtgcgcactgacccgcgctctgcktctctgaacctggcgcccccgaccgtcgccgcccctgccccgagtctgttccccgccgcccaggtaatccatcttacccgggaagaaggctgcttccattcgggctgccggagatggggtctgcgggcatbagaggcgggagttgcgagtctggtcaggagtcattcagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagactt

SEQ ID NO: 1588 - DNA, 484 bp, Homo sapiens
  CDS 148..411
  sig_peptide 148..279: Von Heijne matrix score 5.90000009536743 seq LHTVVGWLQQLQA/AH
ctctcttcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccctgcctgaaccagccaccagaaggggttaggaccaccacagattgactagatcctaaggattctctacctggggctgg

SEQ ID NO: 1589 - DNA, 428 bp, Homo sapiens
  CDS 16..315
  sig_peptide 16..96: Von Heijne matrix score 5.90000009536743 seq LLGWWQVLLWVLG/LP
ctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacggcagcagaagaggccaatgcggtgctggggctggacacccaaggcgatcacatggtgatgctgtctgtgattcctggggaagctgaggacaaggtcagttcagagcctagcggcgtcacctgtggtgctggaggagcggaggactcaaggtgcaacgtccgagagagccttttctctctggatggcgctggagcac

SEQ ID NO: 1590 - DNA, 360 bp, Homo sapiens
  CDS 72..296
  sig_peptide 72..128: Von Heijne matrix score 5.90000009536743 seq LXPVILALREARA/DG
tcaagaaaaaaaatttttttttttttggaagaatttgaaagctgctgatccagagtcattcctttaagaaaatgggccgggcatggtggctcasacctgtaatcctggcacttcgggaagccagggcagatggatcagttgagctcaggaatgtgagaccagcctgggcaatgtggcaaaaccccgcctctacaaaaaatacaaaaactaggtgggcatggtggcatgcgcctgtagtcccagctactggggaggccgaggtgggaggatggcttgagcccggaaggcagaggttgtagtgagctgagattgcagcactgcactccagcctgggcaacagattcaaaccctgtcccaaaa

SEQ ID NO: 1591 - DNA, 486 bp, Homo sapiens
  CDS 81..368
  sig_peptide 81..245: Von Heijne matrix score 5.90000009536743 seq SALMLLPCRPVLT/SV
aywgysracgwmmksyrssrgacagtcaacgtcatctaggagcaccgagcagcttggctaaaagtaagggtgtcgtgctgatggccctgtgcgcactgacccgcgctctgcgtcctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggcaaaaaaaaaaaaaaaa

SEQ ID NO: 1592 - DNA, 518 bp, Homo sapiens
  CDS 176..367
  sig_peptide 176..244: Von Heijne matrix score 5.90000009536743 seq SALMLLPCRPVLT/SV
  misc_feature 12: n=a, g, c or t
attgcggacgancggcgccggacagtcaacgtcatctaggagcaccgagcagcttggctaaaagtaagggtgtcgtgctgatggccctgtgcgcactgacccgcgctctgcgtctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaagcagtcaaaaggaaaaacatgttaagaccctagacttgtatattgacacacttgtaccttgtaaggcagaggaatgtaattaaaaagcacttatttggctccttttgcatgtagtatgtgtacaggagtcagagagtagaatacaaaa

SEQ ID NO: 1593 - DNA, 611 bp, Homo sapiens
  CDS 115..411
  sig_peptide 115..333: Von Heijne matrix score 5.90000009536743 seq IALVVFLSFLIFS/TS
aagaaaggggtgaggcctaagggacaatcaggatgtttttcagagagaagtgtggatgctggacaggaagaaccacagataccagatacgggtactgttgtaactctgttctccatgaaaaaaaaggaagaaacaacactttcagagatggagcctgttgagccacagtaccaactagtcaatgctgaatcgacttctccctttctacattgcctgagagaagtcattggggaatactctgtacacgaattttcactgttggggaaaacagagagtcaagggattggattgtggattgcattggtggttttcctcagtttcctcatcttctccacaagtttctacatatcgaatgcagagcagcccttcttcaaagaacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattctaaaaaaaaaaaaaaatgcgaa

SEQ ID NO: 1594 - DNA, 511 bp, Homo sapiens
  CDS 99..443
  sig_peptide 99..293: Von Heijne matrix score 5.90000009536743 seq FIEAALLIQGSAA/ST
aaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgctgcgtctacagtaagaaggtggaatacctctactcactcgtctaccaggcccttgatttcatctctggaaagaggcgggccaagcagctctcttcggtgcaggaggacagggccaatggggttgccagctccggggtccccaggaggcagagaatgagttcctgtcgctggatgacttccctgactcccggactaacgtggatctcaagaatgatcagacgc

SEQ ID NO: 1595 - DNA, 467 bp, Homo sapiens
  CDS 95..409
  sig_peptide 95..334: Von Heijne matrix score 5.80000019073486 seq LAILSQLFLHITS/RI
ttcgaagtggttgtstctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatat

SEQ ID NO: 1596 - DNA, 541 bp, Homo sapiens
  CDS 44..427
  sig_peptide 44..229: Von Heijne matrix score 5.80000019073486 seq RLWXLRSPLPIQA/AS
aagttgtcgataggcgggcactccgccctagtttctaaggatcatgtctgcgagccaggattcccgatccmagagacaatggccccgatggggatggagcccgaaggcgtccatcgagagtaactggaatgagattgttgacagctttgatgacatgaacctcttcggagtcccttctccgtggcatctacgcctatggktgttgagaagccctctgccaatccaagcagcgagccatttctaccttgtatcaaagggttatgatgtgattgctcaagcccaatctgggactgggaaaacggccaacatttgccgatatcatttctgcagcaraattgaattagatctaaaagcccacccmaaggccttggtcctagcacccactcgagaatttggctcagcagatacagaaggtggtcatgggcactaggagacysacatggggcgcctcctgtcacgcctgttatcggggggcacaaacgtgcgtgctgaggtggcagaaactggcagatgggaagctccccacatcatcgtgggtacc

SEQ ID NO: 1597 - DNA, 435 bp, Homo sapiens
  CDS 75..317
  sig_peptide 75..179: Von Heijne matrix score 5.80000019073486 seq FLLFRSLPRHTFG/LV
  misc_feature 431,435: n=a, g, c or t
agtcaatacccaggagggcgggatagaaaggactgcaagatggaggaaggcgggaactaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgcttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccangcan

SEQ ID NO: 1598 - DNA, 502 bp, Homo sapiens
  CDS 202..477
  sig_peptide 202..381: Von Heijne matrix score 5.80000019073486 seq SCLFLCNWPGLHG/LL
  misc_feature 149: n=a, g, c or t
cctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaatangtgactcactgaaawtgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggktatgtacttgtgtccagatgaataaagcagaaaaagaggggat

SEQ ID NO: 1599 - DNA, 781 bp, Homo sapiens
  CDS 260..544
  sig_peptide 260..310: Von Heijne matrix score 5.80000019073486 seq CACCLMVAWRVSA/SD
taaaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgagcactgtccasagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcaggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctggaatccagttcatggctattttgaaggaaataacttcaccttaggatcaccattagttattactgtgaagacaggtactacttagtgggcgtgcaggaa

SEQ ID NO: 1600 - DNA, 527 bp, Homo sapiens
  CDS 136..435
  sig_peptide 136..279: Von Heijne matrix score 5.80000019073486 seq ALLWAQEVGQVLA/GR
acttccccgggagccggaagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacacccctctcccggccatggtcaacgaccctccagtacctgccttactgtgggcccaggaggtgggccaagtcttggcaggccgtgccgcagctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagc

SEQ ID NO: 1601 - DNA, 465 bp, Homo sapiens
  CDS 21..233
  sig_peptide 21..161: Von Heijne matrix score 5.80000019073486 seq ICFPLGLLILSWP/LI
acaatcttagccgcatacctatgaaatgtatatgtgtgtgtatatatatacatgaatttgcttctgagattatggaggctgaaattcccaagatggaaggaaagctggatacccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgtcggtcacagtgacaagtacaagtaactatcacatatgccctttgtcatattggtgatttccactgtttttctcccaaactgcagcttatatttgttctcttagtactgttgagcaaaaacttaatttttataaagtcgaatttatcaatgttttctttaa

SEQ ID NO: 1602 - DNA, 561 bp, Homo sapiens
  CDS 165..536
  sig_peptide 165..389: Von Heijne matrix score 5.80000019073486 seq LLCMHLTLALVVT/AH
gagaggaggcggcgcctgtatcggccttcgtcctccgcgggtgtgctagcgttgggacggtcctttgttgccgcgagggtaggagtgggcgtggcggasagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgastcttctctcctctgcatgcacttaactttggcattggtggtgacggcacacagcatgtactgtggcggctggagaatggggagctggaacacatccggcccaagattgtggtggtctgggtgggcacaacaaccacggacacacagcagagcaggtgactggtggcatcaaggccattgtgcaactggtgaatgagcgasagccccaggcccgggtt

SEQ ID NO: 1603 - DNA, 555 bp, Homo sapiens
  CDS 123..494
  sig_peptide 123..347: Von Heijne matrix score 5.80000019073486 seq LLCMHLTLALVVT/AH
aacagtaggtggtcccttccgcacatttcactctgtacagcaaatggtttcttcccatttgctagacagagggctagattttccccgcccactctcgactcttcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgastcttctctcctctgcatgcacttaactttggcattggtggtgacggcacacagcatgtactgtggcggctggagaatggggagctggaacacatccggcccaagattgtggtggtctgggtgggcacaacaaccacggacacacagcagagcaggtgactggtggcatcaaggccattgtgcaactggtgaatgagcgacascccaggcccgggttgtggtgctgggcctgcttccgcgagccaacatccaac

SEQ ID NO: 1604 - DNA, 678 bp, Homo sapiens
  CDS 117..539
  sig_peptide 117..455: Von Heijne matrix score 5.80000019073486 seq FTCFGLLHQLSQC/VT
  misc_feature 139: n=a, g, c or t
cacttcccgacagcctggctcggccactactgggcggggagaccaaggatggaagtgggcttaccggccattaccctctttctcaccagcgccasagccctgtggtggcgacgacgatggaccaggagccagtgggcgntgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaaktgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgt

SEQ ID NO: 1605 - DNA, 200 bp, Homo sapiens
  CDS 35..187
  sig_peptide 35..109: Von Heijne matrix score 5.80000019073486 seq LLWIFSCFRPSGC/IH
ttgatcagttagggtggggcagaaacaaatcacaatggtgaaaggtcatcagttaaggctattttcacttcttttgtggatcttcagttgcttcaggccatctggatgtatacatgcaggtcacaggggatatgacggcttagcttgggctcagaggcctgacacaaaagacctgaaaaagacaacttgagaccaacaga

SEQ ID NO: 1606 - DNA, 583 bp, Homo sapiens
  CDS 139..513
  sig_peptide 139..201: Von Heijne matrix score 5.80000019073486 seq IVMGVQVVGRAFA/RA
rmgsywrwkcscmkgccsmgsgscsyaksrmgymsgvstytswgcssckkwscywgascksykrccmgccgaccacgcttgatccccggccgcggggccaggaagtcggagtttgagccccggagcagagcggctgccatggccaagtacctggyccagatcattgtgatgggcgtgcaggtggtgggcagggcctttgcacgggccttgcggcaggagtttgcagccagccgggccgcagctgatgcccgaggacgcgctkgacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggccmaggaggacagagaaaaagggcagatgccccatacgtgactgctcggctccccccgcccaccccgccgcctctaatttatagcttggtaataaattkcttttctac

SEQ ID NO: 1607 - DNA, 506 bp, Homo sapiens
  CDS 65..247
  sig_peptide 65..127: Von Heijne matrix score 5.80000019073486 seq IVMGVQVVGRAFA/RA
acgcttaatccccggccgcggggccaggaagtcggagtttgagccccggagcagagcggctgccatggccaagtacctggcccagatcattgtgatgggcgtgcaggtggtgggcagggcctttgcacgggccttgcggcaggagtttgcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggccaggaggacagagaaaagggcagat

SEQ ID NO: 1608 - DNA, 355 bp, Homo sapiens
  CDS 83..241
  sig_peptide 83..226: Von Heijne matrix score 5.80000019073486 seq LPFLSFFFFFSIS/VP
ttaactcactaatgtcaaaagtcaaaacctcctaggggttgtcctgggagtcaggttcacgggtacakaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttaaccaagagacttcttttgtatccttttcttgtcctatgatgtaaataaaagcctcgatttatgtaaaaraaaaaaa

SEQ ID NO: 1609 - DNA, 453 bp, Homo sapiens
  CDS 80..304
  sig_peptide 80..289: Von Heijne matrix score 5.80000019073486 seq VLILVATLGELDT/QV
cttttaacagctgaggtctctctttaattctcttaaataccatttctccctcaaaaaagaccattagatcatttcacaaatgtatctgccaccaaacaggtcagagctttgcaactttgctttgtctcttaacctctatggcaaagggttttttagcctggtggaaaagcataacagcagggatttagaagatagagctagttctggcccatcactttcatctccatcacacccggactggggttatatagttctgattttagtggcaaccctgggggaacttgatacccaggtaggtggtcactgatcagtagttgggagaggtaggaattggtgagtacaggtaattagaggaaagtcttgtgtcctgtttccccccttttaattttatcccttgctagaattaagatactatatgcctcacttatcaattacagtctaaatccaaaagaa

SEQ ID NO: 1610 - DNA, 491 bp, Homo sapiens
  CDS 96..290
  sig_peptide 96..266: Von Heijne matrix score 5.69999980926514 seq SHLCFLAFQVLLC/HP
agaatgaaaagaatgggcagcctagtggttgctcaggtgagcgcaggtacacagaccaggaagtatctctgctcctaacctctctttatgtatgcatgaaggctaattgttcaagtccaggggaaactggtgaggttccccgagggattgattgcctcacagctgctaagtatacagaggcaccttttggcattgctgacttctcctatgcgavscctgggctccgaagtcacctctgtttcctggctttccaggtcttgctctgtcacccaggctggagtgcagtggcgtgatcatggcccaaagcagcctcaacctacctgggctcagagacggagtttcaccatgttgcctgagaatcatgtgatcctcccaggaatttgaatggacacaaaactatgtttgaaatatacagcaagatggccacctgcaaaccaggaagagagcccctaccaggctggtaccttaatcttagacttctcagcctgcag

SEQ ID NO: 1611 - DNA, 430 bp, Homo sapiens
  CDS 114..308
  sig_peptide 114..257: Von Heijne matrix score 5.69999980926514 seq VTFSCCRMPPSRA/GP
  misc_feature 277: n=a, g, c or t
agacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcacgagctggaccaccagcggctgctgnagtatttgaagtacacactggaccaatacgttgagaacgattataccatcgtctatttccactacgggctgaacagcggaacaagccttccctgggctggctccagagcgcatacaaggagttcgataggaagtacaagaagaacttgaaggc

SEQ ID NO: 1612 - DNA, 427 bp, Homo sapiens
  CDS 67..237
  sig_peptide 67..186: Von Heijne matrix score 5.69999980926514 seq SLCSLQFLPNLSC/LW
ctgattcttcgaaatgatataagtcctgagggcttcagtcccattcgcgcactcatacttgcaatcatggactacagccgtgtctttcagggtgtgttcttcaccttcaagcatgcttttgctgatggtgcttkgggatctttcatttctctgtgctctttgcagtttctgcccaatctcagctgcctctggcagaccttacaggtacttggaattctggagattatacctgtctcctagttccatggaaaatggagttcaaaaattccacgaaacttttttcattgtctttttgcttttgtttgatatcgagaggaaaggaaaaagttctgtttgtccattttgttacagataaggaaagtggtttcacaaaggttaagcaacttgttcagtgttacccagcaaagagcagaatgattttcaacaw

SEQ ID NO: 1613 - DNA, 478 bp, Homo sapiens
  CDS 127..285
  sig_peptide 127..234: Von Heijne matrix score 5.69999980926514 seq LGLSLWVLAGGMG/EG
  misc_feature 311,350: n=a, g, c or t
accttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctncccctcacccacccgaggctctgccaccgcctggacctncccacccctgadagactggcccctggctccccgcccctcggtctccacgtggtgtatggatctgtggtcattgtcctctgcagaataaagattgctcaggcctgcctggcaaaaaaaaaaaaaaaaaa

SEQ ID NO: 1614 - DNA, 464 bp, Homo sapiens
  CDS 130..300
  sig_peptide 130..201: Von Heijne matrix score 5.69999980926514 seq LIFLLHPLHSATS/VA
  misc_feature 276: n=a, g, c or t
taacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaamccaacagcaacaaaacagngcccatccatgtcagccacaccaatagtttcatgttaattctttgcsactggagtcaattttgctatgagcaatgtaaggctggtaacctttaaattatttggttgatgtggaaaattggtgatgtaasactgtttctagatttttttcattgcctttttattctgatattaggttaatsactttgaa

SEQ ID NO: 1615 - DNA, 513 bp, Homo sapiens
  CDS 135..320
  sig_peptide 135..203: Von Heijne matrix score 5.59999990463257 seq LELLASSEPPTWT/CQ
cgatgagagctcattgcagctttgaactcctgggcttaagcaatcctctcacctcagccttctgagtagctggactacaggcacctgccaccatgttcggctaattaaaaaaataacaaactctgttcgtaaagatggggtcttgctgtgttgctcaggctgctcttgaactccttgcctcaagtgagcctcccacctggacctgccaaattgctgggattataagcatgagccactgcgcccagccttactcacctttttgtatgacactatcagtctttctaaagtgcaaagaaaaagggttctgttatcatctgatgtgaaaattcctttaaacattgactttttctggtgtgaggaatgaaagctgtggaataggtgaagttttatgaaatagtgtttttttgtgtgtgtgtcaacaaaattaagagagtttgggttattgaagatacaagagtgtttttgaaggtatatataggaaaccaaatctcaaatgtggtctgtccttgtgat

SEQ ID NO: 1616 - DNA, 954 bp, Homo sapiens
  CDS 42..536
  sig_peptide 42..281: Von Heijne matrix score 5.59999990463257 seq FGLSLWSFPPSPS/VP
atttttccctgcctcgcgacacccagaccgagacctcgggaatgctccggccccctgccgccgtctcccggcccggttctctttcactaaaaataggcgattctggcagcgccctcctatggggccttgggggcaattggggttttgtcttagagcccgtgtggacccggatggcgacggcagcccgaggagagggagggctgactgtatggttggctttccgacgaccagaccctgcaggattcggcctttccctttggagttttcctccatccccctccgtccctcccaggggatgcccgcagccacagtggtcactgaaggtcaaccctgagccgaagagaagtggcctcgacccttgggaccccttcagaagtctacctgtgcctgcgcccgccggacctgccggcctcttccttctcatccagggggcctcttctccagcctcacggaggtgggaagcttgctggaggcccctacctgccttttggggaagaccccgaggctggcccacgccctgctggcaggacccttcctgactgggtccaccgttcttctgggtctcaccacttctcccagcccctgggctgcttcctctctcccgtgtctgggaccccagaggcaccacttccattccatacaaggtaagagtcccaaggagaggccgggcacggtgctcacgcctgtaatcctagcactttgggaggccgaggcgggcggatcacgaggtcaggagatcgagaccatcctggctaacacggtgaaaccccgtctctactaaaaatacaaaaaattagggcgtggtggcgggcgcctgtagtcccggctactcgggaggctgaggcaggagaatggcgtgaacccgggaggcggagcttgcagtgagccgagatggcgccactgcactccagcctgggcgacagagagagactccgtcccaaaaaaaaaaaaaaa

SEQ ID NO: 1617 - DNA, 483 bp, Homo sapiens
  CDS 32..307
  sig_peptide 32..223: Von Heijne matrix score 5.59999990463257 seq ISILLISFSRTSS/LQ
atgactggtgtctttataaaagaaacaccatatgaagagacagatgtgcatgcaaagaaaatgccatgtgacaacgaaggcagagaatggggtgacactgcaaaaggaacatcaaagattgccagcaaaccaccagaagctgggtgaaccatggaacagattcttcctcacagcccctcagaagatatcaatcctgctgatatctttttctcgaacttctagccttcagaattgtgagacaataaacttctatggtttaagctacctgatgcagtcatgccagagagaaatgatcataaatttgttttgattaggatgattttcccatgtctattggatgaataaccccattggaaagagtagaaaactagatttgagaactaaaatgctgaaagactgactcaaagggttcccaacaggccgcctgcagaccgaggaccaaggagagccagtccaagtcccaaaactgaagaacttggagtc

SEQ ID NO: 1618 - DNA, 461 bp, Homo sapiens
  CDS 75..251
  sig_peptide 75..155: Von Heijne matrix score 5.59999990463257 seq LLGLLYLTNTSIC/QG
catttccccgtaggaaaaatcatgcacacagtaaaaatattcatctgtgaaaacgttactccccaaatgcgtgaatgcagtttctacgagagaagramccagttaaactttccaatcttctaggattgctgtatttaacaaacacgagtatctgccaagggtctgggttaatatataaagatccagtcggtcgggcacggtggctcacgcctgtgatcccagcactttgggaggttgaggtgggtggatcatgaggtcgggagatcgaggccatcctggccaatatggtgaagcctcgtctctactaaagattaaaaaattggctgggcgtggtggcgcatgctgtagtcccagctacttgggcaggagaatcgcttgaacccggtagcagaggttgcagtgagctgagatcgtgtcattgtactccagcctggcgacagagggagactccatctcaaaaa

SEQ ID NO: 1619 - DNA, 468 bp, Homo sapiens
  CDS 65..253
  sig_peptide 65..235: Von Heijne matrix score 5.59999990463257 seq FXLXLFFFPLLYQ/IK
atattgacacataagctctaactcacatgaaacgaaaacacatctctggggctgggctgagcaaatgcattttttaaaaggcccctcaggtgattctgtctcagagatgttgaaaaccagtgggttaggagctcagtcatccactttcagatctktgattatgccgctattaaatacagttggctatcacatagattttatkctttasttgttcttttttcctttgctataccaaatwaaatcttctkagctktagttccagtccttaaaataatkgttgttaccawactkaggttaaacattagtgcatttgcttaacaaggactttaaaacttatcacactgccataatttttaatggttctataatgattaattaataagaaaatcaataattggattttaagcaggaaactaggcaggaaagttgaaattcatagaccaattcaatggaaaacattaaaatgta

SEQ ID NO: 1620 - DNA, 472 bp, Homo sapiens
  CDS 216..383
  sig_peptide 216..353: Von Heijne matrix score 5.59999990463257 seq LAQLLGMVCDVRP/QV
attcaaaacagcatcggccataacaacagaaatggccagtcagtcccaaggtatccagcagcttctgcaagctgagaagcggcagctgagaaggtggcagatgccagaaagaggaaggcccggcgactgaagcaggcaaaggaggaggcacagatggaggtggagcaataccgcagagagcgagagcacgaattccagagcaagcagcaggcgccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtaggcctgactccttctgccagttccctccctcaaagaaatcctccaatcaaaatcacctcccaccataatccctgtc

SEQ ID NO: 1621 - DNA, 499 bp, Homo sapiens
  CDS 30..284
  sig_peptide 30..158: Von Heijne matrix score 5.59999990463257 seq FYLFWLLVGGLST/LR
ttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtgtagaggggatcctggacacactggagggccccaacatcccgcccatccagagggtccccagagacatccctgccatgctccctgctgctcggcttcccaccacmgtcctcaacgccacagccaaagctgttgcggtgascctgcagtsacactgaccccacctgaaattcttggscagtcctctttcccgcagctgcagagaggaggaagactat

SEQ ID NO: 1622 - DNA, 526 bp, Homo sapiens
  CDS 126..371
  sig_peptide 126..254: Von Heijne matrix score 5.59999990463257 seq VVSFALIATLVYA/LF
actccaaattagaaaggggacgtctagtgggttgcccgggagggtggcgggacggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacgagacatg

SEQ ID NO: 1623 - DNA, 513 bp, Homo sapiens
  CDS 140..304
  sig_peptide 140..193: Von Heijne matrix score 5.59999990463257 seq ALFGFLFLLLLLS/NW
aacatttgcccctccttccagaccctggcagccaccattctactctttgcctctatgaatttgactattgtagatagctcatgagtctccatgggatacttgcctccgcagcaccataggagcagtggcagcttggctgatgagctataagccagccttgtttgggttcctattccttctgctgttgcttagcaactggttggtcaagtatgaacacaagctcaccctcccagagccccagcagcttaaaaggaggaagagaaaccaaagacttctgaaaacgactccaagaacagcaaggccgtgaacacaaaagaagtcaatagaacgcatgcctgctttgccctctaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgc

SEQ ID NO: 1624 - DNA, 477 bp, Homo sapiens
  CDS 226..447
  sig_peptide 226..279: Von Heijne matrix score 5.59999990463257 seq FCCCVSLLGMVAS/SS
tcaatccgacaaggtgggaacattggatgcccataggccttctgaaccttgtataataaactacttggggctgtcttttctttagatctcagaaaccacaatgaggaactattatcagtgactttagtcaggggagcaagatgggagtttcatagaccccgatgtgtgttgttcctctgtctatgtgttcttcttatcatttagttctcacttataagtgagaacatgtggtgtttggttttctgttgctgcgttagtttgctagggatggtggcttccagctccatccatgtccctgcaagacatkaytctggttcttttctgtggctgcatagtattccatggtgtattaatatatgtgccacaatttcttcatccagtttatcattgatgggcatttgggttgattccatgttgcaaaggttccttaagattccatctttcctttagttttcatagcctatttttcccattttc

SEQ ID NO: 1625 - DNA, 521 bp, Homo sapiens
  CDS 223..435
  sig_peptide 223..390: Von Heijne matrix score 5.59999990463257 seq VLSILSLVPILLG/VF
atcttttagtaactggtaaaccggcgackgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctac

SEQ ID NO: 1626 - DNA, 463 bp, Homo sapiens
  CDS 34..327
  sig_peptide 34..162: Von Heijne matrix score 5.59999990463257 seq LGDALLFLRPAGS/CA
agagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggagccacacaggacagttgacccaacacttctgccacctgaagaacgacacctgcattcctccatctctgggaccaccaaggaactcagggagcttggaatctctcagatcaaaaagatactgactcatcggatagccatggcatcctgaaaacggccttccttgtgtgtacattatttgcaacaagcaacaagtttataagcactttggtaaaattgcatgtgagggttaaaatattaaagtcagtgcgtcaactt

SEQ ID NO: 1627 - DNA, 508 bp, Homo sapiens
  CDS 46..270
  sig_peptide 46..135: Von Heijne matrix score 5.5 seq TTALFIFGSLCWC/CQ
tatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagagttggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctc

SEQ ID NO: 1628 - DNA, 321 bp, Homo sapiens
  CDS 54..224
  sig_peptide 54..131: Von Heijne matrix score 5.5 seq LRRVDFLSSGVQG/QP
tagtagtgagttttcataattatcaaatatgtagtagaaaaatctggctgtgcatggtggctaatgcctgtaagtcvctatatgctgggaggctgaggcgggtggattttctaagctcaggagttcaaggccagcctgggcaacatggcaaaaccccatctctgccaaaaataagctgggtgtggtggcacacgcctgtggtaccaggtactccggagctgagctgagaagattgtggaggtttcagtgagccaagattgcaccactgcactccagcctgggtgacagagtgagactccgtcccaaaaaaaaaaaaaaaaa

SEQ ID NO: 1629 - DNA, 348 bp, Homo sapiens
  CDS 124..333
  sig_peptide 124..216: Von Heijne matrix score 5.5 seq SLALLPRLECCGA/IS
tttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcscagctagtttttttgtatttttagtagagacagggt

SEQ ID NO: 1630 - DNA, 486 bp, Homo sapiens
  CDS 60..209
  sig_peptide 60..137: Von Heijne matrix score 5.5 seq SSFFCFFLSASES/RT
aacattttcccgaggacattgagttagggaagtggcctctccttgagggaaggagccagatgacttctcagagaacaacaaccatattcaaaatattctcaagtttcttttgtttcttcttgtctgcatctgaatccaggacattattccacaggaaaaggttaacaggaaatcaagatcggcccgaagtcttgggctcttatcacctctgaatagcatgccattctcttagcctcatctaagaaacagactgtaggggaagagaagatctagaatgttggtcaccaaccaatggcagacattatcaggttgcctatagccttacaagtggcctccttggtttttagtggcatagtgcaggtgagccatatattatgcttctcaatttatttccattggtcagaaaactggtaaaaaattccttttcaatggtatagttttcgaatctcaacagagacttctttggtcttagtgatgagtcttcat

SEQ ID NO: 1631 - DNA, 472 bp, Homo sapiens
  CDS 189..434
  sig_peptide 189..254: Von Heijne matrix score 5.5 seq SLLMWDLLELCHC/LS
gcaaagaatgactcatgaattacgcagcactcagaaccattggaggttagtgagccccattctagcagcaagggcagtgagcttttataggctgaacatgaaagtaagacaaaagacatttaaattggttagagtggaaagttccgagttacggaatagttggcagtttctgattgataaagtctagtatggttttactgtttacattggactttagtttgcttatgtgggaccttctagagctctgtcattgcctcagcctaatggcctctcaattaaagtttgtttgtttgtttaacgggatagtgggccaggtgcagtggttcacacctataatcccatcactttgggaggctgaggcgggaggattgcttgagtccagcagtttgagaccaggctgggcaacatggcaagatcccaactttataaaaaattaaaaaattagctgggcatggtggtgcgtgctgtggtc

SEQ ID NO: 1632 - DNA, 545 bp, Homo sapiens
  CDS 55..459
  sig_peptide 55..312: Von Heijne matrix score 5.5 seq ALLTGPTLGSSQA/RW
cgaaaaatctgtcttgctggaagcttttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgcagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagccttttatcgaaga

SEQ ID NO: 1633 - DNA, 453 bp, Homo sapiens
  CDS 130..303
  sig_peptide 130..192: Von Heijne matrix score 5.5 seq FLLLCSPLAYVFL/SR
aaggtgactggctcgctaaagcccaacccttatgatgcaatccaatggcaagtgatatttgctatcttttcttccggatcaaggaacaaatcgcaaaagaaagctctcccgacacctacgcaaaataaaatgtttccggggtcaatcataaattttctgcttctgtgctcgccgctagcgtacgtttttctctcccgtcagtgcattaaaagacatcggcgcgcttttttggagtcatgcacttctggcctgagaaaacttaaaacgcctgcctgtggccagcgattattgttgctgcttctctgaaggtttcccatttactcctctttcctgaagctttgcctctagacttacttaactctttcctccagcctacgttcatcgaaactatcacttattgtcatatagacctttatttctgaagggagatctgggagttgcatcagaacatyc

SEQ ID NO: 1634 - DNA, 485 bp, Homo sapiens
  CDS 104..319
  sig_peptide 104..190: Von Heijne matrix score 5.5 seq LLLCGASSDLSIS/LS
ctgtaaggtgacaagttaggcttactgccagtgtgaccttaaataagccatgcatgctttctgaatccttttttcttatttggtgagtgacgtgctagttaaaatggtgtctccagccctttcccgtcctcactgctgtgattcaagccccctccttctctgtggggcttcctccgacctctcgatttcactgtcacctttctctcttcctctctctcctgcttcctccctgtccacccccatctctgtccccccagggccgagtttgttttatatctcttttggtatctcctctggttttctggcaccatgtcttacgtagagcaaataataatgctttaaaaaattctcgataaaggaaaaagttcagtaaagtgtgaatttcacattgtagtcagtggttaaatgcctcaaacacttaaaaagtagaatttatctcaacctgggcagaaggcagtccatgccaatttctaaatggaatccaa

SEQ ID NO: 1635 - DNA, 570 bp, Homo sapiens
  CDS 70..483
  sig_peptide 70..333: Von Heijne matrix score 5.5 seq ALLTGPTLGSSQA/RW
acgaacgcacggccgcgcasatctgtcttgctggaagcttttttcctagagggktgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtaccctcccgcagcggggcccaacagctcgaggaggaaggcccaatggaggargaaggaaaggcccagccaatggcggcgccagaaggggaaacggagccttgctaacgggcccaacgctggggagcagccaggccaggtggctgggcgcagacttcgagagcgaggacgagggcgaggaatttgatgactgggaggacgactacgactatcccgaagagggagcagctcagtgggtgccggctacagagtatcagccgctcttgaagaagccgacaagatgtttctgagaacaaggagaaccagccctggatggcgggtttcagatgcattatgagaagaccccgtttgatcagttagccttttatcgaaga

SEQ ID NO: 1636 - DNA, 476 bp, Homo sapiens
  CDS 315..473
  sig_peptide 315..434: Von Heijne matrix score 5.5 seq CGLCLLPFLPVFC/FF
ccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggctgtgcgtgtggcctttgccttcttccctttcttcctgttttctgtttttttaatttggggattgagaaagctgtacgattttgttaa

SEQ ID NO: 1637 - DNA, 183 bp, Homo sapiens
  CDS 13..165
  sig_peptide 13..60: Von Heijne matrix score 5.5 seq CICGFGCLRGCGG/RI
  misc_feature 2: n=a, g, c or t
anttggctgggcatggtggtatgcatctgtggtttcggctgcttgagaggttgtggtgggaggatcgctttggccccggagttcgggaccagcctcggcaatatggcggggtcctatctctgcaaaaaatgcaaaagttggctgggcatggatggtgtgcacctgtagtcccagatgcttgga

SEQ ID NO: 1638 - DNA, 437 bp, Homo sapiens
  CDS 22..333
  sig_peptide 22..66: Von Heijne matrix score 5.40000009536743 seq RVLCAPAAGAVRA/LR
agtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcgaccagtggttgagacakgtgtggggagaggtgccagagcccagtgatcgttctgaggagcctgagactccagctgcctacagagcgagaacttgacggggtgcccgctgggct

SEQ ID NO: 1639 - DNA, 478 bp, Homo sapiens
  CDS 47..274
  sig_peptide 47..124: Von Heijne matrix score 5.40000009536743 seq LLWAWLWPKCTLT/CV
atatatatcactctccaggttggcaagacccaagcagcagagccacatgatatctgtgataagcccagagatatgtcacaatgccctcctttgggcatggctctggcctaagtgtaccctcacctgtgtgcctggcctagcaatatatcactattcttcctttgtgcagggcccattacagagagagagtacatcccctaagaggtggacacaatggttggcttawwgaatgaggccactattattgctgcgagctgaatccagaaatgagtcatgattccaactgtggccagattgacttatgawagtcacaattccaactttgtgctttattcactcattagactcaggacatcaacaataccctttgcaaatgcaggatggtaacaacttttactttcgtctgtgcagtcaagagtcacaatcttaattttttgctgggccctgttataaaactctctctaccaaccaagaagtt

SEQ ID NO: 1640 - DNA, 484 bp, Homo sapiens
  CDS 52..210
  sig_peptide 52..93: Von Heijne matrix score 5.40000009536743 seq LFFYMQSCSVTQA/GV
ccttaattagactcaggaaacaatgggtttttgttgtcgttgttgttgttgatgttgtttttttatatgcagtcttgctctgtcacccaggctggggtgcaatggtgtcatctcgattcactgcaacctccgcctccccaggtttcaggcgattctcctgccttagcctcccaagtatctgaactacaggcatgtgccaccaagcctggctaacttttgtattgttggccgggctggtctcaagctcctgacctcaaatgatccacccgcctcagcatcccaaagtgctgggattacaagtgtgagccaccgcgcctggccttgttttgttttcttatactcataaatagagtgttattgtgggggtgggtgtaggggtggggattaacttcaaatatacaagaaaaggtatatttggaaacataatcgcttgattatatattaggtttacaatttgaactggtcttacaagaaataaaatgga

SEQ ID NO: 1641 - DNA, 379 bp, Homo sapiens
  CDS 64..240
  sig_peptide 64..189: Von Heijne matrix score 5.40000009536743 seq SLLSMSLFSEVVG/KT
aaaaaccactttctcctattttcagaacagtattattcagtttatgtggttcagggaggtcacatgactcagccttgtccaatcagaggactcaatcctgctggccacattgattggtccaggaatggatatatcctaagaatggaccaatcactactttccatgagtcttttctcagaggttgtgggaaagacactttctcctaagctggtattgagagctgtgtgtagtacacaggcttgagaccgtgaactgccgtcttgtgtccacctggataaagcttgtctgataataaagcaaagtggagctgagggataaagagagaaacatacagakvaccctgatgacattatttgaacctagatgcagctaagtctga

SEQ ID NO: 1642 - DNA, 456 bp, Homo sapiens
  CDS 67..225
  sig_peptide 67..138: Von Heijne matrix score 5.40000009536743 seq PVILALWEAKVSG/SP
agataaagtttttcattgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggcagtttctgtgataaatga

SEQ ID NO: 1643 - DNA, 600 bp, Homo sapiens
  CDS 211..459
  sig_peptide 211..249: Von Heijne matrix score 5.40000009536743 seq MLLFSLWYPLLLC/KL
tttattttgccttctatgtcatcttggagcttaatgtgcatgcaagatatgggaaatactaaagcaagactactctatgaagccaatcttccagagaactttcgaagaccacagacagatcaagcagtggaatttttcatcagagataaatatgaaaagaagaaatactacgaaaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggasccactgtggatcttttaggacttgtttggagaaagattgagaaggaaaagagtgaaaggcagttagttgaagtggaagagttgaccttcatgtactgctttccaaaaaattgatcctagttgttattgaataaattgttgtctgttttaagaaaaaaaaaaaaaaatgcgaaaagctt

SEQ ID NO: 1644 - DNA, 352 bp, Homo sapiens
  CDS 18..230
  sig_peptide 18..74: Von Heijne matrix score 5.40000009536743 seq FVLSLLLILEKQA/AV
aagatttttcaagcaagatgaagtccatcatcctctttgtcctttccctgctccttatcttggagaagcaagcagctgtgatgggacaaaaaggtggatcaaaaggccaattgccaagcggatcyttcchawtttccacatggacaaaaagggccagcactattttggacaaaaagaccaacaacatactaaatccaaaggcagtttttctattcaacacacatatcatgtagacatcaatgatcatgactggacccgaaaaagtcagcamtatgatttgaatgccctacataaggcgacaaaatcaaaacaacacctaggtggaagtcaacaactgctcaattataaacam

SEQ ID NO: 1645 - DNA, 468 bp, Homo sapiens
  CDS 196..396
  sig_peptide 196..333: Von Heijne matrix score 5.40000009536743 seq LMPVIPALSEAEA/GR
ttagtcttttttcttctattcatttctgagatatatttctcttctgcctgctcctgtctggccatctcctctcagagttctggcaactgctttacagtcttccttcataacagctgttgtttattaagtgtcttcttttcttcctaaaattcatgttggaatgttgactattctttttccatatttaaaaatagtatgtttttactcttaactagaaaaaagggaaggggagaagtatatatctatggtatgctgtctttctgtaagaaagagaggatgggccgggcacagcggcttatgcctgtaatcccggcactttcggaggccgaggcaggcagatcacgaagtcaggagttggagaccagcctggtcaacatggtgaaactccatctctactaaaaatacaaaaattggccgggcgtgatggcacgcacctgttgtcccggctacttgggaggctgaggcagg

SEQ ID NO: 1646 - DNA, 488 bp, Homo sapiens
  CDS 67..225
  sig_peptide 67..138: Von Heijne matrix score 5.40000009536743 seq PVILALWEAKVSG/SP
agataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatactcaaaaaaaaaaaaaaa

SEQ ID NO: 1647 - DNA, 370 bp, Homo sapiens
  CDS 19..315
  sig_peptide 19..75: Von Heijne matrix score 5.40000009536743 seq FVLSLLLILEKQA/AV
aaaggttttycaagcaagatgaagyccawcatcmtctttgtmctttccctgctcctyatcttggagaagcaagcagctgtgatgggacaaaaaggtggatcaaaaggccrattrccaagtgaatyttcccaatttccacayggacaaaagggccagcactattytggacaaaaaggcaagcaacaaactgaatccaaaggcagtttttctattcaacacacatatcatgtagacatcaatgatcatgactggacctactcagtcatgaacaaaaaggcagatacaaacaggaatccagtgagtcacataatattgtaattactgagcatgaggttgcccaagatgatcatttgacacaacaatataatga

SEQ ID NO: 1648 - DNA, 414 bp, Homo sapiens
  CDS 201..410
  sig_peptide 201..329: Von Heijne matrix score 5.40000009536743 seq LILVLAQLHCVTL/EK
  misc_feature 238,387: n=a, g, c or t
cttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtcnactgattgaggagctctgttcagactactggagtagatgtgtaaatcctgaactgatcttagtcctggcacagcttcattgtgtgaccttggaaaagttgcttactttcttaggttttttttgttgttgttgtttgttttttaaacaanatttaatgggtggtcatgatgtctagg

SEQ ID NO: 1649 - DNA, 581 bp, Homo sapiens
  CDS 194..379
  sig_peptide 194..250: Von Heijne matrix score 5.30000019073486 seq LASGILLLLWADS/PQ
ctttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagagcccagagagacaccagagaacccaccatggccccctttgagcccctggcttctggcatcctgttgttgctgtgggctgatagcccccagcagggcctgcacctgtgtcccaccccamcccacagacggccttctgcaattccgacctcgtcatcagggccaagttcgtggggacaccagaaagtcaaccagaccayctttataccagcgttatgagatcaagatggaccaagatgtataaagggttccaagccttaggggakwgccgctgaaaatccggttcgtctaaaaccccgccatgggagagtgtctgcggaatacttccacaggtcccacaaccgcagcgagggagtttctcatttgctggaaaactgcaaggattggactcttgcacatcactacctgcagttttgtg

SEQ ID NO: 1650 - DNA, 413 bp, Homo sapiens
  CDS 75..275
  sig_peptide 75..143: Von Heijne matrix score 5.30000019073486 seq VCWMISYIAGCLG/SL
atgtgtttctacataaatggaggtagattctagaactaaataaacagtttttcatctgtgtgaacttccagaaaatgttcaaaagttttgcgggacatgagacagtgtgctggatgatctcatacattgcaggatgccttgggtcgttggtcccattccactacagtcatcatgtcaccccagaacggcccaacargkttkgcaaaawgkgycyccatkgaraggcgctgagcttggggtgggagggtttaggaccagatttggtctctggtggctgaatcccctagcctgcttagaacagcacaatagcagggtctttgtgcagacaaagtggrgctgtaggaagggaagaggctgcccaggctggcacagctgtggctgaaggagagaggcagagaagggagtgtctctgt

SEQ ID NO: 1651 - DNA, 437 bp, Homo sapiens
  CDS 145..318
  sig_peptide 145..285: Von Heijne matrix score 5.30000019073486 seq ARLVGFWVAVCSG/FV
agtcggtgacgggacacagtggttggtgacgggacagagcggtcggtgacagcctcaagggcttcagcaccgcgcccattgcagagccagaccgtgagtcggggatccgggtaggagggtcgggccgcgccggggcctggctgaatgctgcaggccccggggcccaagggtggccgcggtggggcgggaagtagggagcgcttcggggagttggattctgagggctgttgcttagcgatctgtatcgctaggctggtgggtttctgggtcgcagtgtgttcagggttcgtttaccacatccacttgccaagttgccaatgatcgcgtgtttctcgcaccttggttgctaaggtccctcgctgcaaagaacataagttgccccggtcccgcttgctatgggtacctgattgttagaggcaaccagaggatgctgaggg

SEQ ID NO: 1652 - DNA, 473 bp, Homo sapiens
  CDS 47..397
  sig_peptide 47..187: Von Heijne matrix score 5.30000019073486 seq ILAHSTSTSQVQA/IL
gtcaagcgtgcggcggcccgtggaagggaactccctccactagaatatgagctccttgtggtcaagactgggtcccctgttcccttccccccagtgccagcggasaaagagtctccctctgttgcccaggctggagtgtggtggcgtgatcttggctcactcaacctccacctcccaggttcaagcgattctcctgcaacctctgcctcccaggttcaagcgattctcctgccttggcctcctgagtagctgggattataagcgtgtaccaccaaccctggatgatttttgtatttttagtagaggcagggtttcaccatgtttgtcaggctggtctcgaactcctgacctcgtgatcctcctgcctcggcctcccaaagtgctgggattacaggcgtgasatcatgcccagccaactggtttgtgattaaatgttttgattgatgcagtttttgcaaaaaaaaaaaaaaaaa

SEQ ID NO: 1653 - DNA, 517 bp, Homo sapiens
  CDS 322..513
  sig_peptide 322..402: Von Heijne matrix score 5.30000019073486 seq HHLLLTSIINVFS/SR
tttttcgttctttctttttttggcagagatgaggtctcactaggttgcctaggcttgtctcaaactcctgggctcaagctcagcctcctaaagtgctgagattacaggcatgaaccactgcacttagccaaattggaagtcttaattaggaagaattatagttcaaatctgtatgttatataaaaaaatacagtacaacagtataaaatgaaaagtaaaaagtccttattctctgctatccccatttaaccactatttatacatcttgtgaatcctagaaattttctatgtgtgtgtatatttgtttatgtggatttgtgtatgcttcactatcttgattgctctgaactgaaactcatttttcatcatttgcttctaacatctattattaatgtcttttctagtagactgatctttcaagatcagggactccattttgttcatggatacatgactcccgtagtgtctggtacatacaggttttcctttcctgcctcagcctggccaacctggtgaa

SEQ ID NO: 1654 - DNA, 505 bp, Homo sapiens
  CDS 167..331
  sig_peptide 167..238: Von Heijne matrix score 5.30000019073486 seq RLCVVLLAQACMP/ED
ataacttgtcattgcctgtcctggtgtacccagatgttccatgatggacgttttatcccataagacgtctccctcctgatagatgtccgtatatgcagattaaactaccaacattttttccagcaaaggtggtttttgaaagtaacctaatgaaaccctggctgccatggtcattttaaattgctggactgagaagaagcgactctgcgttgtgctgttggcccaggcctgcatgcctgaggactgttggccgttacagttccttgctgtggtcgccggtctctctgtattctgccactgctctcatgtggcatttggcagaagtactacgtagatttctgtgctactgaaaaaaataaaaacagtggttccttttaatagccctgatttgagacttaggagagggtcaagagtccctaactgatttatgaggagagaagattttttaaaaacctcatgtgatgctgtcatacatagttcaaagagcttccttaattcacttcat

SEQ ID NO: 1655 - DNA, 474 bp, Homo sapiens
  CDS 191..448
  sig_peptide 191..433: Von Heijne matrix score 5.30000019073486 seq PIWLKCSISLCCA/WR
acaagttccgttgtacaccgcggctccggctgcaaaagcctggagcgttgggagcatggggctgatggaggcatggcgggagatgtagtctggagctcataacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcascagacaagggtgaacattcctatctggctcaagtgttcaatctcactctgctgtgcatggaggagtatgtcatagaaccaaagtctgtgcagttcctg

SEQ ID NO: 1656 - DNA, 459 bp, Homo sapiens
  CDS 94..375
  sig_peptide 94..327: Von Heijne matrix score 5.30000019073486 seq PVCLACACXVSAA/WA
  misc_feature 64..65: n=a, g, c or t
agtgacgtgcggaaggggtgcccgggacgaagccatggccctggaggcggcgggagggccgcgnnaggaaacgctctcactgtggaaacggtaatgctgtcaggcgacgcgcaggaggcgggggccgaggccgggcggccttcgcggaccctccgagctcatagtcttcaggctgtggaatcggagctgccaccgcccgagactccaaagcaaagcccagtttccggcgcggaassaggggatctcaggaattgtagtccgcggggtgggcgcggttctcgcttccggccagtttgtctggcctgcgcttgcsgggtctccgccgcctgggctcctagggactgtggcctcggcggtatgtcccttgctttcccttgaagcgggataagacccggcagaggcgctctgtccgctgcagccgcgcgggtggaggaagcagagtctgaggtgtgaccccga

SEQ ID NO: 1657 - DNA, 482 bp, Homo sapiens
  CDS 26..370
  sig_peptide 26..352: Von Heijne matrix score 5.30000019073486 seq PLRMCWAWHLCSA/SR
agaaaggtgtggttggcatggggcaatgcttgaggtatcagatgcactgggaggacctggaagagtaccaggggccacagcagggatgaatggagtggacacgtcgcttctctgtgatttgttgcaggccctgaccttcctgaccagaaatgaaattctgtgcatccatgacaccttcctgaagctctgccctcctgggaagtactacaaggaggcaacgctcaccatggaccaggtcagctccctgccagctctgcggtcaaccctttcagagaccgtatctgcagagtgttctcccacaaaggcatgttctcctttgaggatgtgctgggcatggcatctgtgttcagcgagcaggcctgcccaagcctgaagattgagtatgcctttcgcatctatgattttaatgagaatggcttcattgatgaggaggatctgcagaggatcatcctgcgactgctgaacagtgatgacatgtctga

SEQ ID NO: 1658 - DNA, 637 bp, Homo sapiens
  CDS 163..468
  sig_peptide 163..243: Von Heijne matrix score 5.30000019073486 seq VXWLSGLSEPGAA/RQ
aaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtccygtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacatcaataagcagataaatgacaaagagcgagtggcagctgcaatggaaaaccccaacttacgggaaattgtggacagtgtgtccttgaacctgactgatagctgttttaagagccactggcctgtaattgtttgatatatt

SEQ ID NO: 1659 - DNA, 552 bp, Homo sapiens
  CDS 35..319
  sig_peptide 35..109: Von Heijne matrix score 5.30000019073486 seq AVTSLLSPTPATA/LA
tttttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgatacaagaagtcaagggt

SEQ ID NO: 1660 - DNA, 451 bp, Homo sapiens
  CDS 183..413
  sig_peptide 183..386: Von Heijne matrix score 5.30000019073486 seq WPTLGPLLGPAGA/GP
ttcttctccatcgagcgcgcgcaacaggaggcgccasggtgcgaaastctcgtctaagggcagctttgctgacytgggcctggagccccgtgtgctgcacgcactacaggaggctgcgcykgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggccaacccttgggccgctccttgggcctgctggtgcgggacctggagggaggccacggcatgcgtaggatcaggctgcagctgtccagacagccttcagcaa

SEQ ID NO: 1661 - DNA, 489 bp, Homo sapiens
  CDS 43..264
  sig_peptide 43..102: Von Heijne matrix score 5.30000019073486 seq LYGLPTFPGQSWA/QG
  misc_feature 333..334,382: n=a, g, c or t
ctagtatttgggatgtatggacgataaggacataggaagaaaatgaaaggcatggtctttctcctttatggcctccccacttttcctggccagagctgggcccaagggcggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattcctnnsagcctgtggttctgactcttcccagtgtcctgcatgtctgcccccrnaamccagggctgcctgcaaggcagktcagcatggccccagcacaactccgtagggagcctggagtatccttccatttctcagccaaatactcatcttttgagactga

SEQ ID NO: 1662 - DNA, 396 bp, Homo sapiens
  CDS 32..385
  sig_peptide 32..361: Von Heijne matrix score 5.19999980926514 seq SCLVSGWGLLANG/RM
gcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctacvgcggggaactcttgcctcgtttctggctggggtctgctggcgaacggcagaatgctaccgtgctgcagtgcgtgaacgtgtcg

SEQ ID NO: 1663 - DNA, 581 bp, Homo sapiens
  CDS 187..405
  sig_peptide 187..294: Von Heijne matrix score 5.19999980926514 seq LGLTQCMLGCVYA/SC
attcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggagattgcccagcgaggccggaacaccagcaggatggcagaggacacctccccaaacatgaatgacaacatcctgttgcctgtccgcaacaatgaccaagccctaggcctgactcagtgcatgctgggatgtgtgtatgcaagctgctgtgccagaagctcatggagaagacaggcattctgctcctctgtgctttcggtgtgtcccagggccctgccagtcccaggtggaggtatccctgggccctggcactgattataggacactgggcaagacactgcaccgccacgtgactcagtttccccatctgcctgatgggtgttgctgtgagaattatgaaatgaaatgatgaccatgaaaatattgtagaagccaagaaatgcttcagaagttataaagctctccccaaaaaaaaaaaaaaatgcgaa

SEQ ID NO: 1664 - DNA, 737 bp, Homo sapiens
  CDS 76..675
  sig_peptide 76..135: Von Heijne matrix score 5.19999980926514 seq SPVFLVFPPEITA/SE
agcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcacyttgttaaaaccatatccaaggtttccctttatatttctttcaggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaaaaaaaaatgcgaaaagctt

SEQ ID NO: 1665 - DNA, 485 bp, Homo sapiens
  CDS 228..401
  sig_peptide 228..371: Von Heijne matrix score 5.19999980926514 seq AQLMLLFVEGSIC/TI
catacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagctgggactacaggcatgcaccaccatgcccagctaatttttatatttttagtatggagtttcaccatgttggccaggctggctttgaattcctgacctcaagtgatctgactgccttggcctcccaaaatgctgggattacggacacgagccaccatgcccagctgatgctcctttttgtagaaggaagtatttgcaccatacaacattctcaccccctctggctgtagcttcccctttcctttccactctgtgtccagcggtgccagcctcctttccactttccaggtggccatgcttctccggcctct

SEQ ID NO: 1666 - DNA, 641 bp, Homo sapiens
  CDS 191..439
  sig_peptide 191..277: Von Heijne matrix score 5.19999980926514 seq VVFMTVAAGGASS/FA
aaaagcgagtcaggtccctcgcgctcccgccccacgcgcgtgaccagagcgcgctggcccggcccacccggggcggttgtggtcgctatatataaggtggggaggccgccggccgttcggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtccaaaaaaaaaaaaaaatgcgaa

SEQ ID NO: 1667 - DNA, 474 bp, Homo sapiens
  CDS 76..276
  sig_peptide 76..135: Von Heijne matrix score 5.19999980926514 seq SPVFLVFPPEITA/SE
agcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaaaaaaaaagcgaa

SEQ ID NO: 1668 - DNA, 491 bp, Homo sapiens
  CDS 228..401
  sig_peptide 228..371: Von Heijne matrix score 5.19999980926514 seq AQLMLLFVEGSIC/TI
  misc_feature 478: n=a, g, c or t
catacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagctgggactacaggcatgcaccaccatgcccagctaatttttatatttttagtatggagtttcaccatgttggcmaggctggctttgaattcctgacctcaagtgatctgactgccttggcctcccaaaatgctgggattacggacacgagccaccatgcccagctgatgctcctttttgtagaaggaagtatttgcaccatacaacattctcaccccctctggctgtagcttcccctttcctttccactctgtgtccagcggtgccagcctcctttccactttcmaggtggccatgcttctcnggcctctgggctt

SEQ ID NO: 1669 - DNA, 585 bp, Homo sapiens
  CDS 5..334
  sig_peptide 5..253: Von Heijne matrix score 5.19999980926514 seq LNTALVDLPGVAA/SQ
aaaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcagatctctagctacctctacttaaatactgctcttgtggacttgcctggtgtggcggcctcccaggcatgtgactctcagcaggtgacttggcttctctacgttgctaatggtgcctactcggcatgtaacaggcctggatgaacggtagctgctgcggttacattattagcttcagtttgcccgcccaggctagatgtttaatcagatttcacagacttcacagtgtgagttggggatgtgacttcgtatgaaagtgaaggaactcaggctcagagagggtgagacgtaggagcatggccactgcgcgactcggggctggctgtgggtttctccccattccctgcccatctgggaagtcgctgccaccccctacgcttgtctgctgactc

SEQ ID NO: 1670 - DNA, 267 bp, Homo sapiens
  CDS 26..214
  sig_peptide 26..172: Von Heijne matrix score 5.19999980926514 seq LVTGAVCSGAILA/HC
ataagactggcaagatccaatccatatgttggcaaatggatttctggtgctcagaaatgaccaatctttaggaagcaacgagtttctgaaaacaaaacaacaacaacaaaaaaaaaacagacggagtttcgctcttgtcactggggcggtgtgcagtggtgcgatcttggctcactgcaacctrcacctcctatgttcaactgattctcctccctaacctcctgagtagctgaaggagctaaacaaatttttttttttttttttttt

SEQ ID NO: 1671 - DNA, 531 bp, Homo sapiens
  CDS 76..276
  sig_peptide 76..135: Von Heijne matrix score 5.19999980926514 seq SPVFLVFPPEITA/SE
agcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgctttctcaatttt

SEQ ID NO: 1672 - DNA, 471 bp, Homo sapiens
  CDS 94..324
  sig_peptide 94..207: Von Heijne matrix score 5.19999980926514 seq LHSTSPLPDPASA/SP
agcctttcccttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagmctgcmagcttctcctamrgattctggacttgccagccccacaatcatgtaagccaatatgctaaaataaatttcttaatataattcttaatgtatatatccttttgattctgkttttctggagaaatctggsttatacaggctcttaacatgattgtttatctgtcaawttttattttatggcgatgttattagg

SEQ ID NO: 1673 - DNA, 416 bp, Homo sapiens
  CDS 66..251
  sig_peptide 66..131: Von Heijne matrix score 5.19999980926514 seq AGAWLLGVPVCGA/AE
agttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagaaaaccaaagcacactgtgtactggttgcagaatcagttggggaacaccagtgcatgtgcttttgaaaaatggtgatctttgctgtaaacttgacccagcaccagcagtggcgtccaggagtgccccacatgtggcagcaccgtwagacctacagtwcggaggagtwccaccacwggctgyakacgtttgccagcaactggaggaagawaaacgyccacaacaatggg

SEQ ID NO: 1674 - DNA, 476 bp, Homo sapiens
  CDS 159..368
  sig_peptide 159..314: Von Heijne matrix score 5.19999980926514 seq VALAPSLTSQCSS/ST
  misc_feature 410,438: n=a, g, c or t
gtagttaggagtctggagtcgtgagccggagtcagaactgcgtctcgcgacccaggcgcgggtttccggagacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggcacaggcacccccggscgtggctctagctccctctttgacctctcagtgctcaagctccaccacagcctgcagcagagtgagccggacctgcggcacctggtgctggtcgtgaacactctgcggcgcatccaggcgtccatggcaccgcggntgcctgccacctgtgcctagcccactgnagccccagtgtggctgacaacttactggcaagctcgga

SEQ ID NO: 1675 - DNA, 357 bp, Homo sapiens
  CDS 44..193
  sig_peptide 44..127: Von Heijne matrix score 5.19999980926514 seq LMPVILALWEAEA/GG
acaaaaaataaataaataaataaaaggaaaaaaaagaattttgatggttagtcacccaataaatgttctggttggccgggcgtggtggctcatgcctgtaatcctagcactttgggaggctgaggcaggtggatcatttgaggtcaggagttcaagaacaacctcgscmamcatggtgaaaccccatctctactaaaaatacaaaaattagctgggcatggtggtgggagcctgtaatcccagttacttgggaggctaaggtagcagaattacttgaatctgggaggcagaggttgcagtgagccaagattgcgccactgcactccagcctgggtgacagagtcagactctgtctcr

SEQ ID NO: 1676 - DNA, 406 bp, Homo sapiens
  CDS 203..352
  sig_peptide 203..304: Von Heijne matrix score 5.19999980926514 seq IIMLSNFPFSILG/EM
aagaagaatgtaaagggccttaagtgtcagggagttagttacctactgtgctaccatagttggtgtcatataaatagttctcgtctttccaggtgttcatgatggaaggctctacaaaaaatagagaaggagaatagtcagcgatctcttttccccagggagaagaggctgcgttttctaattcattgttcatcaacaaagtatggggggtgaggagtggtcctcagagacaagggatatgattctgcttcagctgcgttactttataataatgttgtctaattttcctttcagcatcctcggggaaatggcctcatccatgtgttctgtacctattgcatttttagggaagtgagagragttgcaagaatgggaacctgtcctagaccaagtgggttcctgggaa

SEQ ID NO: 1677 - DNA, 602 bp, Homo sapiens
  CDS 97..477
  sig_peptide 97..138: Von Heijne matrix score 5.19999980926514 seq NFILFIFIPGVFS/LK
aataatgtcctagttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagtatttaaattactacactgtattcatacctggagaatatcattatgtgacttaaaaatttaagtttcactactctgagcattacataaagccatagcatgcttaaagaatttatactgctaccttttaa

SEQ ID NO: 1678 - DNA, 418 bp, Homo sapiens
  CDS 41..337
  sig_peptide 41..268: Von Heijne matrix score 5.19999980926514 seq ALPFLLAVWQTEQ/AV
cttcaccaccaaaactctccactccaccagcacagccaaaatgctcgcacgtgctactttccgcgccgcctcggccccaactctcgtcgcccgccgcggcttccagtcgacccgcgcgcaaatggccagcccataccactaccccgagggtcctcgcagcaacttgccattcgacccgctgaagaagggctttgctttcaagtactggggctttatgggcaccggattcgcccttcccttcctccttgctgtctggcaaacagaacaagccgtaaatgcgctgagacacggcgtggacatgcgtatcgggatcccggggaacacggcatttgtagattaggtggagggcccgcatacggctatactagacatcacagcatcaatttcattgtctgtccccaaaaaaaaaaaaaaaaaa

SEQ ID NO: 1679 - DNA, 459 bp, Homo sapiens
  CDS 111..377
  sig_peptide 111..233: Von Heijne matrix score 5.19999980926514 seq LWFLAQIPSRVAG/SL
aaaccgaaaccagcgctccaaacaattgggacccgggatcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaaggtactgtggtttcttgcgcagattcccagtagggtcgccggtagtcttctttctgtctgtgtgatgagcagagatggtaacataaaggactctggtgaagacactcagtcgggtaccagggaagtctgttttctgcctgcctccctatctccatattcaagtcggctaacgtttcagaggcgtttttgagcagaggaaagtagagttctagtctagaggaacaaggggctctggcagctcaaatcaattaaccaagatccaattccct

SEQ ID NO: 1680 - DNA, 686 bp, Homo sapiens
  CDS 96..497
  sig_peptide 96..137: Von Heijne matrix score 5.19999980926514 seq NFILFIFIPGVFS/LK
ataatgtcctagttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacggatcaaccccaaacgtgcctgcattttggacaatgttagctaaagctataaatggacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaaccagagctggc

SEQ ID NO: 1681 - DNA, 412 bp, Homo sapiens
  CDS 180..377
  sig_peptide 180..239: Von Heijne matrix score 5.19999980926514 seq GFSVCWSLLEVRS/RP
aacattctgaagcctacttctatcaatttgtcaaactcattctctgcccagttttgtgcccttgctggagaagagctgcgatcatttggaggagaagaggcattctggtctttggaattttcagcatttttgtgctggtttttcctcatcttcatggatttatctacctttgatctttgatgctgatggcctttggatggggtttttctgtctgctggagtttgctggaggtccgctccagaccctgtttgcctgggtattaccagcagaggctgcagaacagcaaagattgctgcctggtccttactatggaagctttgtcccagagggcacctgccagatgccagctggagctctcctgtatgagatatgaaaaatgagcatttaaaatgaagaaagtaattagaagagg

SEQ ID NO: 1682 - DNA, 517 bp, Homo sapiens
  CDS 11..487
  sig_peptide 11..70: Von Heijne matrix score 5.09999990463257 seq SCCCWGTPHSCRC/RP
gcggtgcctgatggggccgttgggcggcggtagctgttgctgttgggggacccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaaaggagcttattctccatggagtcagtctaattcagaagatggttgatactgaagcct

SEQ ID NO: 1683 - DNA, 486 bp, Homo sapiens
  CDS 41..304
  sig_peptide 41..283: Von Heijne matrix score 5.09999990463257 seq LVCSAVVLLFILG/VA
acatttcgcctctcaaaagaagcattgccttgacagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaaacatgccgtaactctgtgactgcattgtaagtgcagtgggggtaagcagtcctgtgagtggcgcatgaacgctggagctattccgccgcctgccccagtgtggggggagatacctttaccatgaacttacagaattaaagatggcccataaggaattccaaaaaaaaaaaaaaaaagg

SEQ ID NO: 1684 - DNA, 523 bp, Homo sapiens
  CDS 194..427
  sig_peptide 194..328: Von Heijne matrix score 5.09999990463257 seq CVFLIHFSFFLLS/QD
aaatttaggagggaatacaaatcccttgctggcgtcgaggcaacgttttcccttcccccctcccttcccgggagcaggctcggtgtccttaggccccctcccttccagattttgcctttcacatgggttttggccccagatatgtattttgcgctgttttgccccacttacgcaggagggggctgttgtgcgcatggtgggggtaataatagaaggaccgaacctccttgacctcttattcccttctctgcctccttctggcagaaagggttgggttctcccaccaggttgtgtgtttttgatacatttttcttttttcctcctatcccaggaccaagaatcgccttcagccctgtctggtgcatccttggcagaaagtgaggaggaaaacacccccattgtgagtcctttgcccctaatttgttgctaatagaggacattgtcaggttgtaggggttaagctatgggacctggccctccccgttgttttgagggggaggagctttcccttgggtggcagctg

SEQ ID NO: 1685 - DNA, 691 bp, Homo sapiens
  CDS 439..648
  sig_peptide 439..537: Von Heijne matrix score 5.09999990463257 seq HLMTTMLSLSSHC/EV
cttttctactgctccctctattcctgtattttgctcagctctctaaattgactcagctccaggttttctagtttgtctgcacagaggtgtttacagtggttctgatggctgtttccatttctgtaggattcttactatgttgccaaggctgatctgaaactctcagcctaaagtgatcctcccacttcggcctcctaaattattaggattacagcaccttgcttgatccagatcatccttccatttgggacttcaatggaacaccacactgggggcatgaggtttggctttcataactaccaccaagggactggatgatggaacgcagaacagcagagatggtagttctgcctcagggaaaccctggccaatgggaaatagaagacagaagacagctgagcagatacattttctcttctctttctcttccgtggactaatgccggctgtggtttccccttgcagcccttctggaaaagtactgggagtcaagtccacgcatctgatgaccaccatgctgtctctctcatctcattgtgaagtggtcatcagcagagtcatatcatacatcacaagacatggttkcacatttgctttgcctcaatttccacatgtcctggccattgctgccctggacttatcttccaaataaatgttatcactttaacaccaaaaaaaaaaaaaaatgcgaa

SEQ ID NO: 1686 - DNA, 448 bp, Homo sapiens
  CDS 24..329
  sig_peptide 24..152: Von Heijne matrix score 5.09999990463257 seq PHMLSSLCTCVFT/RY
aaagttgaggtgttgtcagggccatgcttcctctgaagcctccaggagaggatcttttcttgccttttcatcttccagtagccacagattgttcacttcaatctccacctggaccccacatgctatcttccctgtgtacctgtgtcttcacacggtattctcctgcgtgtgtatatgtgtgtgtccacatgttcttcttagaaggacattggtcatgttacattaaggcccattttaatggttctattcttaactttatgacaactgcaaagaagtcacattcacaggcactggggcttaggtctttgacacatctttttgaggggacataattcaatccgtaacagagggcagcaaagggaactctgctttsccaagcagaactgtaggtvrtggacctgagacctttcatcttgctaaggtaccaatgagtgactcctttagccga

SEQ ID NO: 1687 - DNA, 517 bp, Homo sapiens
  CDS 76..408
  sig_peptide 76..279: Von Heijne matrix score 5.09999990463257 seq LSLPVCTVSLVSS/VS
aagttgaggccaccctggtggcaccaaagccctctcaggcaggcagacccagggcctccccgccacaccttgttcatggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttccgtgtcttttggcacctaccgccactgcctggcgcacatctgccggctccggtacgsaaccctgacgccaagcccaccaaggccgacatcacgctctcgggatgcgcctccggcctcgtccgcgtgttcctgacgtcgcccactgaggtggccaaagtccgcttgcagacgcagacacaggcgcagaagcagcagcggctgctttcggcctcggggcgttggctgtgcccccatgtgtc

SEQ ID NO: 1688 - DNA, 456 bp, Homo sapiens
  CDS 75..242
  sig_peptide 75..113: Von Heijne matrix score 5.09999990463257 seq MXLYLLCXXLXLA/XV
ttcctcctctttctccttttcttcctcctcctcttcctcttctttctcctcatcatcamtcttgtcaatcagggatgstgctgtatctcttatgtymagscctgtgscttgcwttkgtaaggtacycaaataaatactttgttgaatggatgaatgctgcatattggaacttaagttcactgggcacagtggctcacacctgtaatcccagcattttgggaggccaaggcaggtggatcacttgaggtcaggagttcaagaccagcttggccaacgtggggaggccccgtctctactaaaagtagaaaaattagccgggcacgtgatgcacgtctataatcccagcaactcgggaggctgaggcacgagaattgcttgatcctgggaggcggaggctgcagtgagcccctgcactccagcctgggcaacagaatgagactgtctcgaaaaaaaaaa

SEQ ID NO: 1689 - DNA, 506 bp, Homo sapiens
  CDS 28..324
  sig_peptide 28..264: Von Heijne matrix score 5 seq LFTSFVILQLLQA/IW
taagaggtaaacgggtggggccattttatgggatttgggaaggtaatggaaaattacagtcaaagggagttgttctctggtgggcaggggcggggggtcacagggtgctcagtgggggagcttctgagccaggagaaggaaattcacagggttaatcactcagttaagatgcggcaggaacaaatcacaatggtggaatgtcatcagttaaggcggggtaagggccttttcacttcttttgtgattcttcagttacttcaggccatctgggcgtatacgtgcaagtcacaggggatgcgatggcttggcttgggctcagaggcctgacaggtaggtcctgagttactaggaaagctcatttgtagaaagttgtgaagtctcaggttttatgaagagaaaatagagggaggaagggagaaaaacaacaacaaacaaaaaaacaatcctggtaagttgatacaggccacatgactctgaagttcataacatcagtaggcaggtatgaa

SEQ ID NO: 1690 - DNA, 464 bp, Homo sapiens
  CDS 138..350
  sig_peptide 138..248: Von Heijne matrix score 5 seq FELLTSSDPPASA/SE
tgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctcggattacaggcgtgagacactgcgcccagcctcatccctgtgaatttcttattgtacacaagttctttcactatctgtgtgsagtgctctgaggggacagacaaggcttgggtgtatatgccaaccagatctcattgaagtatcagcttgtttggtactaggtgcaagtgtagcatgtcacatgtgaccatgttgggatcatt

SEQ ID NO: 1691 - DNA, 415 bp, Homo sapiens
  CDS 239..397
  sig_peptide 239..322: Von Heijne matrix score 5 seq IFMVRLVCSLIFS/GC
tttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggkttccactccctgctgtagcctgaagagagctctattacctagttccaagaaaagataatattctgttagatgt

SEQ ID NO: 1692 - DNA, 472 bp, Homo sapiens
  CDS 2..157
  sig_peptide 2..85: Von Heijne matrix score 5 seq SLFLLCFPSPHNQ/SQ
aatgtttcagctgcttgtgcattcttcacctcccattgtctctgtctctctctttctcctctgcttcccctcaccccacaaccaaagtcaagagcgcagaccccatgatcacctgatacttccaagcaagcaggtgttcttttcagaagccagaagctgataacctgggctttctgatctaaccccagcccaaattcattgcaatggaggaattggggaggagattcttcctactgagaagtgggtgccaactctccctttcaaatttgttcatcaacaaactaaaggggatgccagaaatgtctggagcaatggaagaaccactggaataatgctcctgcctgattgtatctacttaacccactctccaagagccagaatcagatttcaaccgtatggaatcatctacaatgcagcagatgggtttacaagtctcttggtctcttcatgtaattaacagccaagaagtcta

SEQ ID NO: 1693 - DNA, 454 bp, Homo sapiens
  CDS 240..407
  sig_peptide 240..374: Von Heijne matrix score 5 seq VLWFLLNCMLIMS/GQ
atcttattcactttggttttttatttcaggcaaagaggtaaatttgtttcctgttactccagcttgcttggatgtggtcttgctctgtcgtccaggctgaagtgcactggcatgatctcagctcattgcaacctccaccttctgggctcaagcaatcctcttaccttagcctcctgagtaactgagaccacaagcatgcacaaccataccagaatttgctctatcctcaacgttgcaaaatgtctgggcataggctgtgttgcatttctcacgtacagtatgagcagagaagcttacccattctgttgcagcaggtccagagaagtctcactgaagtgctttggtttttattgaattgcatgcttattatgtctggacaagaagatgtgtacatgaagaggatgttttgatargcctgacctgagagctgtatgctcacaataaaagctwgagr

SEQ ID NO: 1694 - DNA, 469 bp, Homo sapiens
  CDS 114..287
  sig_peptide 114..272: Von Heijne matrix score 5 seq GGAGLVFVPSGNG/QP
agatggaaagccatctgctgagataggaaagaggagcaaagaagcagatgtggtgagagtgagagcaagagttgggttgtggacatgttgactttgagatcatctgagtgagcatggagagggtgcagttggagtgtgaatctggggctcaggggagaaacctgggctggaaatacaaacgtggagttgtctgcatactcatgggccagaggtcagaaccgaggcaggtggctgggggagctggcctggtttttgtgccctctgggaatggccagcctcagacctcctgactggtcatggccaggaggtcagaaatctgaaggtgaatcctaaccctaacttgagtccttggctgagatctcaggactacttcccagctggcctgggtcctcaaggagtaaaggagcagtcctggagcacccagctgtgccggtacctggggaaaaagtaactacagatggaaagtctc

SEQ ID NO: 1695 - DNA, 293 bp, Homo sapiens
  CDS 23..202
  sig_peptide 23..100: Von Heijne matrix score 5 seq LELLGSSNPLTLA/SQ
aattattactattattattactatgtgtagagatggggtctcactatgttgcccaggctgtcttgaactcctgggctcaagcaatcctctcaccttggcctcccaaagtgctcccagacagccaccacgcccggcctatatttgcagttttgagtgcctttcatacacttggcatgtacaaggcattttatacatatttatttaatatagttttgcatatacttcctgtgatgcatttacaaggaattaaaaaaacagtgagaagttcaaaaaaaaaaaaaaaaaaaaaaaaa

SEQ ID NO: 1696 - DNA, 577 bp, Homo sapiens
  CDS 139..378
  sig_peptide 139..198: Von Heijne matrix score 5 seq HLLAGFCVWVVLG/WV
cccccccagctggaaccaagaaggttgtgtcccccttcctctgggtgtccttgtctcctgctatcagggcacagtcctcaggatgtttcggggagaataggagccagaacctgagcccctaagccattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgctgggacagcatgggcctctgactggacgggctgcatccccagctgcagacaattccacacacaggccacagaaccctgagctgagtgtggatgtctgggcagggatgcctctgggtccctcagggtggggtgactggaagagtcaaaggcccctcacctaccccgtgggccagccccctcgggcctggacctccttcacaggcttctgttgctggac

SEQ ID NO: 1697 - DNA, 465 bp, Homo sapiens
  CDS 284..451
  sig_peptide 284..418: Von Heijne matrix score 5 seq VLWFLLNCMLIMS/GQ
actttctagacaaaatgggaatacaaggtgaagatagccacctgcaaactatgatgtaggccctcaccagacactgaatcttcctggccttgattttggacttcctagcctctagaattggtcttgctctgtcgtccaggctgaagtgcactggcatgatctcagctcattgcaacctccaccttctgggctcaagcaatcctcttaccttagcctcctgagtaactgagaccacaagcatgcaccaccataccagaatttgctctatcctcaacgttgcaaaatgtctgggcataggctgtgttgcatttctcacgtacagtatgagcagagaagcttacccattctgttgcagcaggtccagagaagtctcactgaagtgctttggtttttattgaattgcatgcttattatgtctggacaagaagatgtgtacatgaagaggatgttttgataggcctgacc

SEQ ID NO: 1698 - DNA, 433 bp, Homo sapiens
  CDS 8..325
  sig_peptide 8..58: Von Heijne matrix score 5 seq LPAITLFLTSAXA/LW
  misc_feature 98: n=a, g, c or t
accaaggatggaagtgggcttaccggccattaccctctttctcaccagcgccasagccctgtggtggcgacgacgatggaccaggagccagtgggcgntgtggaacgaggagaagccgtcgcagcctcgggagctgcggccgccgcggcattcggggaatctgcagggcagacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatc

SEQ ID NO: 1699 - DNA, 354 bp, Homo sapiens
  CDS 56..310
  sig_peptide 56..100: Von Heijne matrix score 5 seq KVLLLITAILAVA/VD
acttgccatttctcataacagcgtcagagagaaagaactgactgaaacgtttgagatgaagaaagttctcctcctgatcacagccatcttggcagtggctgttgatttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaatt

SEQ ID NO: 1700 - DNA, 782 bp, Homo sapiens
  CDS 188..679
  sig_peptide 188..658: Von Heijne matrix score 5 seq PFLSLFFLYFCFC/FL
agttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagcatgaaaaaaaaaaaaaaaaaaaaaaaaaaaaaaaaaaagaaaaaaaaaaaaaaatgcgaa

SEQ ID NO: 1701 - DNA, 281 bp, Homo sapiens
  CDS 51..209
  sig_peptide 51..95: Von Heijne matrix score 5 seq HVILLQVLGRSVC/FE
  misc_feature 279: n=a, g, c or t
cactgatgtagattaataatgtaagtyctgatttaaagaatggtgggaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaggtaaaaaaaaaaaaaaaaansc

SEQ ID NO: 1702 - DNA, 456 bp, Homo sapiens
  CDS 83..358
  sig_peptide 83..136: Von Heijne matrix score 5 seq ITLLGLAVNVVTT/LV
acagcgcggcggggcgtctcgctgctcgagcctgscgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttagggagctctttgaccatggctgtgactctctttccacagtatttatggcagtgggagcttcaattgccgctcgcttaggaacttatcctgactggttttttttctgstcttttattgggatgtttgtgttttattgcgctcattggcagacttatgtttcaggcatgttgaga

SEQ ID NO: 1703 - DNA, 457 bp, Homo sapiens
  CDS 79..288
  sig_peptide 79..279: Von Heijne matrix score 5 seq SINLLFFFLSSTS/IF
aaaaaatcataaagagaaacagacaaaaaggctggtcataggtacattgtcctacagcagtgatctttaaacttgagcatgcttgacagaacacagattatgacgcccaccccagagtatctggaagctgaagggcagtgtggaccagtgtcctcagattgtttaggtgaagcagtgctcctcctagccaagaatcatgcatcagaacccttctttcttctacatcctctgggacttcattctatcaatttgctcttcttttttttgtcttcaacctccatctttttgtgatgataattaagtactcacatgtacacacattcaaaaacacagaaataaggtgcttttgttttgtggagacactttttccttttccaattctaacagtacactattcaataaattacatgaaatattcggcaatttctcatataataggctttgtattggatgattt

SEQ ID NO: 1704 - DNA, 621 bp, Homo sapiens
  CDS 49..432
  sig_peptide 49..111: Von Heijne matrix score 5 seq LIVIFFYCWLSSS/HE
attagaattttctttctcaaattaaaggtttgagaaattcgtgatgagatgtcctgttccctaaagtttactttgattgtaatttttttttactgttggctttcatccagccatgaggagttagaaggtggtacatcgaagtcttttgacctccatacagtgattatgcttgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaataaaaaaaaaaaaaaatgccaa

SEQ ID NO: 1705 - DNA, 544 bp, Homo sapiens
  CDS 35..526
  sig_peptide 35..82: Von Heijne matrix score 5 seq CGLFLRTTAAARA/CR
agactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcacgactaggggagatcatcagcatggatgggtccatcactgtgaccctggcagcgcaccaggctattggcctcaaggggatcatcttggctggcactgaggagcagaaagccaaataacttgcctaaactggc

SEQ ID NO: 1706 - DNA, 489 bp, Homo sapiens
  CDS 148..402
  sig_peptide 148..204: Von Heijne matrix score 4.90000009536743 seq VKMLLNFVNLASS/DI
attcctggttggtgcctgggagagtgacgaggcctatcagtactggaggacacagtcaaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctaccgccgctccgtggaccatcgcaagtacctgcagaagcagctcaagcgcttctcccagaagtattcccggctcccgcggggccttcctggcagagctgctgagccctacctgaaaaaggggtctgaggaccggcccaggagggctgctcctggatttgggccctgattccagccccggcggggtgggggctgcaaggagaaggtgctgaggaacccctacagggagggaatgtcttgctaaggagcagct

SEQ ID NO: 1707 - DNA, 542 bp, Homo sapiens
  CDS 110..526
  sig_peptide 110..154: Von Heijne matrix score 4.90000009536743 seq AVVFVFSLLDCCA/LI
aggattcgagggccacacgcctcagccagccccggcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttsgtttccacttgctctgcttcttcatgtatctttatagtatgatcttagctttgataaatgactgaagctggagaagcc

SEQ ID NO: 1708 - DNA, 457 bp, Homo sapiens
  CDS 187..360
  sig_peptide 187..324: Von Heijne matrix score 4.90000009536743 seq VYIFFSFLSFVWQ/DT
tgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttc

SEQ ID NO: 1709 - DNA, 509 bp, Homo sapiens
  CDS 94..267
  sig_peptide 94..141: Von Heijne matrix score 4.90000009536743 seq AGLLIYFPQPSYG/GF
atgtagagggtgccttggaagccacataagcactcagcctcatttctggcccaccaggtgccagcagtgtgactcagttgcaagccccatcaaatggtggaagcgggactcttgatttatttcccccaacctagttatggtggattcaggcacctagtccctcacgactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagccaaaaaaaaaaaaaaaa

SEQ ID NO: 1710 - DNA, 494 bp, Homo sapiens
  CDS 176..325
  sig_peptide 176..298: Von Heijne matrix score 4.90000009536743 seq FCCLALVGLQILC/AF
gtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttstttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttsttctagtgtttcta

SEQ ID NO: 1711 - DNA, 511 bp, Homo sapiens
  CDS 50..403
  sig_peptide 50..355: Von Heijne matrix score 4.90000009536743 seq TVMSALSVAPSKA/RE
aggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccc

SEQ ID NO: 1712 - DNA, 529 bp, Homo sapiens
  CDS 178..507
  sig_peptide 178..324: Von Heijne matrix score 4.90000009536743 seq PSLAAGLLFGSLA/GL
acgacgtcccgcctttctccccgccctgscgcggccccggggcgcacggcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccartttgctgatggccgccaaagttkggaagttcgtatgttgatgacatctgattagcagag

SEQ ID NO: 1713 - DNA, 356 bp, Homo sapiens
  CDS 110..277
  sig_peptide 110..220: Von Heijne matrix score 4.90000009536743 seq LELLTSSHLPISA/SQ
ttttttttttgaagacagagtcttgctgtgtcacccaggctagagtgcagtggtgcactgactgctcactgcagccttgacctctcgggctcaagctgggactataggcatgcaccaccatgtccagctaattttttcattttttgtagaaacaaagttttaccatatttcccaggctggtctcgaactcctgacgtcaagtcatctacccatttcggcctcccaaagtgctgggattacaggcattagcaactgtacctggccgaaaataaacttttaagtggtcagttaatttgttcactcaataaaacttattgagcacctaatatgttccaagcactattctagaccatgag

SEQ ID NO: 1714 - DNA, 481 bp, Homo sapiens
  CDS 5..274
  sig_peptide 5..49: Von Heijne matrix score 4.90000009536743 seq SSMALSSTSLCSS/FI
aaaaatgatgtcatcaatggcactctcttctacttccctctgctcttctttcatctctcaacatccaaaactctccatcactgcttctcctccattgttccatacccaaacaaccaaacccatctctgtaaaacggaaaatcataactctagcagctccagagacactcaccgctgaaacagtcaccggaattgatacttccgacaacactccacaacaaacaacaaaggtggtgaagccagatgagaaatcaagagtggtactcaagtttgtgtgaatggagaagaacataggattaggattggaccaacatgtacctggacatggcacaatcccacttagtccttacttcttctggcctaggaaagatgcttgggaagagcttaagtctactcttgaagctaaaccatggatctctcagaagaagatgatcattcttcttaaccaagccactgacatcatcaatctctggcaacaaagt

SEQ ID NO: 1715 - DNA, 475 bp, Homo sapiens
  CDS 235..414
  sig_peptide 235..327: Von Heijne matrix score 4.90000009536743 seq YLAFLLFLEHVRS/GL
ttttgcctagattttcctcttaagagtctgttgagtctatttctagtagtcacttaactagttacttgtaactagatatctaactgcctcctaactagttcttacccataaaagtctatagtgcctatagcaaacagtcagattatgttacttttatggtcagatgcctccaaaggcttctaaactgattaagaataaaagatgaaggccttataatgggctgagagactctacatgatatcctgctttccagtcattccacatcgacattatcttctattaccctcttacttggcctttttgctgttccttgaacatgtcaggtctggtctccccttatggcctttgcacttgtttctctgtctagaattttttccccaaagatacccacatgactccatcacttctttctggtaagtatgttcaaatgttaacatgcttgctcattttggtcttctttgaagactaccttatc

SEQ ID NO: 1716 - DNA, 497 bp, Homo sapiens
  CDS 170..319
  sig_peptide 170..277: Von Heijne matrix score 4.90000009536743 seq TSMVLLLVNCGNS/DP
acacaccctcatcaccatcctgatcgccgtccaaaaaacgttcacgtcttgcctccttccgaggcagggatcctgtccctgccccaggagcttcctgttgactgtaggtcgaaccagccttgccgggaggggaaccgaagctgagttctgtttggcgactatcccagtcatggtggctttggcttatgttgggacagcgtttttctatatgatgctggcggcascagtgagaagtgcaacaagtatggttctcctgcttgtcaactgtggaaacagcgaccctgaaagtggaggagccacagctggaatcgtgtccgtctgaatacacgcacctttcctatgagccttgtaaagccagtcgttgaagaagggggaggacccggaaggatggggtgggggcgtaaagatgaaggttaatcaaggtcctcatggactgaaccttgaggcccttctgctgcagtcacttttgccctatcagacttttagagtaacttcct

SEQ ID NO: 1717 - DNA, 496 bp, Homo sapiens
  CDS 229..471
  sig_peptide 229..384: Von Heijne matrix score 4.90000009536743 seq SLLLLHLHLLLHQ/NG
ttcgcggttagggattccatagttcacgggttacggcacacacgcgttacgtatatatcgaggttaatctgcgcaastcttcacttttgtctgaatgtattttagcggtgaattactccttctggctaagagcttcacatcttcagtgttaatggtggtggttttcgcatgtcttgcacacatttctagatcttgcactgtcgaaaagtcagctccgaaattgctgcaatgataagtttgctgaactgcatctctgcccaatgccacttcctcgcaaagacaacccacagtgtagtccactgctgcctcctttggcctctgttggtaagaaaatggctaagaaaatcgctgctgctcctccacctccacctcctcctccatcagaacggcgaggcaaacgcgcagaacagaaaggggctgtggggcagcggccagattggattttctctccgcagccccaarggatgtttctaatgacccaaggaaaattagtggt

SEQ ID NO: 1718 - DNA, 476 bp, Homo sapiens
  CDS 53..271
  sig_peptide 53..94: Von Heijne matrix score 4.90000009536743 seq GVFVCICVGRAFG/GK
  misc_feature 313: n=a, g, c or t
aaaaccacttcttcccccctaccccccgccacgcgaggctgcggcgcacggtatgggtgtgtttgtgtgtatttgtgtggggagggcgtttggagggaaggttaccgggagctcgaggccgctggggaacagggatcccggtgacaaagatggggatatttcctctgtcttccacttggaaacctcaacccccgcttcaggctccctagatactttctggggcccaaccgaagccgtagccatccaaagcgttcccagcctttctggggagtgaaacttacccccggggttcgtcctagaggagcgtgassgngaatgcccaggtcaaccgggctgtccgaattccgccccggctcagcctccggcctcagtccgggagagagatctgcctgtcggtctgggctgggggaaacgcggcagtggcctgggcamaggttgagggcagagtaaccagtgggaaggctgcgttttcacga

SEQ ID NO: 1719 - DNA, 506 bp, Homo sapiens
  CDS 278..463
  sig_peptide 278..394: Von Heijne matrix score 4.90000009536743 seq FVILKLFCIWTNT/KY
  misc_feature 501: n=a, g, c or t
atgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcctttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggccttttttttttttttttaaaacctgtgtatccatctcaycctttggcgcattcctagtaagcaaaaaaatttgttatgccatctycattatncgaat

SEQ ID NO: 1720 - DNA, 511 bp, Homo sapiens
  CDS 202..351
  sig_peptide 202..297: Von Heijne matrix score 4.90000009536743 seq LCPVLAPFGEILG/CR
tttggttttgaagattctgttgaggcgccatcctcaccttgacctcttctacaaaatctgtctcccctgctgtgccgtggaacacctacgggaagccagtaagttaaagtcctaagatcaaagcccctccctctactgcctgcatctcctgtcataaaagcctgaattgtatggttattcttacaccctgtgggatgggggatgctttatacggacatggcacattatcctcaaagggccctggatgcacccataagtttgtgtcccgtgcttgccccctttggtgaaattcttggctgtcggtgtcattttaaggaaatcaggggaaattacccagaagatcagggtctgtaggagaagaggggtaggggatgcatcagtgacccaaacttgctggtgagatttggcagctgaagccatttaaagagattggcggttgggcgtggtgactcatgcctgtaatccagcactttgggaggtgagtagatcacctgargtcaggagttcgaga

SEQ ID NO: 1721 - DNA, 1062 bp, Homo sapiens
  CDS 56..271
  sig_peptide 56..214: Von Heijne matrix score 4.90000009536743 seq LICTGFLLMWCSS/TN
gggaaaactcgagcacccagaacggcttccggcgggagctgtgcagctccttatcatggggacaattcatctctttcgaaaaccacaaagatccttttttggcaagttgttacgggaatttagacttgtagcagctgaccgaacctggaagatactgctctttggtgtaataaacttgatatgtactggcttcctgcttatgtggtgcagttctactaatagtatagctttaactgcctatacttacctgaccatttttgatctttttaggtaagtttttaggaaatcttaatgttttggagctaataaggaacttggtagaaatgtggtatagccatacaattcagcaataaaaacagcaactactgatatcttacaagaaaacaataaaaacattatgctttgaagacagtcataaaggaccacatattttatgatttcatttatatgaaatgtccaaaacaggcaaatctatggagagaaaaagtagattatgaagaagttttctttgcttaaaggaaagtaatctactaaataagtaaaattatcaacatagwacaaacacacawacwacaataattagagacatwacagtaattagagggcaggtggggcggctcatgcctgcaattccagcactttgggaggccgaggcgggtggatcacttgaggtcaggagtttacgaccagcctggccaacatggtgaaaccccgtctctactaaaaatacaaaaagccaggcatggtggtgtatgcctgtagtcccagctacttgggagggtgaggcataagacttgcttggacccaggaggcggaggttgcagtgagccgagattgtgccaccacactccagcctgggcaacgagcgaaactcagtctcaaaaaacaaaatatttataaatttgattatattaaagttaaaaactctaggtagcaaatgtcaccataaacagagaataacctgagaagatatttgtaattcatacctcagagggctaattttgctaacatttgaagggccctacaatttaagacaaagaccaaaaaaaaaaaaaaatgcga

SEQ ID NO: 1722 - DNA, 552 bp, Homo sapiens
  CDS 62..235
  sig_peptide 62..115: Von Heijne matrix score 4.90000009536743 seq SFLWLSSIPSCVC/XY
ttccattcttgagttacttcacttagaataatagcctccaaactcatccaggtcactgtgaatgccattaactcattcctttttatggctgagtagtattccatcgtgtgtgtgtdtgtatgtgtgtgtgtatgtgtatctatatatatctcacagtttctttatccattcattgattgatgggatgggcattttagttggttccacggttttgcaattgcaaattgtgctgctataaacatgcatgcacaagtatctttttcatatagtgacttcttttcctcttggtagatacccagcagtgagattgctggatcaaatggtagatctacttttagttctttaaggaatctccacactgttttccatagtgattgtactagtttacattcccaccaacagtgtagaagtgttccctgttcactccagcctgggtaacagagcgaggctccatctcaaaacaacaacaacaacaaaacaacaaaaaaagcccacaaaaatcagtaactcaaccccttttacaatagctgcaaaaaaaaaaaaaaatccgaa

SEQ ID NO: 1723 - DNA, 498 bp, Homo sapiens
  CDS 8..214
  sig_peptide 8..100: Von Heijne matrix score 4.90000009536743 seq AVYALCDLSPSNP/AE
tattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttag

SEQ ID NO: 1724 - DNA, 444 bp, Homo sapiens
  CDS 55..240
  sig_peptide 55..183: Von Heijne matrix score 4.90000009536743 seq LFLACNFMLQCLS/LA
  misc_feature 253: n=a, g, c or t
ttttttgcctgccgtcacgtgagtcgtgcttttgctcctcctttgccttctgccatgattgtgcggcctcccaggcagctcatcagtagtgtcatacacatttttaggattattgtcaaatttgggaaagcctctatcaagatattatttctggcctgcaacttcatgttacaatgcctgagtcttgctctgttgcctagactggagtgcagtggcagtgatcgtagcttactgcagccttgacttcccgggntcaagcaatcctctcatcgcagccacctgagtagctgggagtacaggtaaggaacagaaagctaaagagattacgacttacctgaggtcacacactggtaagcagtggagctggtactttggttccagaatctatgctcctaactatgctatgctgcttcttattttatctggaagagtgtacacatacat

SEQ ID NO: 1725 - DNA, 527 bp, Homo sapiens
  CDS 21..209
  sig_peptide 21..122: Von Heijne matrix score 4.90000009536743 seq SWMVVILCVSVWG/LY
aagctgaattttgtggcagaatgtatgagctgattttattaacacataaggatagggcaaaggcagaaaaactatttctcctcagctggatggtggttattttgtgtgtgtctgtttgggggctttattttgatccacctcaagcagaagatatgctggccagaagagactctgaagacatcgagggcataggcagggagggtagaaaataagaaatttaaagtaataaaagttgtgggttttctatactagataatgagaaatgatgaactaaatatacagtatttctacattctttggcatgcacatgaaataaagtcatactttttttcaacaaatacaacagctgcaaaagtaggtaaattttatttcataaacttacctttctttagatgattttctttgtttttcatatttttagtttcaaatgctttgtgagatctctagatgccgtttagttttataagagggcttaatattaaacttgggttaaatacgtatatgtttatttgaatatttcacttgcg

SEQ ID NO: 1726 - DNA, 494 bp, Homo sapiens
  CDS 108..275
  sig_peptide 108..218: Von Heijne matrix score 4.90000009536743 seq LELLTSSHLPISA/SQ
ttttttttgaagacagagtcttgctgtgtcacccaggctagagtgcagtggtgcactgactgctcactgcagccttgacctctcgggctcaagctgggactataggcatgcaccaccatgtccagctaattttttcattttttgtagaaacaaagttttaccatatttcccaggctggtctcgaactcctgacgtcaagtcatctacccatttcggcctcccaaagtgctgggattacaggcattagcaactgtacctggccgaaaataaacttttaagtggtcagttaatttgttcactcaataaaacttattgagcacctaatatgttccaagcactattctagaccatgaggaaatagaagcaaatacaaagagataaaattcttgactccatgaaatttataatccagtgtgagaggcagaaaatgaacaataaaatgttttatagtgatcagtcttaagaagaacaagtaagtttaagagacaaagggt

SEQ ID NO: 1727 - DNA, 567 bp, Homo sapiens
  CDS 234..407
  sig_peptide 234..368: Von Heijne matrix score 4.80000019073486 seq IIWSLILMSPVET/LG
caagagattgtagatgcctagtttgatttaaacactattgtaaacctatcttgcctattgtgtggacaccaaaagagaccaatgagcctgtttatttttcagaggtctaggaaaattgcatccgtgtgagtagatgtacagaactaatctaaaagtgattgctagtaacattttagaatataataatttcaagaattattctgagtgttttaaatgtgccctgaaatgttggcatgtcatttcagcatttccatttgaattgctcttgtaatatttttgcacaaaaaggactgagaaaaagaatactttggttaaaggaaaaaaatagtataatttggtctttaattttaatgtctcctgtggaaacactggggatgaattttgttggcacagttattcaggatatttaaaacagtgttgaacagttcacaagaaattaagcaaacttggattttaaaaattaaaatactttctttccatgtgactgttttgcatagttttttccccctatgtcataacactacattccttgtttttcytaaataaaatactctgcaggkttaaaaa

SEQ ID NO: 1728 - DNA, 507 bp, Homo sapiens
  CDS 128..319
  sig_peptide 128..169: Von Heijne matrix score 4.80000019073486 seq FCCCWFLFFETES/RS
taaagggaacctctggaagaggctggacagaagagtcacaaggttgataatgaattgacttattattccttcctgatctacttttaatattttgtgtcttgatagaaaacattattatagtttaataatgttttgttgttgttggtttttgttttttgagacggagtcgcgctctgttgcccaggctggagtgcattggtgccatctcggctcactgcaagctccgtgtcccgagttcacaccattctcctgcctcagcatgcctagtagatgggagtacaggcacgcaccaccacgcccggctaattttttgtgtttttagtagagacggggtttcaccgtgttagccaggatggtcttgatcctctgacctcgtgatccgcctgccttggccthccaaagtgctgggattacaggcgtgagccactgcgcccccgcagtaatggkttttttttgactgtatgtcygkttcctttgaggactttacgtgctgagctatttctaata

SEQ ID NO: 1729 - DNA, 482 bp, Homo sapiens
  CDS 17..187
  sig_peptide 17..97: Von Heijne matrix score 4.80000019073486 seq AELIYLFSPPALG/SF
taattgtgtcctccttatgaccctttgtagtctccaaaggctgggctcctcttctgttgctgagctaatctatttattctccccgcctgcgcttggctcattcctgggcccaagccttaccacttgctactcttcctctaaatttggatttcttcccctctcttgtcctcaaacccactgtcacttttgaatttgaagacatgttgctttgcacgccgctcctctttggggtacatctgtgagcacctgcatggctaagagggagtgctcagtgagaacccagtgaatgatgaaggtgtatgtgaatgacgattggatgggagaggctgcccaagtggaaaagcggtatttgcttttcagtacaggaaaatttccgtgatatttttctggcacacaataaagaaaatgctatattgaagcaaattaatatattttaactttgtgtagatgcagtgggaattactttttaaatggtgtatgga

SEQ ID NO: 1730 - DNA, 470 bp, Homo sapiens
  CDS 147..326
  sig_peptide 147..239: Von Heijne matrix score 4.80000019073486 seq LIVPSGWSTRSCA/VP
  misc_feature 247,457: n=a, g, c or t
ttattattattcacatgcttttctttataggatagccatacatgtatcactaactgttctaccatatctcataacctcttatatagtttcccttttttgtcatatttgctgtgttctggataatttcttcagatctatcttccgatatgaaattgtcccttgacaaagtggaggacaaggctggatttggccaccatagactcattgttcccagtggctggtccactaggtcgtgtgctgtgccttnccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagngrccatatatgta

SEQ ID NO: 1731 - DNA, 483 bp, Homo sapiens
  CDS 50..241
  sig_peptide 50..151: Von Heijne matrix score 4.80000019073486 seq LLCLFYVWLCLET/QI
tcaatataaatggaatcatgtaagatataatatagtcagctaacatataatgatgtttcggtcaatgaccacatataggaaggtggtcccacaagattataatactgtatttttactgtgccttttctatgtttggctatgtttagagacacaaatactcaccatgttacaaccagctacagtattcagtacactgagggccatacagttttgtagcctaagtgcaacacgttataccatttagccagggtgtgtagaaggctgtaccttcttggtttgtgtgaatacactttatgatgtgtacatgatgacaagttggctaacaacacatttctcagaaggtatccctgccgttaagtgatgcttggctgtatataatacataagatatggtattgtgtgcctgggctcttagacctagcatagtattttcaaggttaatgtgtagcatgagtcactacttcattcctttctgtgtctgagt

SEQ ID NO: 1732 - DNA, 491 bp, Homo sapiens
  CDS 28..387
  sig_peptide 28..342: Von Heijne matrix score 4.80000019073486 seq LVKWTMSLSSCHS/HN
agcgcatggcgtcattgaagagagaccatgatggcggcggcgctggggcccccagaagtgatcgctcagctggagaacgcggctaaagttctgatggctggagtgcagtggcacgatcttggctcactgccacctccacctcccgggttcaagcgattctcctgcctcagcctcccgagtagctgggactacaggcaccaccttccatggtcaataatgaacaacgccagcatgcagagcacatattcttatcatttaggaaatcaaaatcaccatttgcagtttgcaagcatattttggaaactagtaaagtggactatgtctctttcaagctgccacagccataatggaagcagttgtccgagagtggattctcttggaaaaaggtagcatcgagtctctgcgaacattccttttaacctatgtcttacaaaggccaagtaagtacatggagggggactgctgaaatacttttgctgagcttatgtgta

SEQ ID NO: 1733 - DNA, 568 bp, Homo sapiens
  CDS 73..390
  sig_peptide 73..198: Von Heijne matrix score 4.80000019073486 seq PNFLLLGVPTASG/KM
ggttccaacatggcggastgacggtggaggttcgcggctctaacggggctttctacaaggaatttatcaaagatgttcttgaagactcccttacagttgtttttgaaaataagtaagttatttttgttgacaaaggccttaattttagagatggcagtgccaaactttttgcttttgggtgttcctactgccagtggaaaaatgattttgcttttagggagtggggaggtttggttgtttgatcataagtctagttttgataattctttatctgtttttctgtccataattgtcacttttttcataaccctcttcgccagaacatgtatggatatgaatcagttttgcagaaatagatggcacaaattagatgataatatgcttaatatttaaaagcccagaattttcaaatgaggttgtagaaggtcttccagttgactactggtcatcagaataagtattaagccatttttaattgcctgaggggtatgcagtctaaaaatgggaaagacagcatgctgggtttggttaggaagggctataaaagagcgctgggctgcgtgcggtg

SEQ ID NO: 1734 - DNA, 540 bp, Homo sapiens
  CDS 235..525
  sig_peptide 235..456: Von Heijne matrix score 4.80000019073486 seq VTLLLLWFGMFLS/IS
agtgtgtttaagactagggtcatgcccacatcaatctcagattcccattttatctttcttttttggtatcactcctagtaccaagtcttgtgtctgtcaatatcctgtccaaaaaagaaaaacacaccaaggaaaattaatataggaaaaatttaaaaagttattagaggactgaaaatataaaaatggaacactgaaagacacagagtttttattttcagcactgcagctctgatggtccagctccaccaggacacagatccccagatccctaaaggtcagccatgcaccctgaacagctcagagggaggagccaggccagcagtgcctcacaccttgttctcttctgctctagacagatggctccataatgacagcttcataatggcagtgggtgagcccctggtgcacatcagggtcactcttctgctgctctggtttggaatgtttttgtctatttctggccactctcaggccaggccctcccagtatttcacttctccagaagtggtgatccctttgaagtgatcagcagggcag

SEQ ID NO: 1735 - DNA, 440 bp, Homo sapiens
  CDS 52..372
  sig_peptide 52..174: Von Heijne matrix score 4.80000019073486 seq FFFLSFFPSFLRQ/SL
cccttttagttgagactcgtcggtgaggctgcaagctcgctgtttcctgctatggcttgtgtgactgagtatgcagtaaccgggggtggatgtcgacacaagttccacgcgttaggagtaaacactgcgagtgkttttttttttctttctttctttccttcttttttgagacagagtctcgctctgtggcccaggctggagtgcagtggcgcaatttcagctcactgcaacctccgccttcctagttcaagcgattctcttgcctcagcctyccgagtagctgggactacaggcacgcgccagcacgcccgsctaatttttgkgtttagtagaracggggkttcactgttggccagaatggtctcgaactcttgacctcgtgatccgcccgcctcggscttccaaagtgctgggattacaggcgtgagccaccacgcccs

SEQ ID NO: 1736 - DNA, 505 bp, Homo sapiens
  CDS 51..368
  sig_peptide 51..341: Von Heijne matrix score 4.80000019073486 seq ILDVILLVFVLSS/IH
aagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaca

SEQ ID NO: 1737 - DNA, 712 bp, Homo sapiens
  CDS 86..244
  sig_peptide 86..223: Von Heijne matrix score 4.69999980926514 seq GATFTTSLPLTQA/GS
agttctccgacttctgggcattccacgtaggacgctttctcatgagtgtctgaaaccgtcagttcactgccagaaatggagatacatgtttcctgataaactggcacttgccttttcaaagccaccatttcctctatcctctgggctgtcacaaatcctcctctgcacctcaggagtgccccttggagccacgttcaccacttctctgcccctgacccaggctggttcccaggccttggggtcctagcgtggacctcctggaagtaattaatgcagttttccagattaactcgaagtaccccacgactaaacgctaatgaaactagaggaggcacagcttcagctccgtgcaggatggatgcacaagagcagaatctccatgggacgcctttctggagcatcagtattactgcaggatttggaagaaacaaattcaaataatttccaaagtcaaagcaacctatatgtcatcatacaaactacaggctacgatgagcacctcattttctttctggaaggctgaccttaaatgtcctgcacattcctatagtgcatatttacccttttcctatactaagtaagccctaaatcttggcggtaacagcctggggaactacctgtcttgctaccactcaagaccatgcttctccacaaattccccccaataaattaccctttactkacaaacsggaaaaaaaaaaaaaaatkcgaa

SEQ ID NO: 1738 - DNA, 649 bp, Homo sapiens
  CDS 50..340
  sig_peptide 50..229: Von Heijne matrix score 4.69999980926514 seq PVMAFGLVTLSLC/VA
gaggagaagaggtgaccccgctaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatattttctttccttactcttataaaagtgccatgagaatggaagttgtttttgttaattattaaattctgtataataaaaaaaaaaaaaaatgcgaa

SEQ ID NO: 1739 - DNA, 451 bp, Homo sapiens
  CDS 2..250
  sig_peptide 2..124: Von Heijne matrix score 4.69999980926514 seq FVFLGGQLTLALG/VL
catgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagctctgggagcaggatccttacttcttgtcatcacctacccactaatgaaaagaatttcatactggcctcaactagccttgggacaaaagagatgatgttttgattggtcttaagtcaacggctctgcggttcggagaaaataccaagccgtggctcagtggcttcagtgttgcaatgctgggggcactgagcctagtgggtgtgaacagtggacagactgctccctactacgctgccctgggtgctgtaggagcccatctgactcaccagatttacactctagacatccacagacctgagg

SEQ ID NO: 1740 - DNA, 296 bp, Homo sapiens
  CDS 23..247
  sig_peptide 23..178: Von Heijne matrix score 4.69999980926514 seq AWKGCLSLPSCSQ/RP
atgatgtcatggggctggttacatgactgccaaggggtgctgctggccacactgcactagcaagtttgccagatggaggacaagcgatcatttagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagc

SEQ ID NO: 1741 - DNA, 478 bp, Homo sapiens
  CDS 194..346
  sig_peptide 194..313: Von Heijne matrix score 4.69999980926514 seq VFTSYVISSPVWA/GP
actcasctcccagaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaagacaggtttctaagacagccaccgatgggtcctacctcctcgtattcacatcctatgtaatctcctccccagtgtgggctggacctggtgacttgcttccagtgaatagaatatagcaaaagtgattgatgtcacctccagattcagctatagaagactatgactatgactttcctcttggctagcattctcgctaacccttcctgcttgcttgtactgagctgccctatgaagaggccatgtag

SEQ ID NO: 1742 - DNA, 454 bp, Homo sapiens
  CDS 128..412
  sig_peptide 128..253: Von Heijne matrix score 4.69999980926514 seq FSCLGPLSSCSTG/VR
  misc_feature 383,427: n=a, g, c or t
atttagcttttctctatttgttagcttttgtacttaagattgttttatccacatatttagacaactgccatacacagctgcacagctgccttataggtaatagtttttttgtttttktttttttttaatgacggagtctggctctgtcacccaggctggactgcggtggcatgatctcagctcactgcaacctccacctcctgcgtttaggggattctcatgtctcggccccctgagtagctgctctacaggtgtgcgctaccgtgcctggctaatttttgtatttttaatagagacagggttttgccatgttgtccaggctggtctcgaactcctgacttcgggtgatccacccgccttggcctcccaaggtgctggggttncgggtgagagccatgctgcccagcctatgtaatagattttwarnattcagtgctgggcgcgtggcycatgc

SEQ ID NO: 1743 - DNA, 630 bp, Homo sapiens
  CDS 132..449
  sig_peptide 132..404: Von Heijne matrix score 4.69999980926514 seq VICLVGAXISTSA/AS
aactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctsgaatctccacatccgcagcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgca

SEQ ID NO: 1744 - DNA, 512 bp, Homo sapiens
  CDS 86..244
  sig_peptide 86..223: Von Heijne matrix score 4.69999980926514 seq GATFTTSLPLTQA/GS
agttctccgacttctgggcattccacgtaggacgctttctcatgagtgtctgaaaccgtcagttcactgccagaaatggagatacatgtttcctgataaactggcacttgccttttcaaagccaccatttcctctatcctctgggctgtcacaaatcctcctctgcacctcaggagtgccccttggagccacgttcaccacttctctgcccctgacccaggctggttcccaggccttggggtcctagcgtggacctcctggaagtaattaatgcagttttccagattaactcgaagtaccccacgactaaacgctaatgaaactagaggaggcacagcttcagctccgtgcaggatggatgcacaagagcagaatctccatgggacgcctttctggagcatcagtattactgcaggatttggaagaaacaaattcaaataatttccaaagtaagacactggaaatttaagaggaagctggaaactcatctgcctttaatacttttttttctc

SEQ ID NO: 1745 - DNA, 767 bp, Homo sapiens
  CDS 83..658
  sig_peptide 83..157: Von Heijne matrix score 4.69999980926514 seq LCALLSNFCPSTT/VK
ttttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagttgcgcatgttcactgggcgtcttcccatcggccccttcgccagtgtggggaacgcggcggactgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaatgcgaa

SEQ ID NO: 1746 - DNA, 363 bp, Homo sapiens
  CDS 79..276
  sig_peptide 79..126: Von Heijne matrix score 4.69999980926514 seq SLFCFVVLFETES/RS
  misc_feature 267,282: n=a, g, c or t
actcctgacctcaagtgatccacctgcctcagactcccaaagtgttgggattacaagtgtgcaccctcgagccttgccatggctgattctttgttttgttttgttgtgttgtttgagacagagtctcgctctgtcgcccaggctggagtkcagtggcgcgatctcggctcactgcaagctccgccttccgggttcacgccattctcctgcctcagcctcccgaggagctgggactataggcacccaccaccacgcctggctaatttnttgtatytytagtanagacagggtttcactgtgctggccaggatggtctcgatctcctgacctcgtaatcccagcactttgggaggctgaggccgg

SEQ ID NO: 1747 - DNA, 478 bp, Homo sapiens
  CDS 63..299
  sig_peptide 63..104: Von Heijne matrix score 4.69999980926514 seq SVLTPLLLRGLTG/SA
  misc_feature 200,202..203,417,471: n=a, g, c or t
cattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttasmtcntnnttcgtgasdvttsctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtbattyaattccagtcacctcttctgcaatcatgacctcttgatgtntccatggtgacctccttgggggtcactgacctgcttggtggggtccccttgtanaataaaa

SEQ ID NO: 1748 - DNA, 404 bp, Homo sapiens
  CDS 73..249
  sig_peptide 73..120: Von Heijne matrix score 4.69999980926514 seq CGLFLRTTAAXRA/CR
atcagacgtgtgtgtgtccctgcggcgctaagaagggsmgactgaggctgaggctggggaacatcgggcagcatgagcggctgcgggctcttcctgcgcaccacggctgcrrctcgtgcctgccgggrtctggtggtctctaccgcgaaccggcggctactgcgcaccagcccgcctgtacgagctttcgccaaagagcttttcctaggcaaaatcaagaagtgttgtgtctacttcacagatgtgttgtagagccccagtgagataaacggtgcatggagagtcttcttaaactgtagagtactgtgcagcagaagagagagctggcttcaacacttagtcttgtgaccttggagctgacggctgcacctccctgtgcctcagtgcattcatctacaaaatag

SEQ ID NO: 1749 - DNA, 394 bp, Homo sapiens
  CDS 17..316
  sig_peptide 17..181: Von Heijne matrix score 4.69999980926514 seq VHSLSXXLPSXQL/AP
agagtcagagcgggccatggaagagctgcaccggcaggagggcactttgacccttctagaaggaaacccaaaagcaggccccaaaaggagagggggcacaccagggagccggattctggggccttattttcctgccacaggggttcattccctttcawtctyactkccatccastcagcttgcaccagacgttccccsamagccctgtttctctttaggcgaagtttggagaaaacccaaatccctctccctgttccccttagtgcagctgacaatcggaaaaagcagagggtcccgcaacgggagcggaasgdcatgacttctccttgtttaagctttcggacacggagatgcgggtgaagatctcaccacagcttctgctagccacacaccg

SEQ ID NO: 1750 - DNA, 587 bp, Homo sapiens
  CDS 85..333
  sig_peptide 85..192: Von Heijne matrix score 4.69999980926514 seq LVLLLYPQELTWT/QI
gggacacacttggtttcagggaaggggaaagaggtcaccaagggcagaggtgtccaggccggagccaggggccccactgttgggatgctggctgcagtggggcgccccaagcccaggtcccctctgtcttctctttcgawctttgcagctgtacttgttttgctcctctacccgcaggagctgacatggacccaaatacctcgggccgccctggagcgccagcagctccgccttcagggagcggcaaaaattcttcgaggacattttacagccagagacagagtttgtctttcctctgtcccatctgcatcgtcgagtcgcagagaccccccataggtagtatctcatccatggaagtgaatgtggaccacactggagcaagtagaagcttattgaccttggtgtgwacccggatgcagcagaatgtgttcttgcctttgcgaaagatcctcccaccaacccccccagttcgtctgggatggacaaccaatttggagggagctgagcctgccggtgcctacatcagacaggaccacatctaggacctcctcctcctcctcctccgamtcctccaccaaacctgcata

SEQ ID NO: 1751 - DNA, 582 bp, Homo sapiens
  CDS 155..376
  sig_peptide 155..361: Von Heijne matrix score 4.69999980926514 seq FLHFLELALVTFS/LS
atgtactttcaaagaggaacaagaatgacctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccaggaaaggctccaaaatgtatggtctaaagagctacatcgaatatcagctaacacctactgtaagtatccacgttatcaaaagcagaatcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgtgtgtaatgctaaacccaggatgacaaatagaaagactccagtcagattatcttcctgtaagtcagtgatggcatttt

SEQ ID NO: 1752 - DNA, 475 bp, Homo sapiens
  CDS 286..465
  sig_peptide 286..375: Von Heijne matrix score 4.69999980926514 seq CAAAALGFGSARC/WP
  misc_feature 405: n=a, g, c or t
atcaaaacaaggatcgcaggagaggaactgcaaggcactgagcggccactctaagtcccagggacctcgaagtctttatcctgctgaatgctcacaaaccacctctgaggcaggaccggtctcctcacttcacacgtgagagagtcaacattcagaaaagtcagtgctgaagcctgaagtcacaggttgggtggacaatggagccaggcttttcccagatctcgctgaataaactgctcacgggctttctattctactgtatgttgctgagatgaccgtcccagaatggccccacccttgctaaactgggagctgcctggaactaaggtaagccgctgtgctgctgctgcgctgggcttcggaagtgccaggtgctggcctgtgagccgcacacagctgtgtsanctgcccaagccccagtccctcctgctgaatcagttcctcacaattggctttatttcatcttaaattgctc

SEQ ID NO: 1753 - DNA, 513 bp, Homo sapiens
  CDS 262..501
  sig_peptide 262..321: Von Heijne matrix score 4.69999980926514 seq LVLTLIVAKVLRG/AE
taaatcaaattagctggtctctgaattaagggggagacgaccttctctaagatgaacagggttcgccccagtcctcctgcctggagacagttgatgtgtcatgcagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccatdmaagaacagggtcctcaggccctgcccgcttcctgtccactgccccctccccatccccagcccagccgagggaatcccgtgggttgcttacctacctataaggtggtttataagctgctgtcctggccastgcattcaaattccaatgtgtacttcatagtgtaaaaat

SEQ ID NO: 1754 - DNA, 475 bp, Homo sapiens
  CDS 46..249
  sig_peptide 46..174: Von Heijne matrix score 4.69999980926514 seq ICPLFCFMPTSFS/TF
tctatggttagaagccagatatgcccaggttcttcctgttgacagatgcgcctgactttccacatgacttgttcagaaagcttcaggctaggtctaaccaaaggcaaacgtacacttggtcagggaacaaaacctatctgtccactgttttgctttatgcccactagtttctcaacattctccctctcccctcacacacacacataccaccactcaaactgcaccccaactctaattgacttcagaaggtgatttcctcagcctgccttatcttttctttaaaaccttagctgtatacaggaaagaaagtattatacttctgaaggataaatagtatacctagaaccattcttattttgaaaattgggaagcatccgtgtgttgcctttggagtgacagtattaaagggtttgcaaattgctgttttccttgggaggattactcaaaattaaaaagcagaaaagctgagtttgga

SEQ ID NO: 1755 - DNA, 487 bp, Homo sapiens
  CDS 33..218
  sig_peptide 33..185: Von Heijne matrix score 4.69999980926514 seq LLLTLFFLAWLYK/SI
atttgacaaatatttaattagtatctacaaatatgtcaaactctgctgagaactgggcatacaaatatggatatgctcaaatcctttctgtggaggagttcagcatttggggtatggcaaacattgttggttggctgagtcgaaagctcttgctaacactcttctttcttgcatggctatacaaaagcattggaaaattcctagcagctactgatatgtgagcagaaacttgctggaagtgatagtggtggtggcggtggtaaagatgcttctgttttcttattaaaagaggatgattgtagctagtgctccccccactcttcttcttgccttgagcacagatctaatacctacaggatagcagccatctggggactatgaggtgataagccaaaaataattggagagatattaggcatcattaagtcagcaatccaacattaggtgacactacttcctgactttttattttcaaaggtaaatgata

SEQ ID NO: 1756 - DNA, 450 bp, Homo sapiens
  CDS 19..168
  sig_peptide 19..135: Von Heijne matrix score 4.69999980926514 seq FIFLLFCEPYCES/WL
tatttggaaaggactgatatgaggtatgtgtgtgaagtgctgattgtggagagaattttcaaaagtggtgtgagagtgtttgttgacatggccaactttatatttttacttttctgtgaaccctactgtgaatcctggcttctatcatggactttaaaatcttttacttaaagtataatctgagaacatatttgttcttttattcattggttggttggttcaatagactctttgtgcatttgttcaatccttcattttatcatttcttcatcacttaattatacggccaatacagaaagtatttattgagcatctactatagtgctagtcatgtaacctctgatttattttccacaatttttgttggtaccattcattcatcattcaacagttactagtacgtaccctataccaagcataaagaaatatagacaagggatcttgctggaa

SEQ ID NO: 1757 - DNA, 700 bp, Homo sapiens
  CDS 55..399
  sig_peptide 55..192: Von Heijne matrix score 4.69999980926514 seq ILTGLTVGSAADA/GE
aatgcttgaggaaaactgggaacagtatattgttctgaaaacctaaaaagtttaatgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagacgaaaaaaaaaaaaaaatgcgaa

SEQ ID NO: 1758 - DNA, 517 bp, Homo sapiens
  CDS 9..380
  sig_peptide 9..104: Von Heijne matrix score 4.69999980926514 seq AVFAVLFVFFLFA/ML
  misc_feature 436: n=a, g, c or t
acatcctaatggtggtggttgaaccaggagccagtttattcccaaatggtgttccttggctctatgctgtgtttgctgtgctttttgtattttttctttttgccatgttatctccctttttayttgagatagaccagcacataaagaaattcttgrtcagatgcaggtattctctgcataacactgtgcataaggacaaaaaaaacagtgagataaagatggaccatctagaaaggccaggctgtccactggagtcaccaaggagaggagttctgggagggaagaaaaatgggatgggaaacgacccattactatttgtgaaagtgacaaaagaacccagggattctgaggctgaaatctatacccctgggccttcagtttgagagtcatttagcctatatggaattacctgtgacattacattccagagagatgngaaattctgagacccttattatcgatgtttatattgaaaaaatggtaataaatattttgagactcccaaaaaaaaaaaaaa

SEQ ID NO: 1759 - DNA, 418 bp, Homo sapiens
  CDS 62..385
  sig_peptide 62..370: Von Heijne matrix score 4.69999980926514 seq KLLCLQQSGRAGA/SQ
ctttttagggagtccaaggtacagtcgccgcgtgcgrrsttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtgggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttca

SEQ ID NO: 1760 - DNA, 492 bp, Homo sapiens
  CDS 78..311
  sig_peptide 78..200: Von Heijne matrix score 4.59999990463257 seq AYLLYILLTGALQ/FG
aaaacagcacatccggtgtggtcgacaggtcctccaagagttmtggggcgacggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttcc

SEQ ID NO: 1761 - DNA, 475 bp, Homo sapiens
  CDS 216..395
  sig_peptide 216..260: Von Heijne matrix score 4.59999990463257 seq LFRVLFSCTCALL/QD
  misc_feature 278: n=a, g, c or t
agttacttctttgctaggttgaggaaagggtggaagcgcctcctgcagccacgaatatcctccagtgcctgagagaaaacggcctaatcgaaaacgtccgcggcatacatccattcttaaaacttgagtggctgcttttctgggtggaaaagagcggtatcagacagggtgagcagtcggggaacggatgaacaaagacttgcaccgtggccctgatgcctttgttccgagttctattcagttgtacttgtgcgttgttacaggactttagaatgcanccctgccccccaacccccacctcccagggccgacctgtgctcctaggaaggcaaacctcccaggaatatattctgcataactatacaaataggcctttattcaaggcttttggattatgacaaagattaccctcaggagtagtaagattctactagcaggataatagaaaggattaaggctcccctccaaagaaaat

SEQ ID NO: 1762 - DNA, 458 bp, Homo sapiens
  CDS 43..312
  sig_peptide 43..267: Von Heijne matrix score 4.59999990463257 seq VICLVGARISTSA/AS
agagcggtcggtgacagcctcaagggcttcagcaccgcgcccatggcagagcagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctcgaatctccacatccgcagcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctg

SEQ ID NO: 1763 - DNA, 420 bp, Homo sapiens
  CDS 131..346
  sig_peptide 131..220: Von Heijne matrix score 4.59999990463257 seq PSSFVGFPLGARS/QP
  misc_feature 47,61,355,379: n=a, g, c or t
cagcgagtgacaagatttcgtggcctgggggctgagctgtttcctbntggaaaggccgagnaggctccgccactctcctttggactggtcgcgctgaagctctatcctagggcactggtcgcaagagcagatggtgccgcacgctccgggcctacaaacttcagcggctgccgggcccgggccctcgtcttttgttgggtttcctcttggtgccaggtctcagcccctgcaaaagaaagctggctttggccgcgcgcagtggctcgcgcctgtdatcccagcatttgggaggccaaggcaggtggatcacgaggtcaggagatcaagactatcctggccaacatggtaaaacccnatctctactaccaatagaaaaatnggccgggcgtggtggcaggcgctgtagtctcagctactcag

SEQ ID NO: 1764 - DNA, 493 bp, Homo sapiens
  CDS 107..313
  sig_peptide 107..268: Von Heijne matrix score 4.59999990463257 seq VICLVGARISTSA/AS
agagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctcgaatctccacatccgcagcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgc

SEQ ID NO: 1765 - DNA, 544 bp, Homo sapiens
  CDS 17..244
  sig_peptide 17..133: Von Heijne matrix score 4.59999990463257 seq HAVLSSLTGPAST/IY
tcaaaagcaaacagtaatgttcaataacgtgggggagccctgsmrrrramykkysggggsmrkkkkrarrrrrrwwarkkscmamykrrkyctccatgcagtcctctcctctctaacaggcccagcaagtaccatctatagtcacaaaagtggagccccttggcctcactgctccaacagagaggccacagaggtgtccctcacagccctttggtggctgttagctcaatccactgcattaacgtgaacaaacgcaggctgtcgggtctaaaaatcagcttttaaaagcccccctagtactaatttccacaataaaacagaatggctccagagaagccattgagttctatcaggtacataacacacattttaaaaggtcccaaatatgtattttacacaatagaagaagagagcaggctgaggatacagtcttttgagtaaataaataacgagttgtataaagccactaattgccctttaagatggtttagtggccagggattcctgaggactaatacagactcgctgcctgatgtctggtaag

SEQ ID NO: 1766 - DNA, 468 bp, Homo sapiens
  CDS 43..312
  sig_peptide 43..267: Von Heijne matrix score 4.59999990463257 seq VICLVGARISTSA/AS
agagcggtcggtgacagcctcaagggcttcagcaccgcgcccatggcagagcagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctcgaatctccacatccgcagcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaagg

SEQ ID NO: 1767 - DNA, 495 bp, Homo sapiens
  CDS 107..313
  sig_peptide 107..268: Von Heijne matrix score 4.59999990463257 seq VICLVGARISTSA/AS
agagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctcgaatctccacatccgcagcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaagggggctactcctgcgctgctacacgca

SEQ ID NO: 1768 - DNA, 492 bp, Homo sapiens
  CDS 184..444
  sig_peptide 184..330: Von Heijne matrix score 4.59999990463257 seq LCPLGSSDSPASA/SQ
tattttctatagaggtgaggtcttgctatgttgcccaagctagtcttgtactcctggcctcaagtgatcctcccatcttggcctcccaaagtgctcagaatacaggcatgagacaccatgcccagccttgatggtattttaaaaataatttgaatagatatttctaacctaactttaaaagttatgatttatttgaggaaaaaaaatatatgtatatatatattttttagatggagtctcactctgtcacccaggctggaatgcagtagcatgatctcagctcactgcaacctctgtcccttgggttcaagtgattctcctgcctcagcctcccaagtagctgggattacaggtgcctgccaccatacctggctaatttttgtatttttagtagagacagggcttcaccatcttggccaggctggtcttgaactcctgacattgtgatccactcgcctcggcctcccaaagtgctgggattacaggtgtgag

SEQ ID NO: 1769 - DNA, 432 bp, Homo sapiens
  CDS 65..370
  sig_peptide 65..169: Von Heijne matrix score 4.59999990463257 seq PLCFTSLPLCLRC/GP
tcaagagggagggtagctcttccgccaccaggggcaagcacaggtcctggtggccccacgccacatgttagcccccctggaggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcgcaaaaraaaaaaaaaaaaa

SEQ ID NO: 1770 - DNA, 460 bp, Homo sapiens
  CDS 216..401
  sig_peptide 216..383: Von Heijne matrix score 4.59999990463257 seq LQMVSCTMRLSLG/AG
cacatagagttcctgaccagacaagacttgctggaaatttcccaggatcttccttccttaagatgtctctgtgttaggaaaacttggataagcaggtccatagaaattcctctgctagccctgtctcctggaatttctacataatggcatatcctcagtttgaatagctctctggttccagtttgaagctgaaaaggttaaattctacctgaaggatgaaaacaaccaacattctgtgccaagacagtcaggagggcaaccatgtttcctggtggagcctctggaaccactcaagccaagatgaccgggggtttggctgggaggagatggggaaactacagaccctacagatggtttcctgtaccatgaggttaagcctgggggcaggagaggctgtaccttagttccttcatctgtaaaataaagtaacatagtacctacctcaaaaaaaaaaaaaaaa

SEQ ID NO: 1771 - DNA, 664 bp, Homo sapiens
  CDS 244..465
  sig_peptide 244..306: Von Heijne matrix score 4.59999990463257 seq LLSLSIICYTALX/NS
ctttctcttggaccctttgctctggggaaaccagctgctacatcaccatcagccttgtgaccatgccacatggtaaggagctgaaatctcagcagccacatgagtgagctcggcagcggatcctttaggccccgtcatgcaatcctggattgcagccctggacatccacttaactagcaagactgagccagaaccacccagatgagctgctcctggattcccaactctcaaaaactgtgagagatgttcaacggtggttgtttgaaactgctgagtctcagtataatttgttacacagcactakctaactcatacacgtcacgtttctgcagcagaataccttggacctggggagagctggagataattactcagtaccacccagtacatgggaaagtgattactgacaggctcagaaatgttaagaagatgcttaaaagaaatgggctcatgagccttctttgctgaagtattaattactagatctgaatgttttgcttttctgtgatggaaaacgtgaagaaaatagggcttttttttttcttttgaagagatgggatttccctctgtcgcttaggcttaactgcagtgattcagtcatagctcacggcagcctcaaactcctggactcaagcaatgactgatatttttgagcacagcagta

SEQ ID NO: 1772 - DNA, 581 bp, Homo sapiens
  CDS 31..213
  sig_peptide 31..150: Von Heijne matrix score 4.59999990463257 seq SFFLSPFLPSAFP/PF
caaggtgtggaaagaaatctaaaggggaaaatgtcacgtaggcaagtgacacgtggatacagtcccttcttagttactgtaccatctttttgtttcctgttgatttttccgtctttttttctgtctccttttcttccttctgccttccctccctttttaatcccgtctttccatctatctctccttttgtatttcttctcctcattttctttttaatgtttccttcacttgggtactcttattttctttaggcaatactttgccatcacattcccccatgaccctggcatttttcattcattcattcaacaaatgtttgctgagcagcttctgtgtgttagatacttttcatcactagagaaatagaatgaactcagatagccaaggtcttctgctcatgtggagtttacaatccagtgtcaagaaatgagaagcaaagaagtaaacaaagaagatcattgcaggaagtgataagtgctgagaagaaaataaaatggagtgataagcaaaagacagtggccagtccggagtggttgagggtggctctcttaagtgctggcatttcagctgagcactaactg

SEQ ID NO: 1773 - DNA, 472 bp, Homo sapiens
  CDS 178..408
  sig_peptide 178..297: Von Heijne matrix score 4.59999990463257 seq PLQWSLLVAVVAG/SV
  misc_feature 440,450: n=a, g, c or t
aaccatggtgaacttgggtctgtcccgggtggacgacgccgtggctgccaacacccgccagtgcccagaggagggacaggagaggcggtgaaggaagagggcaggggatcgagccttcacccgcctctgccaccccagggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattnggggcaggangagtctggaacacagccttcat

SEQ ID NO: 1774 - DNA, 451 bp, Homo sapiens
  CDS 190..435
  sig_peptide 190..306: Von Heijne matrix score 4.59999990463257 seq QGLCPLLCLGSRG/AD
agacttcaggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctkggsctkgraggaaaktscggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagag

SEQ ID NO: 1775 - DNA, 556 bp, Homo sapiens
  CDS 5..328
  sig_peptide 5..217: Von Heijne matrix score 4.59999990463257 seq PLQWSLLVAVVAG/SV
aaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatggccccctgaccccaggccgaccctccccacaccctagggtacccagtcgtatcctctgtccgcatgtgtggccaggcctgacaaacacctgcagatggctgctgcccaacctgggacctgcccaggaggttggagcagaaagggctctccctggggtggtgtt

SEQ ID NO: 1776 - DNA, 513 bp, Homo sapiens
  CDS 5..328
  sig_peptide 5..217: Von Heijne matrix score 4.59999990463257 seq PLQWSLLVAVVAG/SV
aaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatctctgtccgcatgtgtggcaggcctgacaaaacacctgcagatggctgctgcccaacctggggacctg

SEQ ID NO: 1777 - DNA, 462 bp, Homo sapiens
  CDS 84..284
  sig_peptide 84..176: Von Heijne matrix score 4.59999990463257 seq FGLFLSTSPVTFP/SL
cttccttccaccctgtgcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggcttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatkgtgtgcatcagagcattgggttgggggcttccctgttccctcag

SEQ ID NO: 1778 - DNA, 460 bp, Homo sapiens
  CDS 30..410
  sig_peptide 30..149: Von Heijne matrix score 4.59999990463257 seq LFIVFSLVILIIL/CP
tgttgcctgaggacagcagtgcagttgacatggatattctctttcctctgcacagtgttattggtacagagctgtgccccagccccattccccagatcatccatttcgtcctcttcattgtgttcagcctggtgatcctgatcatcttatgcccctacattcccagggagccatcctcagtgcctcccagagaggaggacagcgagaatgatcaagctgaagtgggggaatggctcaggatcggaaataaatatatcactttgaaagggtctcacacccaggctggagtgcagtggcacatcacggctcattgtagccttgaactcctgggctcaaacgatcctcctgcgtcagtctcccgagtagctgggaccaacagtaaagacatctgcagctcttccctcctgagataagaaactggaacagccaccacctgctccctgatgttttcaccatctct

SEQ ID NO: 1779 - DNA, 477 bp, Homo sapiens
  CDS 5..328
  sig_peptide 5..217: Von Heijne matrix score 4.59999990463257 seq PLQWSLLVAVVAG/SV
aaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatkccccctgaccccaggccgaccctccccacaccctagggtacccagtcgtatcctctgtccgcatgtgtggccaggctgacaaca

SEQ ID NO: 1780 - DNA, 424 bp, Homo sapiens
  CDS 22..210
  sig_peptide 22..198: Von Heijne matrix score 4.59999990463257 seq LLSGSGASGLAAS/VS
attgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgartgtgtgtggtgtgtatgartrtgtgttccgcctcccascctctccccatctgctctgggk

SEQ ID NO: 1781 - DNA, 525 bp, Homo sapiens
  CDS 220..456
  sig_peptide 220..429: Von Heijne matrix score 4.59999990463257 seq YVAMLASSLPGRA/QW
gatgctgggagggggcgtaggtccaggtttcatacagctctttatggagatttggcccaggccaggcccaggcccaggcccaggcccagtcagtctggaactgagtcctgggcatggccggmggcaaggtgaaaagggctgggctcaggtgtgagatgagcgtaagagggaactgaagagggaagcttggacgcagacccaggctccctggagctggccatgactcaccctgagttctactggtatgtggatgaggdcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggcaagcagtctaccaggccgagcacagtggctaacacctgtaatcccactttaggaggccaaagtgggaggattgcttgaggccaggagttcaagaccagcctgggcaacataatgagac

SEQ ID NO: 1782 - DNA, 512 bp, Homo sapiens
  CDS 232..381
  sig_peptide 232..306: Von Heijne matrix score 4.59999990463257 seq ILLGLKGLAQLRS/LQ
attttcaggctgcactcagagaagctgcccttggctgctcgtagcgccgggccttctctcctcgtcatcatccagagcagccagtgtccgggaggcagaaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggcccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacgggggtgcagtgagccagcgctgttatattctctcccattggactgttggggtgctgataacctgagt

SEQ ID NO: 1783 - DNA, 714 bp, Homo sapiens
  CDS 87..311
  sig_peptide 87..131: Von Heijne matrix score 4.59999990463257 seq VLAGSLLGPTSRS/AA
  misc_feature 628: n=a, g, c or t
atttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaayatcaaacgcaagaacaagcacggctgggtccggcgcctgagcacgccggccggytgagagycatccttcgccgaatgctcaagggccgcaagtcgctgagccattgaggatcgcgacgcagtcggcggggaaccctcatggaagcatcgccctcgcctcggaccttgcctggcgctatttttgcagggagctmggggagcaggaacgcctcggacctgagtgctctccatattgtggggttgaagtctggatgggagcttgccaagtccctttttaggctttttaattaggaagcatttcgaacctgcgcaacagaccaaagwacagtacaaagracatccgtgtacccagtaccctgactaccgactacntacaaccyktccytgccccatcctgagtwcttktgaagctgatctcaggcaycggattattycttctgtaaatatttcagaatgta

SEQ ID NO: 1784 - DNA, 456 bp, Homo sapiens
  CDS 60..242
  sig_peptide 60..179: Von Heijne matrix score 4.59999990463257 seq IFKPLCSLPLLWT/RV
ttgtgtttttggtagagacgaggtttcgccatgttggccaggctggtcttgaactcctgatgtcaagtgatctgcccatcttggcttcccaaagtgctggaattggaagcatgaaccaccgcccccgcccctgtccgaacatttttaaaccactatgcagcttaccactcctgtggacaagagtgcctggtcctatgatttcagctggggtgctggccgtaatctctgggaatctgattagttagctagggccaggcctaatttattaatgaatgcattaataaattactgttctggccaggcacggtggctcacgcctgtaatcccagccctttgggaggccaaggggggcagatcatgaggtcaggagatcgagaccatcctggctaacacagtgaaatcccgtctctactaaaaatacaaaaaatttagccaggcgtggtgacggggtgcctg

SEQ ID NO: 1785 - DNA, 477 bp, Homo sapiens
  CDS 120..347
  sig_peptide 120..314: Von Heijne matrix score 4.59999990463257 seq WGLILQISFKVSG/SE
atctcctactgagctggaastctggtggataggggcaggtctgctcattcactgctgccttccctgcacctggtaccatgcacacagaataagcctagcagaatgcctgtggatgagtcatgaggaggcataggtggagttggaggtgggaggaggatgatgtagcaaaggtatttatatcagccagagtcccagcaggaagatggcatcttccacaagataagtgggccaagtttaaagatgagatgatctacacaggcaactctatagatcactggggactcatcctgcagatatcattcaaggtatccggttcagaatctatcaccagctcagactgtagcctctgaagagatctcagatgttttgtgccttatacatttaattctgagatcatagagcccaaggaggttttgaggaccctctacccacaccttcagatgttttcagaggatttgctggcagggctgggcaact

SEQ ID NO: 1786 - DNA, 622 bp, Homo sapiens
  CDS 20..247
  sig_peptide 20..154: Von Heijne matrix score 4.59999990463257 seq KTMFLFLVKEVEA/QT
agagttaggacttcaacatatgaatgaggactggggggtagcacaatgcaacccatgccacaggtgctttatccatgttagctcatttaatctacaaaacaattccataagaaagaagaccatgtttctcttcttagtgaaagaagtggaagctcaaactctaaagcgcacggccatggaaaaggacactagtaataagttacggaaactactcagtccagtatctgggcagaatcactattccatataagtttttccgggatgaaaaaaaggaaagaaaaataaaggctaccctgcaagagccccctttgttaacacacactgtttgcatcctggctcaagtgtgaatcctcctaccaagctgtaaatcttcactcctgcttttctacagaatccaagaacaactttgtttgcaaacttgctttggaaatgagagtgaggtaagttttccagtgtctgacagctaggaagtaccaggacgctgtatctcaaagactccaagttgagacctttcctgtgtgccacaatgccggaacaaactccctccccgagtacgagattccagaagcagaaccgtggacaatttttaaactcagaaagccaaaaaaaaaaaaaaatgcga

SEQ ID NO: 1787 - DNA, 308 bp, Homo sapiens
  CDS 17..178
  sig_peptide 17..133: Von Heijne matrix score 4.59999990463257 seq AHTSILLSFLVRA/GK
cttaggatctgtggccatgcaagcagaaaagttcccctctgaaccaaatcgtttactgctcttacatggtttcctggatgagaatgtccattttgcacataccagtatattactgagttttttagtgagggctggaaagcatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacac

SEQ ID NO: 1788 - DNA, 497 bp, Homo sapiens
  CDS 123..332
  sig_peptide 123..209: Von Heijne matrix score 4.59999990463257 seq SLMSLLDESSCQA/VG
agttgtgaaggcgccggggcctagcgctatgcctgcggcggagactgcatcaggctctcgtcctcgggctccacccggggaactgtgcccagacagcagaagggaaggatgtcacttctgagatgaggttcagaaaggcctgggctcctgtcctggctgctctctcccactccctgatgagcttgctggatgaaagctcctgtcaggctgtggggcgtcctgtggagaagctggcaagaaactggtgggggccctttccacctatacccagcaaggaactgaacccagccagcgtccacctgagtgagctcagaggtgggcctcagcccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtgcgtctgcttctacgctttgc

SEQ ID NO: 1789 - DNA, 462 bp, Homo sapiens
  CDS 148..333
  sig_peptide 148..219: Von Heijne matrix score 4.5 seq FLLLAGGVERXAG/RL
  misc_feature 51: n=a, g, c or t
ctctcttttctggagttagattagtctgaagccgccaccagccccaggccnccgtgcagaagaaaagcgggagggaacggcggaggccgccgctgccctgcaccgccctcctggaggccacttggagagtccggccccgaggaggccatggccacaagtgcccacagctggccccagggcttcctgttgctggcaggcggggtggagcggastgctgggaggctgctggataggagaggggtcacggctgcggaagaggaggttcttcgggacacccgtggatggacacggcaaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggc

SEQ ID NO: 1790 - DNA, 480 bp, Homo sapiens
  CDS 77..388
  sig_peptide 77..217: Von Heijne matrix score 4.5 seq FLYLTLNQSCIFA/NY
aacaccctccctggaccctctgcctggaggacggggaatcacagcagctggtttggggtgcctcccaaaccaaaagatgttctctccgcgccaagctttgacgcccgaccccctgcactctcccgcctactcaccggtcctagggggttggtcccgctttcgtagtgtggattttcgtttcctctacttgactctaaatcaatcctgtatattcgcaaactacaaagaggcgcatgcaaatagatactgtactgagggcagatacacgcgcgagatccagaggcttacatccccagccgcttggcccaccagagacaagaacaggatgataagcaatggaatggcattgaactctcctgctgaaggacttgcatttcaatgtagattctgaggctgggtgaaaacttctctgtcacctttactacagcattctcacccatttatatttctttssccttctacatctctattactgttgca

SEQ ID NO: 1791 - DNA, 549 bp, Homo sapiens
  CDS 34..315
  sig_peptide 34..276: Von Heijne matrix score 4.5 seq LTSCGTSVASSEG/SE
agagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaaaaaaaaaaaaaa

SEQ ID NO: 1792 - DNA, 558 bp, Homo sapiens
  CDS 95..349
  sig_peptide 95..265: Von Heijne matrix score 4.5 seq AYFLILLFLQLIP/QI
gagatggcagttgccggagttggaggccgggcggcgacggtgagcaagaggctcccaaaaaattccatggaatttatagttggtctactctgcaatgtctctatttaaaagcccaagtgaggacagacaagatgaacgtagaacaatgccatcaagacctcaaaataatagtgtctttaatttcctgcccctgaacctatttgaacagttccagagacttgcaaatgcatatttcctcattttgctatttttacagttgattccccagatctcctccttgacatggtatacaactataacacccctgatggtggtgctgtccattaacagctgtgaaagatgccatcgatgacctgaaaaggrcatcaaagtgacgatcgagtcaacaaccagcctgttctgctactggtgaatggcaagataaaggaggacaaatggatgaatgtttcaagttgggagatataataaaactagaaaataatcagcctgtcattggcagatatactattactctctagcagtgagccatatagtctgacatacatagagacagcagac

SEQ ID NO: 1793 - DNA, 498 bp, Homo sapiens
  CDS 29..259
  sig_peptide 29..202: Von Heijne matrix score 4.5 seq VLLWIASRQKSQS/SR
gacgcakagccgtggggaagttttcgcaatggccgccggaacgtcgccggccgatgctctctgcgacggaaagaaagccgccggacccacttccggtgcgttttacaatgaactccgggcactcgagtcgctccccggaaactatagttctgcttccaccgttgtcctactttggatagcatcaagacaaaaatctcagtcttcgaggaactcacagtgtagcagaaaagacaaaggaggtaaacaggaggagcatgaataattcatcttgatgtaatcatgcaagactcctaagaagatgttaggagaccctgtcatcattcttttggcctctagtgtcctttatcttcatgtttgctggcttccttttactactatggaaatacaacatatgcaaaagtagtgttttcgctgtttaaaaacatcgtcagcagcatcatcatcattaactgcaccaggaagccatgactcctttctgggacaaggtgcacttgcctg

SEQ ID NO: 1794 - DNA, 477 bp, Homo sapiens
  CDS 238..462
  sig_peptide 238..441: Von Heijne matrix score 4.5 seq FTLTVTSLHLVFQ/MG
tgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcktcgccctttacgtggacaataggttttttactttgacggtgacaagtctccacctggtgttccagatgggagtcatattcccacaataagcagcccttagt

SEQ ID NO: 1795 - DNA, 513 bp, Homo sapiens
  CDS 5..409
  sig_peptide 5..181: Von Heijne matrix score 4.5 seq LSALSALVGFILL/SV
aataatgctcccatcaaatgtcatcaacttctcccaagcagagaaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttt

SEQ ID NO: 1796 - DNA, 554 bp, Homo sapiens
  CDS 186..398
  sig_peptide 186..383: Von Heijne matrix score 4.5 seq IVFIIILFIVLFA/TG
aaaagttggagcaagcaggaagtgaactgagggccaccctgggaggaagccgactaggcgaattcacttactgaccggcctgggctgctctgagacatgggaggaagccagtgaaggtggaggaaatgatcgtgtgcggaacctgcaaagtgaggtggagggagttaagaatattatgacccagaatgtggagcggatcctggcccgggggggaaaacttggaacatctccgcaacaagacagaggatctggaagccacatctgagcacttcaagacgacatcgcagaaggtggctcggaaattctggtggaagaacgtgaagatgattgtccttatctgcgtgattgtttttatcatcatcctcttcattgtgctctttgccactggtgccttctcttaagtaacagggaacctctcccacctgcccttcttttcagggacaaccctccataaatgtgtgccaagagggtctcctttcctgtcttcctctacagagaatgctgctcggtcctcctacccctcttcccgaggccctgctgccacgttgtatgcc

SEQ ID NO: 1797 - DNA, 497 bp, Homo sapiens
  CDS 269..439
  sig_peptide 269..400: Von Heijne matrix score 4.5 seq QLLMMLQSFLCQS/HR
agatttagatatatcactaaaaccagcacccaagtgatgtgactcttcaccagagtcctgcccacaaggaggattgtgacatttcactggaccagcacccactcaggaatcaaatccgagttcgtctacagctgattcggcaggtaccwkggcgtccgcgatggtggtattgctccatatgcctgagaccctaacaaaagcctaattacaactcatatgcctggagccaggacatgtgcaggatggtgatgtaactttcctctctggaatgggtcctgcacaaaggaatgatagtaacatattgcaaagccagacacacagagtcctgaaaaaagagggaattattgcatactggtgggcccagctgctgatgatgctacagtccttcctgtgccagagccacagacagtattttgacataatttcggcccatttgccatgatggtccaagttatattgggattcagccaatagaagatattttgcctgtcatccct

SEQ ID NO: 1798 - DNA, 513 bp, Homo sapiens
  CDS 280..474
  sig_peptide 280..387: Von Heijne matrix score 4.5 seq LIQVSFASLKCWG/WG
caattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccgsttctgttttgtcgattgcttagatttgttcctgttgtcaaaactgttacccccaaaattggtgtgacacatgctcatgcataaaatgttaaaatgagtacat

SEQ ID NO: 1799 - DNA, 503 bp, Homo sapiens
  CDS 214..378
  sig_peptide 214..273: Von Heijne matrix score 4.5 seq ILFSFFVFHPCLS/PH
ttactcctacagggaatggcctcagctcccttctcttttagaattaaacaagtaaaaactaagagttaactttttaaaaaaactgactccagggaaaggacattattatattaccaatagctgatttttttttccattctgggacctaaaatgcttacaggtactagcagtacatgtcggatagcaaagacttttcctttcagacccaactaaatgatctcctttctgcctttgatactcttttccttctttgtctttcatccttgcctgtcacctcacagatggattcttcctcatttctcttgcctcacttgcccaggtttattgactagcgtcagtttaaggagctggacttcctgggacctccttggcatcttgtagggtgattggagtggcctgagtactcagctcttcagaggtcaggtgacccactttctttggttaatgaaatgttactgtctccaggttagtagctgtcatgaacaggaaaggtggcaaaatgg

SEQ ID NO: 1800 - DNA, 489 bp, Homo sapiens
  CDS 42..320
  sig_peptide 42..203: Von Heijne matrix score 4.5 seq WCPLTTCCLSLHG/EP
attagagagagagaggcagggcgctgcgcacctcgccgggcatgcggggcgttgtagtctcttavsgactcccggctctttggkcgcctggctgcaggactacaattccagcaggcaccgggctcagtgggagaggcagggtsdgtgtggacctggcaaagcagtggtgcccgctcaccacctgctgcctttctctccatggggaacctgactggccaggtgtctcaaagacgtggatggtgaccagctctctccaggaacagatggcgctccagctttgtgggagaaactttcaaggtgtggatcacttggaagtcatttgaaacctatgaagtttaacatctctgctttgggatggaatgctcatcacctacagcagtcagggatgtaactaaacttgckgggactgatgcgttgaaattttttgtctagatagtggaaacatccaggagcacttctgcttccatgtagctcttaataattgatgtc

SEQ ID NO: 1801 - DNA, 465 bp, Homo sapiens
  CDS 182..451
  sig_peptide 182..247: Von Heijne matrix score 4.5 seq SLLALLFILASWI/IF
agaaggttgtgaatccatgctaaaggtaaacaaactgcaacttatatctgcaatttattttggtatagacaagaggtatgmcagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagtcccacccagacctttcacccacgtgaacacccaccac

SEQ ID NO: 1802 - DNA, 509 bp, Homo sapiens
  CDS 142..384
  sig_peptide 142..213: Von Heijne matrix score 4.5 seq SLLWLQLLDGALI/KI
cagcttaggatttcagaagatgcttttcttgggaagtaaacataacggattgcttatatattactcttttaggttatttgtcaaagaacacatttgccttggaaggatgtttgttacagcatcttttcttctttctttgacatgttgcctctcttgagtcatttcttcacaaaaagtctcttgtggttgcaactgttagatggagctttgataaaaattggtctcagaatcatctggaatatttatattgtcaagttttttcatataaattattttatggccttaagagtgtttttttctcaaagatactaccctggcagggggtcagtttacagttcaaaactttgtttgcagttgagcttaattgatttaaaaatgtgcttctagccaggtacagtggcatgtacctgtggtcctagctgctcaggaggctgagtgggaggatcgcttgagcccaggagttcaagactagcctagtgagatcctttttcttaaaaacataaggcttg

SEQ ID NO: 1803 - DNA, 642 bp, Homo sapiens
  CDS 1..453
  sig_peptide 1..174: Von Heijne matrix score 4.5 seq VGWPLLRPPXAXA/ET
  misc_feature 29: n=a, g, c or t
atgatgagcagccagttcacccaatgganctgcctactgcagcgtaggcctcgcctcaacggcaggagagcaggcggctgcggtttgctgcagccttcagtctccacccggactacgccatgttggggtttgtgggtcgggtggccgctgctccggcctccggsmgccyttgcggagactcaccccttcagcgktcgctgcccccagctcagctcttactgcgggccgcycccgacggcggtccatcctgtcagggactatmgcggcgcaaagcatctccttcagccaaaagcaggcgccgccaccgggcgcattcgtggcggtcattggcgcagtggtggtacgtccasmtttgatgaggggactaccaccaattctaaatgccctggaagtgcaaggcagggagaccagactggttttggaggtggcccagcatttggggtgagagcacagtaaggactattgctatggatggtacagaaggcttggttagaggccaggaaagtactggattctggtgcaccaatcaaaattcctgtttggtcctggagacttttgggcagaaatcatgaatgtcattggagaacctattgatgaaagaggtcccatcaaaaccaaacaatttgctcccattcatgctga

SEQ ID NO: 1804 - DNA, 463 bp, Homo sapiens
  CDS 30..218
  sig_peptide 30..212: Von Heijne matrix score 4.5 seq LIFLCVFSRDGVS/SC
  misc_feature 282: n=a, g, c or t
gacaaaaggattttctttgtttttttgagatggagttcgctctgtcggccaggctggagtgtaatggttcgatcttggctcactgcaagctccgcctcccgggttcacgccattcttctgctgcctcagcctcccgagtagctggaactacgggcgccmaacaccacgcccggctaatttttttgtgtgtttttagcagagatggagtttcatcatgttagccaggatggtctcaatctcctgacctcgtgatccccctgcctcggcctcccaaagtgctgngattacaggtgtgagccactgcacccggctgacaaaaggattttctgccacttttcatgaaaaatccacctagcaagaaggctttccttatgaagacaatcagggccgggcgctgtggcttatgcctgtaatcccagaattttgggaggccaargcaggaggatcacttgaggccaggagt

SEQ ID NO: 1805 - DNA, 477 bp, Homo sapiens
  CDS 90..371
  sig_peptide 90..317: Von Heijne matrix score 4.5 seq LXRVLALITXVDS/RE
acacttacagaggaactgacacggaggcctgcacttgggagctgacgacagctgtggcccgggggagcgaatcacggaagccttcctgaatgaggaaacctttgaacaagggaaagagagagctgcagactagtccagatgcatttccaagcagactgttgtcaaaggaaaaaaaaaaaaaggtggsagcgtgtsagttctggcagaaatastggrgaccacagatgcattttcccgcttgcccccgctgttctctctgtctccctccctctggcctccttsawagggtcttggctttgataacwycagttgactccagagagagggcaggcagctcagagtcggtggacatcaaggaaagasccggaggataactttaraaaatggtgcccattctsgaatagtmccaagtccttcasytcctaagaacaaactgcgccgacactgatctagacttttagcagttttttaaaagca

SEQ ID NO: 1806 - DNA, 510 bp, Homo sapiens
  CDS 207..419
  sig_peptide 207..278: Von Heijne matrix score 4.5 seq PLPHLSLAAASQT/QR
cttcctttcgctcttcccgctgctccgcccctctctgtcttctctgcagtgggagcagstytycttgcccacagctcctcaccccctgaaaatgttcgcctgsyccvaakttggtctccactccctccttggtcaagagcacctcacagctgctgagccggtccgctatctgcagtggtgctgaaaacgaccggagatactgacagatgagagcctcagcagcttggcagtctcatgtccccttacctcacttgtctctagccgcagcttcccaaacccagcgccatttcaagggacatcgacacagcagccaagttcattggagctggggctgccacagttggggtggctggttctggggctgggattggaactgtgtttgggagcctcatcattggttatgcccaggaacccttctctgaagcaacagctcttctccctacgccattctgggctttgccctctcggaggccatggggctcttttgtctggatggtagccttttctcat

SEQ ID NO: 1807 - DNA, 485 bp, Homo sapiens
  CDS 186..449
  sig_peptide 186..344: Von Heijne matrix score 4.5 seq LILSTVELGAIRS/KR
taatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgctgtaatcccagcactttgagaggctgaggcagggcagattgcatgagcccaggagttcga

SEQ ID NO: 1808 - DNA, 526 bp, Homo sapiens
  CDS 123..284
  sig_peptide 123..272: Von Heijne matrix score 4.5 seq WLLAASRGSSTNA/SR
ctttttcctgattggccgtgttgtacggcggcttctcgcgcastgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcasccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcactccaagcgccccacctgtgtgataatggtcaagccccatgagggagtacc

SEQ ID NO: 1809 - DNA, 483 bp, Homo sapiens
  CDS 6..212
  sig_peptide 6..164: Von Heijne matrix score 4.5 seq LVISMQLLPVSVS/LS
agttgatgcactgcgacttaaactgtggctgcgttgagaaactgacatcaaggaacaactatcatccacacagaatcgacctttgcatgcaatsaattttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccctaaaaaagccaatgtggattgtaaaagtctttaagtatactaacatttcacacaaaacctgccctagttttctgaagtgggtgagggagacgcttcagttttagg

SEQ ID NO: 1810 - DNA, 519 bp, Homo sapiens
  CDS 167..508
  sig_peptide 167..403: Von Heijne matrix score 4.5 seq RWAMLGALGCTFP/EI
aactcacactctctcttatctcctttcctttcattgtagttaacgaaaagattacgataatgggaacatcagctatccagcaatcctccttcgccggccaaacggctctcaagccctccaacgaactcctccgcaagttggtgtctccggtggtggccgtgtgaccatgcgtcgtaccgtcaagtctactcctcaaagcatttggtacggaccagaccgtcccaagtacttgggaccattctcggagaacacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggctctcagattttctcagaaggaggtcttgattacctcggaaacctaacttgatcacgcgc

SEQ ID NO: 1811 - DNA, 544 bp, Homo sapiens
  CDS 132..419
  sig_peptide 132..299: Von Heijne matrix score 4.5 seq GLALLSRLECSGA/II
agttataggcactgctgggaacctgaccaatagcagaaccagccctcaaaccccaagccagacttcaagtttctaaatcaccatatctttactgtagaaacactgttaagcctgcagtgactgccctggccatgagaatgcctctttctttgcgaaacttgaagggtattccctacactggaggggaaaacccagcagtggtcaacacgattaacaaacctttcaagtctctttggatttttgtttgtgttttgaaacagggccttgctctgttgtccaggctggaatgcagtggtgcaatcatagctcattgcaacctcagcctcctgggctcaagcaatcctatcgcctcagcctctcaagtagctgggactacaggaacttccccatgcccaaggctttggttaatgcctctatgctgatgtctcatttatgtatctcctccagacaccaagcctgtctttcagcagtctacttgagatttccttttgaatacctcaaaggtgcaactcaacatgtctaaagtaagaactcatattgactc

SEQ ID NO: 1812 - DNA, 490 bp, Homo sapiens
  CDS 122..382
  sig_peptide 122..190: Von Heijne matrix score 4.40000009536743 seq LELLTSGDPPASA/SQ
cggctcactgcagcctcttcctcccagtctcaagtgattctcctgtctcagcctcctgagtggctgggattacaggtgtgcaccactaccacttggctaatttttatacttttaagtagagatggggtttcaccatgttggccaggctggccttgaactcctgacctcaggtgatccgcccgcctcggcctcccaaagtgctggggttacaggcatgagccaccgcacccggcccccttccttcgtcttagtcaatcctatcccacctcttcttccaccagtcccctcacctgatggtcccaacacttcatcatccaccacctyctggagggggtaccccgaggtgctccgctggggactctgctcattctgggggtgcarttgacggctggtcgtgatctttcccgtaatctgtcccctcttacggaacctagtctccgttctgtccatggccttcttctggacactgctaggatccagaagagtatgt

SEQ ID NO: 1813 - DNA, 464 bp, Homo sapiens
  CDS 87..245
  sig_peptide 87..215: Von Heijne matrix score 4.40000009536743 seq VIVLGVFVFYSFT/ST
ctaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtgattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctatataaagattatatagttgcaagc

SEQ ID NO: 1814 - DNA, 712 bp, Homo sapiens
  CDS 183..443
  sig_peptide 183..395: Von Heijne matrix score 4.40000009536743 seq GSYLLVFTSYVIS/SP
agaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaagaaaaagcacaagaaagatggacacatggcagagtcttaaagtcaaagaagtattctgtaagcataattcttcctatgaatgccttctctataaagaggttgaagcaagacaggtttctaagacagccaccgatgggtcctacctcctcgtattcacatcctatgtaatctcctccccagtgtggactggacctggtgacttgcttccagtgaatagaatatagcaaaagtgattgatgtcacctccaagattcagctatagaagactatgactatgactttcctcttggctagcattctcgctaacccttcctgcttgcttgtactgagctgccctatgaagaggcccatgtagggtggcctgggtgggggtgatctgtggccaacagccagcaaggaactaaatcctgtttacaaccacatgagcttggaaggagatccttccccagtaaagccaggagatgaatacaaaaaaaaaaaaaaatgcgaa

SEQ ID NO: 1815 - DNA, 516 bp, Homo sapiens
  CDS 14..460
  sig_peptide 14..418: Von Heijne matrix score 4.40000009536743 seq VLLSLMLSSQTKD/QV
  misc_feature 450: n=a, g, c or t
gcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcgaaagcacagagactgcgtgtggcctatgagggctcggacagtgagaaaggtgagggggctgagccctcaaggtgccagtctgggagccccaggactggcagcacagctggtcaacatccgtgccatgaggaacaaaaaggatgcacctgtggrccatctggggactgagcactgctatgactccagtgcccccccaaaggtacgcaggtaccaggtgctgctgtcactgatgctctccagccaaaccaaagaccaggtgacggcgggcgcatgcagcgactgcgngcgcggggcctgacggtggacagcatcctgcagacagatgatgccacgctgggcaagctcatctac

SEQ ID NO: 1816 - DNA, 475 bp, Homo sapiens
  CDS 28..282
  sig_peptide 28..267: Von Heijne matrix score 4.40000009536743 seq TGILSIFCAQAGA/RR
  misc_feature 416: n=a, g, c or t
aaggaggggagggaactgaagaggaagatggcgcggasggaaggcggccctggagcgaccccggagactaagcgggaacgggaccagctgtactacgagtgctactcggacgtttcggtccacgaggagatgatcgcggaccgcgtccgaccggatgcctaccgcctgggtatccttcggaactgggcagcactgcgaggcaagacggtactggacgtgggcgcgggcaccggcattctgagcatcttctgtgcccaggccggggcccggcgcgtgtacssgtagaggccagcgccatctggcaacaggcccgggaggtggtgcggttcaacgggctggaggaccgggtgcacgtcctgccgggaccagtggagactgtagagttgccggaacaggtggatgccatcgtgagcgantggatgggctacggactcctgcacgagtccatgctgagctccgtcctccacgcgcgaac

SEQ ID NO: 1817 - DNA, 534 bp, Homo sapiens
  CDS 106..441
  sig_peptide 106..423: Von Heijne matrix score 4.40000009536743 seq GILILLPHAGADG/CW
agactcggcgggcgctgttgagggagtcgggccgcgactgtggtcgtttttataccttcccgcgcggacgccggcgctgccaacggaagggcgggctctgctgccatgaaggtgaagattaagtgctggaacggcgtcgccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccagaatggaagttcaaggagtgaggcccgacctggctctcgctggaggggcatcctgatactccttcctcatgctggcgccgatggctgctggggacagcgcccctgagctgcaacaaggtggaaacaagggctggagctgcgtttgttttgccatcactatgttgacacttttatccaataagtgaaaactcattaa

SEQ ID NO: 1818 - DNA, 519 bp, Homo sapiens
  CDS 62..220
  sig_peptide 62..121: Von Heijne matrix score 4.40000009536743 seq TFFLISLTSETIA/DL
taaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttcyctaatttttaaaccctttcctcctcccattttgacatttgcacttggagaacacttgagttgtraaggttttgggcatccaccccagaaagtgggaatttgattttatccttccgaactggaagaacatttttatgaagaatttttgtctaggrgaatataacagtgtt

SEQ ID NO: 1819 - DNA, 495 bp, Homo sapiens
  CDS 21..335
  sig_peptide 21..191: Von Heijne matrix score 4.40000009536743 seq STLCWTAPLSTCG/EP
gagccacacggcgcgacaagatggcggataaggagaagaagaaaaaggagagcatcttggacttgtccaagtacatcgacaagatcgatccgggtaaagttccagggaggccgcgaascagrtggaatcctgaargggcttcgacccactcctcaaccttgtgctggacggcaccattgagtacatgcggagaaccccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcgggggggtgcagggcaggcccgagcagctcggttttcccgcggacttggctgctgctccaaccgcagtaccgcctcctggaacggaagcattttcctttttgtataggttgaatttttgttttcttaataaattgcaaaccg

SEQ ID NO: 1820 - DNA, 580 bp, Homo sapiens
  CDS 259..546
  sig_peptide 259..339: Von Heijne matrix score 4.40000009536743 seq LCSGLGSVFLSDT/SR
attcgtacaaagaaaacaacctggaatggcagtgtttggatttcttgtgtgcttatttcttcataggattgagaaagggtgaggctaaagtcccaggccctcgtgaagcaatgaagaaagtgccttcccaaggttcaggcccacacggcgctgtgaggctgaaggggcgcgctagaacttcctttcacaggatgccacctcacctgaaaccctccttttcggctgccacccgagggacaagatctcctgagtctgtccatgagttaccccgaggaaaaccctcaggcagcccctgagggactctgttctggacttggaagtgtttttctcagtgacacctctagagggcagcactcaacggatcccacagacacctcccagcatttcctgctcaaacactggaaggatgacctgcttgctgcaacctccctgccttggggtcctgtgattctcctgccttggtctgccgagtgcctgggattgcaggcgcgcaccgccacgcctgactggtttttgtatttttggtggagacggggtttttcgtgttgactgggctggtctcagctcttgaccttgagtg

SEQ ID NO: 1821 - DNA, 493 bp, Homo sapiens
  CDS 129..323
  sig_peptide 129..230: Von Heijne matrix score 4.40000009536743 seq ITLLCCCFYLSHL/RL
ttagaaaactgattttatggagtatttctcaggtgaaaccatgtattattggtaaaattatatacatatgagagactgatttttttttcatgttttatttttagtaagaaaggaggcaaaagttcagtatgccacttagactaaatgtttctaggatccaaaataacattgatgttagtccctttactgtgatcaccttactctgctgctgcttctacttgtcacatctgagactgtttcttaaaatagagctccccagcagcaatttttcattatatggcctcatcgtgcatgtatttggtatgaactctgataagagattatgatgttgatatcataagaatttccctcttttacagaacatgaaaaaatgcatgcatttaggttaagcattgactatatattggaaatgtagttaaaaaaaactgtacaggtccagcacggtggctcacgcctgtggtccctgcactttgggaggccagggcaggtgggt

SEQ ID NO: 1822 - DNA, 579 bp, Homo sapiens
  CDS 243..479
  sig_peptide 243..443: Von Heijne matrix score 4.40000009536743 seq LISLVASLFMGFG/VL
tcctgtcgacgtgttcttccggtggcggagggcggattagccttcgcggggcaaaatggagctcgaggccatgagcagatataccagcccagtgaacccasctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaagattgccgtgggctgggctctctgcactccacagtccaccccttcgctttgccttaactgctgtgcccagttacgaggtcacctctaccaagtacactcgtgatatctataaagagctcctcatctcattagtggcctcactcttcatgggctttggagtcctcttcctgctgctctgggttggcatctacgtgtgagcacccaagggtaacaaccagatggcttcactgaaacctgcttttgtaattacttttttttactgttgctggaagtgtccacctgctgctcataata

SEQ ID NO: 1823 - DNA, 494 bp, Homo sapiens
  CDS 50..202
  sig_peptide 50..133: Von Heijne matrix score 4.40000009536743 seq LRLFLKLRGTSSG/QS
atttctttgcaaagctctctcctaacttcctccgtaaattccagccagcatggscacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtg

SEQ ID NO: 1824 - DNA, 482 bp, Homo sapiens
  CDS 154..351
  sig_peptide 154..288: Von Heijne matrix score 4.40000009536743 seq LLLLILQASDVPP/GC
gataagacgggtgttaggagttgactagctttgcttatgctctcaagttgatccatacagtgccagattataccctatcataagagatagggtcccctgaacacaagaagtcatctccccttctgggactgtgaactcaagaaagcaggaagtatgcctcccttattcatcactgggtccccagtgcttagaacagtgcctggcacagagacggggctctgtaaagatctgctgaatgaacrctttatcctcttacttcttatccttcaagcctcagatgttcccccaggatgccttcttcgtttccccagactggttcaagctgcacctccgacgtgctcccacagcccctgagctgcctccctgcagacgccatacctgccgtggctgcttgtttgctgagtagcctctcccactgraccctgggcaacttgaggtcagggaccatgctgtttactgttacagtgaattaaaacgtctaa

SEQ ID NO: 1825 - DNA, 292 bp, Homo sapiens
  CDS 56..274
  sig_peptide 56..154: Von Heijne matrix score 4.40000009536743 seq LAQFLFSLHSGMG/XQ
ttagactgtgttatgacttggttcagccagttttctatcttattttatattaaatatgtctgtgttctctgagtcagcacatttatttccttattacatgttccagacaggagtgctagcccagtttttgttcagtttgcacagtgggatggggraacaagtctggaatttaaaaaaaaatgttttagaggttggagccttgattttagtctctatattagcacatccatcacaaagaaccattagtaaattcatgaatcttttgttttttatgtagttcatttgagaagaa

SEQ ID NO: 1826 - DNA, 551 bp, Homo sapiens
  CDS 161..334
  sig_peptide 161..214: Von Heijne matrix score 4.40000009536743 seq PLIYFLFLPLGAC/FP
aataaaacagtggcctagtcccagcactgctcggaagccgggctcagctgagccccctgctcacatctacgctgccagcctgtcccggggaaacattttggtgagttgcgcttggccacgtgtgcagcctgtcactctgcctctctttcctctgggtcagatggtaaggccttaccccctgatctacttcctcttcctgccgctgggcgcctgcttccctctactggacagaagagagcccacagacgccatgggtggcctcggagctggagaacgctgggccgacctggccatggggcccgaccccactccgtgtggggttcctctcggtggctgagagcttcacagccacaggccctgcttgtcatagccagggggctgcagacatcgggcagagagcatgctggctgcagattccgcttcgggaggcaggacgaaggcagtgaggccaccggcttcctccctgctgcgggggagaagaccagcggcccgttagraacctggctgaggagctcaatggctacagcaggaagaaaggcggcttcagcttc

SEQ ID NO: 1827 - DNA, 547 bp, Homo sapiens
  CDS 153..431
  sig_peptide 153..278: Von Heijne matrix score 4.40000009536743 seq VLFFTGWWIIIDA/AV
gagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtaaataggtgcaaacagcatcttattatacatgcttaaatccttaagatgagaatttcacatggaaataccacttttctatttgttttaatatatctgttgagtaacagcttattatttt

SEQ ID NO: 1828 - DNA, 642 bp, Homo sapiens
  CDS 23..382
  sig_peptide 23..175: Von Heijne matrix score 4.40000009536743 seq QHLLILLVLGASL/LT
  misc_feature 584: n=a, g, c or t
cccggccttgcgtcgtaagakaatgccaagcccggggagaaggcgttccgggcctcaactttggcgtcgtgagattcttatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttkccaggaaaccatactaataattaaagcagggactgagacagccattttggccacgaagggctgcatcccggaagggakgaggccataacaattgtccagcactcttcacctcccggcctgatcgtgacctcctacagtaactactgtgaggattccttctgtaatgacaaagacagcctgtctcagttttgggagtcagtgagacacagcttccactgtgtcacaacctccattgtcmasctgtgtggctttggggactgtttcagtgctccttctctccctgtccnaatggtacactcgatgctatcaggaaactgagatcactggagtgcatgatcgtctgtg

SEQ ID NO: 1829 - DNA, 352 bp, Homo sapiens
  CDS 5..175
  sig_peptide 5..64: Von Heijne matrix score 4.40000009536743 seq AVVSCLRPXPARS/RR
agcgatgtccggggccggcctagccgcggtggtgagctgcctgcgcccgcrcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagcctgagttgcttcccctgcctttcttggccacctcaatagcagaagtactctgcctgactgcatactttggcagactggtacattttgcaaaagtcactcctca

SEQ ID NO: 1830 - DNA, 462 bp, Homo sapiens
  CDS 147..374
  sig_peptide 147..242: Von Heijne matrix score 4.30000019073486 seq RLDQLLSLSMVWA/NH
tatccggtcctcggctgcggcgggcaccatggtcggtggcgaggcggctgcgcagtggaggagctggtttcgggggtgcggcaggcggccgacttcgcggacagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaargtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctct

SEQ ID NO: 1831 - DNA, 476 bp, Homo sapiens
  CDS 73..378
  sig_peptide 73..246: Von Heijne matrix score 4.30000019073486 seq LTALIVMTALSAS/LG
  misc_feature 118,399: n=a, g, c or t
gctctaccagtctacctctaccccgcgccccctccgagatcggaatcgcggcgccccgccgcctcctccgccatggcgccgtctctgctcgggggcttcaccaagtcgctggccatgnctgtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcacgtaaatggactcatsatgtgaccactctattgttctttgtatttggtatttggtcattgtgggaaggcttcaaggaagatggagattcagaagaattgggctgaagttgaagcagagctggnatgctgtctttaagagtaataaaggccgaatctaaaactaaaactaaggcattttctattacattcttttggtgagt

SEQ ID NO: 1832 - DNA, 465 bp, Homo sapiens
  CDS 70..366
  sig_peptide 70..312: Von Heijne matrix score 4.30000019073486 seq MGLFLSIPSCSTG/LQ
atattgcctgtgcttttagggttacatccaaaataatcattgtctaggccaacgctgtgtagcgtctccatgtttacttttagttgttttatagtttcaggtcttatattgaagtctttaatccattttgagccggtttttgtttatgatataaggatccactttcattcttctgcctgtgaatatccagttttcctgacaccatttatttactgtccttgccctattgtatgttcttggcacctttgtggaaaatcatttgaccataaatgcatgggtttatttctgagcattccatcctgttccactggtctacagttcggtttttatgccagaacatgctgttttgattataatagctttatgtaataacatattttgaaatcagggagtgcgatgcatccagctttgttcttttggcctgattgttttggcaatttgaggtcttttgtcattgcatataaa

SEQ ID NO: 1833 - DNA, 517 bp, Homo sapiens
  CDS 109..450
  sig_peptide 109..366: Von Heijne matrix score 4.30000019073486 seq LPVVVAFSRAADC/AV
gttttgccaacgtactcgcaatagttcccatggtttcctttgctcccagcggttgcgcgggctgggtttttggagcaaaggcaacggatactgctgaggctcctgagaatgtcccgttttcgaggctgcagtagctccggtgtccggttctgcagtgccgagagggaggcctcgggctccgggcgggggaatgtgttgcagtttgtccaagagccccaagcccagcaaagccgcccgttccccgctgggcgcaactctcactggaactcttgttctctgactggggaatggaatgggctcagcaaggctccaaaaccagccccgccgctcccagttgtggtcgcattctcaagagcggctgactgcgccgtggaccatcactttcgcttctgcctgctcttgcgcctattgcggcaactactcacgctctacgggacgaggagagggaggtgaatccgtggcagagaaaaatagtagtctagtcattcaagtgaaaggtcaaaaaaaaaaaaaaaaa

SEQ ID NO: 1834 - DNA, 454 bp, Homo sapiens
  CDS 56..229
  sig_peptide 56..115: Von Heijne matrix score 4.30000019073486 seq LGFYSACVATSSS/QV
taaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaa

SEQ ID NO: 1835 - DNA, 615 bp, Homo sapiens
  CDS 173..511
  sig_peptide 173..409: Von Heijne matrix score 4.30000019073486 seq YDSLLALSPDLQA/AR
actggatactatctggccagaagtagcaaagcagctcttatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatsaccaggtgcacgggggacaatgagaaggtgaaggctcacattctgctgacggctggaatcatcttcatcatcgcgggcatggtggtgctcatcctgtgagctgggttgcaatgcatcatcagagattctata

SEQ ID NO: 1836 - DNA, 458 bp, Homo sapiens
  CDS 123..359
  sig_peptide 123..179: Von Heijne matrix score 4.30000019073486 seq IAFILNASLMVQG/EQ
actttagcctgggcttgagcgcgcgcagaagtcagcttcgtgacttccttctcaggatggaaccagcttggtggcttgagggaaaggggttctgagttgcaaatcagaaacttgaagatgaaatggctactacgctgggtattgcctttatcttgaatgccagcctgatggtccaaggtgaacaagccttcctgtgttttctgaatgttcccccgcactttgcctgccaccatgtaagatgtgtctttgcgcctcctttgccttccaccatgattgtgcggcctccccagccatgtggaacggtgtctggggtctgtcaggatcaacaggccttgagagagactgacccagaggactactaaaagggacacytgcccaggccagcctattctaccatcctcgttctcctgcaaaaccaaggccacgtcatttcagcagaggacctgcgtgtggaagga

SEQ ID NO: 1837 - DNA, 486 bp, Homo sapiens
  CDS 79..435
  sig_peptide 79..189: Von Heijne matrix score 4.30000019073486 seq LWEKLTLLSPGIA/VT
gatttggatatccctagaacgttgagggcacgagtcgggtcctgagacaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaaggtagatcacagaaggccgctgaggggagaggccccgcccaagggttccacagcctccagagatttctcccaagtgtgaatgggatcagccgaagtgcattatttttctggcttgggcaccctctac

SEQ ID NO: 1838 - DNA, 470 bp, Homo sapiens
  CDS 92..298
  sig_peptide 92..208: Von Heijne matrix score 4.30000019073486 seq AFIPLCSLSPAQL/GT
ttttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaa

SEQ ID NO: 1839 - DNA, 564 bp, Homo sapiens
  CDS 359..547
  sig_peptide 359..535: Von Heijne matrix score 4.30000019073486 seq VLWSLTSVVFLNA/SG
acgcccgtcgccctgagtacgttagcggaaatggctccgagaggctttgacgcatgtgtacctttttagtggcggtatctcggccggggattttcgggctccagtggaggtggctatgctcaccccatctcccttgagaggcacagaaggttagagatgtgtgcgaggaacggccaggtccagcgtctcctcgttgctgccccttgagcccgggaccggcgccaatgcgcgcccgggttcttgggttctttcgtcccgcagacctgccttggtgtggcgtccctgggccgtagcttccgaagctgcagctgacctggtcggggtcctctagcccgccttacccttcccccattgacagatggagaaactgaggcccaggccaaaaaatatctcactagagggctcaccgccatttcctggaaaaattggggctgggactcaacggacgctcgtccagcagcagcgcgtagtccgaagtaaaggcgcccgtgaccgagtgctttggtcccttacaagcgtggtgttcttgaatgcttcaggcgccttatgaggccccgatgtaca

SEQ ID NO: 1840 - DNA, 473 bp, Homo sapiens
  CDS 243..401
  sig_peptide 243..371: Von Heijne matrix score 4.30000019073486 seq LFCGFGLLFNCTQ/VI
tgaaaaaagttacaaaaataagtcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagt

SEQ ID NO: 1841 - DNA, 438 bp, Homo sapiens
  CDS 18..239
  sig_peptide 18..65: Von Heijne matrix score 4.30000019073486 seq IILFXLSLLLILE/XQ
aakatttttcaagcmasatgaagtccatcatcctctttrtcctttccctgctccttatcttggagmagcaagcagctctgatgggacaaaaasgtggatcaaaaggccaattgccaagcggatcttcccaatttccacatggacaaaagggycagcactattttggacaaaaagaccarsaacatactaaatccaaaggcagtttttcwkattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagmccatgataaatcaaaaggtcattttcacatgatagttatacatcataaaggaggccaagctcatcatgggacacaa

SEQ ID NO: 1842 - DNA, 476 bp, Homo sapiens
  CDS 129..323
  sig_peptide 129..203: Von Heijne matrix score 4.30000019073486 seq SLMPRCLVPGAHQ/LF
tccaagccatggtaaggcagcatgacctgacccagggtgagggagagggttcatgatgtaaacctcagagtagctagtcaccttcagcaggcactggtttaaagcaagacaagagagagtgacagtaaatgtcacatgtgtcagtgggtgggggtaacctcgggtccctaatgccccgctgtctggtacctggtgctcatcagttattccttgagcctgtttttcccccagttagtgtggctattctggtccatctgcctccctcccagttgctggtgagaacctgggaagatagagggatagaagggcagtttcaggaaacttagcaacctgaggtgtcttggacctcattttccagtcatggagcatcacagttccaggatgggaggatgtattaataatgatcattctaggcaaaaaatattgagtgctagtccgggcatggtggctcacsctgtaatcccagcactttggga

SEQ ID NO: 1843 - DNA, 363 bp, Homo sapiens
  CDS 32..274
  sig_peptide 32..178: Von Heijne matrix score 4.30000019073486 seq LMVELLKVFVVEA/AV
  misc_feature 339: n=a, g, c or t
gttccggtgggcgcgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttntgtttccagcggcctctgataaga

SEQ ID NO: 1844 - DNA, 466 bp, Homo sapiens
  CDS 71..256
  sig_peptide 71..199: Von Heijne matrix score 4.30000019073486 seq VVIDFTAAWCVHA/AP
accaaaggtaccttgcaatcacaacgaacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcgtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgccgcgcctgcgcctgcgtctgcgtctgcctaaaggagatcagtcgtcgccgtcaataagg

SEQ ID NO: 1845 - DNA, 652 bp, Homo sapiens
  CDS 216..635
  sig_peptide 216..335: Von Heijne matrix score 4.30000019073486 seq ITLVSAAPGKVIC/EM
gcttcgtcacaagggtgcgakgaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagacagcagaatg

SEQ ID NO: 1846 - DNA, 257 bp, Homo sapiens
  CDS 40..231
  sig_peptide 40..225: Von Heijne matrix score 4.19999980926514 seq YFLLLRSHFVAQG/DF
actaggggttttatcataatctgtctcatatcatttcatatgttaaaagggaattttaatgaaatacgttactactggttgtggattctaaaaggtagaaggacaaaatattatttgcctttaagaatacaaagaaaggattgtctgtttgtatggttagttgaattgtcttatttcctatttatttattttttattgctgagatctcactttgttgctcagggtgatttttaactcatggcctcaagtgatctcct

SEQ ID NO: 1847 - DNA, 462 bp, Homo sapiens
  CDS 244..453
  sig_peptide 244..447: Von Heijne matrix score 4.19999980926514 seq RVVSXAVISGSLA/SV
accaggtcctccgtggtgcacctgaaatggtcaacagaagtcttgtgacacgtggaatcatttcagagtcaccccttctgcctcctgctcaagcaacagacctgccgatcacccccgtcggcccgcgtttctcagggtcttcctaatcccctgggctttccggcttgtcgtgtgcctggagtcaggccgccgtgcgaggctgttaacctagcctcggggagagtgggatggagccaccttctcatggaacgatcctcgccttccctcatctccattgttttatggcttcacacggaccgtggctttctgcatggaagcttggtggccagggtgctgtcactttgggaagcagcagagaaccacaggatgcgtgaatcggtctccttgtcttcatgggcatctccggccagggtggtgtctygtgctgtgattagtgggtcactggcaagtgtctgaatgaaa

SEQ ID NO: 1848 - DNA, 462 bp, Homo sapiens
  CDS 264..443
  sig_peptide 264..386: Von Heijne matrix score 4.19999980926514 seq VFWMSFYLSRVNC/TT
ttcgtgaaatttgttggttttgaggactgtaaaagtgatttcatactctgaatataaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcgtkggtacccaatgcccgagtcactgtggcagcattcgcactggtgtggggagtcctttcaactcaaggaggctgggtttctgggcacccttgaagttttctggatgtctttttatctttctcgtgtgaactgcactacaaaagagaccagcccacttcccaagccagccagacacctgggtcttgagccataaactggcgtagttaagc

SEQ ID NO: 1849 - DNA, 459 bp, Homo sapiens
  CDS 16..201
  sig_peptide 16..147: Von Heijne matrix score 4.19999980926514 seq YNLFFSFVACAFS/HI
  misc_feature 332: n=a, g, c or t
ctcttatcagataatatgacttgcagatattttctgtcattctatgtactgtcttttcacattcttgatgatatacttttcagcccaaatgtttttaacttgatggaatacaatttatttttttcttttgttgcttgtgctttcagtcatatttgtgaaaactttgcttatcccacattacaaagatttactacttctaagtgatttataattttaccacctacctttaggtctctgatccattttgagttaatttttatgtgcaaggagggagtctaacttgattcytttacawgkggawawttwrgtgtcccaggacccattggtgraanagggtgcccagaacaggtacatctatatatagagaaagtggattagtggttgtcagagactgcaagaagtggggaattggagagtgactgcccatgggtacaggcatgctttttggcattatgaaaa

SEQ ID NO: 1850 - DNA, 526 bp, Homo sapiens
  CDS 17..373
  sig_peptide 17..142: Von Heijne matrix score 4.19999980926514 seq FILFLPVVFYLSS/FL
tgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaacagagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttaattttataggcat

SEQ ID NO: 1851 - DNA, 480 bp, Homo sapiens
  CDS 144..308
  sig_peptide 144..206: Von Heijne matrix score 4.19999980926514 seq FFFFKFFVQRVSQ/IP
  misc_feature 100: n=a, g, c or t
gttttttttgtttgttttaatgcatagtgtcactgtcactcaggctggagtggcagtgatgtgatcataactcactgtaaccttaaactcctaagctcangtgatctcctgcctcaccttcctgagcagctaagactgcaggcatgcaccaccatacctgcctacttttctttttttttaaattttttgtacagagagtgtctcaaatacccttctgtcatcgaggctggagtgcaatggtgcaatcttggctcactgcaacctccaccttccagactcaagtgattatcgtgcctcagccttctgagtagctgggatcacaggcgtgtgccaccattcccggctaatttttgtatttttagtagagacaggtttttgccacgttggccagtctggtctcaagctcctgacctcaagtgatccacatgccttggttgaccaaattgctgggattacaggcatgagcaatatgaccagctc

SEQ ID NO: 1852 - DNA, 517 bp, Homo sapiens
  CDS 150..434
  sig_peptide 150..275: Von Heijne matrix score 4.19999980926514 seq SLSPALLSPCLSP/FP
atatttgtcctcgtccctgccagtctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttccccyaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgctgaagttcagccagagtctgcatgtgcca

SEQ ID NO: 1853 - DNA, 500 bp, Homo sapiens
  CDS 143..361
  sig_peptide 143..268: Von Heijne matrix score 4.19999980926514 seq FILFLPVVFYLSS/FL
attctagaatactttggtcagtattatggacttagaatatgaaatttctgtatggatataaatttctacaatgactgtattttgaaccaggtttttttcctggcagaagaagttgtcctcaactatcagtaggtttttagagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaat

SEQ ID NO: 1854 - DNA, 671 bp, Homo sapiens
  CDS 266..547
  sig_peptide 266..424: Von Heijne matrix score 4.19999980926514 seq ILKWLHATAGAAA/LP
agtgcgcactggcgtgcgagactcggcgggcgctgttgagggagtcgggccgcgactgtggtcgttttttataccttcccgcgcggacgccggcgctgccaacggaagggcgggtagggcggtgcgtgattagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgcccctgactgcaaggtgcccggcgacgactgcccgctggtgtggggccagtgctcccactgcttccacatgcattgcatcctcaagtggctgcacgccacagcaggtgcagcagcactgccccatgtgccgccaggaatggaagttcaaggagtgsaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctcgaaaaaaaaaaaaaaaa

SEQ ID NO: 1855 - DNA, 402 bp, Homo sapiens
  CDS 16..201
  sig_peptide 16..147: Von Heijne matrix score 4.19999980926514 seq YNLFFSFVACAFS/HI
ctcttatcagataatatgacttgcagatattttctgtcattctatgtactgtcttttcacattcttgatgatatacttttcagcccaaatgtttttaacttgatggaatacaatttatttttttcttttgttgcttgtgctttcagtcatatttgtgaaaactttgcttatcccacattacaaagatttactacttctaagtgatttataattttaccacctacctttagtctctgatccattttgagttaatttttatgtgcaaggagggagtctaacttgattcttttacatgtggatatttagttgtcccaggaccatttgttgaattaggtgcccagaacaggtacatctatatatagagaaagtggattagtggttgtcagagactgcaagaagtgg

SEQ ID NO: 1856 - DNA, 510 bp, Homo sapiens
  CDS 172..486
  sig_peptide 172..300: Von Heijne matrix score 4.19999980926514 seq AGSLVATLQSVGA/AG
  misc_feature 63: n=a, g, c or t
agggcagagtaggcgcgtccctactggatggagggggaagtaacaccccaagaacgctgtcdnttcctgggccaagttgggacccggacggcctcaccatgatgaaacgggcagctgctgctsagtgggaggagccctggcagtgggggctgtgccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatacaaaa

SEQ ID NO: 1857 - DNA, 465 bp, Homo sapiens
  CDS 37..321
  sig_peptide 37..219: Von Heijne matrix score 4.19999980926514 seq LCGESGCSHGAGA/QR
actgctgtcccccgagctgctctacgcgctggcgsgatggggcacggggacgagatcgttcttgcggacttgaacttcccggcctcctccatctgccagtgtgggcccatggagatccgtgcagacggcctgggcatcccgcagctcctggaggccgtgctagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaaga

SEQ ID NO: 1858 - DNA, 755 bp, Homo sapiens
  CDS 102..263
  sig_peptide 102..251: Von Heijne matrix score 4.19999980926514 seq VLWLTSLQLVAET/ET
aagtgggagccacataccccgagctggaggcttgagcctgtggtatctaggctcgcctcactggggttggtggaggtgatggaggttgcagcttggccagcatggtagaaaggtggcagggcacgtctggcttttaccacccagttgcttcgagccaggagatggaggagtcatctgttgcacgctggaggctggagcctgcagatggcatggttctgtggctcacctcgctgcagttggtggcagagacagagactgcagcttgaccagagtggtggagtgatacgtatctcaagagcactccacaacaaagattctgcctgcaatcctccacttcaaggtctgttccaggaaacctgtgtaacacagttatgcatagagtggtcttaggaagctgactctaacatgaaaatttagagttggatcttttgctgacatattgaatattcataagagcatatgatacatttgtctatcataaacatgtcatttcaaaaaaccctcaaagttgccttgtagaacataattttaaaactagtgtgtaggaatatttcatatcagttattcagtcttcttaatatctgaaccgaaattaatcttccattctgcttttatttataaataatgatttattgtcagattcaataatttatattttcatttattctaaggtaggaaataccagcataaaaataaattatttgaaacaaaaaaaaaaaaaaaaaaaaaaaaaaaaaaaaagaaaaaaaaaaaaa

SEQ ID NO: 1859 - DNA, 465 bp, Homo sapiens
  CDS 222..374
  sig_peptide 222..299: Von Heijne matrix score 4.19999980926514 seq ILFKFSLCPYAAA/LS
taataatgttgttaaattattgccttctcatctgcgtgtctcttatgttctgcttaaagagattgtcagtttgttcaagctctttttagttgttgctcctccagtgcctagctttgagctttgtacacggtagttattgagttgagtaacatagtttgttctgagtcatttgttccacatgcttgaagacttggcttaacctagtagataataggaaagaaatggaaatgctctttgatgaaagagcccctctcttattcatcctttttaaattttctttgtgcccatatgcagcagctctcagcaaacctatatttggcagtgtggcctgtatgactaaagaaatcctggccaggcacggtggctcacgcctgtaatcccagcactttgggaggccgaggcgggtggattacgaggtcaggagattgagaccatcctggctaacatggcgaaaccccatctcta

SEQ ID NO: 1860 - DNA, 487 bp, Homo sapiens
  CDS 255..422
  sig_peptide 255..359: Von Heijne matrix score 4.19999980926514 seq LELLGLSNPPTLA/PQ
cctgagagagctttataatttcaagcctaggctgtcattcacctttgtttcatttctccaaaacaagctcctaatttagctacctgaagagactgctgcagcagtacagtgaaagcagcctttttttgaaatagggtctcactctgttgcccaggctggagtgcagtggtgtgatctgtgctcactgcaacctcaacctcccaggttcaagtgaacctcccacctcagccttctgagtagctgggactacaggtatgtaccaccacacccagctaattttttttgtagagatggggtttagccatgttgcccaggctggtcttgaactcctgggcttaagcaatccacccaccttggccccccaaagtgctgtgattacatgtgtgagccactgtgtccagtcgacagtagcctttttactgtgatgtcaataaaccaacatctgaagatgacaggaactggaaaaaaaaaaaaaattgsgaaaagc

SEQ ID NO: 1861 - DNA, 270 bp, Homo sapiens
  CDS 17..178
  sig_peptide 17..79: Von Heijne matrix score 4.19999980926514 seq WLPPCSLISDCCA/SN
taatcaagcctgggcaatgggcgggcgccctcccccagcctggctgccgccttgcagtttgatctcagactgctgtgctagcaatcagcgagactccgtgggcgtaggaccctccgagccaggtgttaccgtgagaaaatatcttgaacttctactctgtatctcatcagatgaaggataaataaacgtgtctctcaaagccatctttattcgaagaagtttccttcgcactacaaatctaaagttctttctacgaacatcttgtatgaa

SEQ ID NO: 1862 - DNA, 613 bp, Homo sapiens
  CDS 436..585
  sig_peptide 436..498: Von Heijne matrix score 4.19999980926514 seq SISLMLLIILLEQ/QE
gcactaatggattctacttcacattatataggacatgggacttcggagcttaatgggatatcgatcttcatcatgcttaatacttacttttcaagagaaagcaattgtagaccagtgtggttaagtgacggttacaagccctcatatccagtaagcagaagatgaaatataatttgatgtttgcccttgtttgaatactccatgaagatgaggaaaatacatgtttgtgtctaacagtgtctggcatgtgtgatttctattgagatggactcaatctcagagattctattctcagctgtgtccagtctactgagaggcccatcaaagattactcaaggagccgtctcatgtagaaagacgccctcataggctctcacaaactgttgcaagcatctcaaattttattgactgctgggtcttacaattcctcaccagatggctttgaacacagttcgatcatcaatctcattgatgctactgataattctattggaacagcaggagatggctctagctcctaaacctgccactcgaaacacctgtcatcacctcgaaagatctttccaatacccactggtacagttgtaactcaatcacttcgcaagacagataa

SEQ ID NO: 1863 - DNA, 596 bp, Homo sapiens
  CDS 31..321
  sig_peptide 31..309: Von Heijne matrix score 4.19999980926514 seq SVAIFILLTLVYA/YW
  misc_feature 544: n=a, g, c or t
agtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaangggagaggcaataaagaacacaaagctgttccccgtaaaaaaaaaaaaaaaa

SEQ ID NO: 1864 - DNA, 468 bp, Homo sapiens
  CDS 102..362
  sig_peptide 102..239: Von Heijne matrix score 4.19999980926514 seq FSFLFFLFLFLRQ/ES
cagatgagcaggtctagggatagacccatggaacttaattagtgtgtgattatgataaaggaatggtaagtgtgatcaagaaaagctgaacttttcaacaaatggtgttggggaaactggatagccatctgaaaaaacaaaagttttgtccatacctcacattctgcctcaagataagctccaaatatatgaggatttgtttttcatttttgttttttttgtttttgtttttgagacaagagtctcacccctttgccaggctggagtgcagtggcgcagtctcggctcactgtaacctctgcctgctccccgacaccagattcaagcaattctcctgcttcagcctcccaagtagctgggattaggcgtgtgcaccacgcttggctaagttttgtatttttagtagagacgggaaattttgtcatgttggccaagctggtctcaaactcctgacctcaggtgatccac

SEQ ID NO: 1865 - DNA, 492 bp, Homo sapiens
  CDS 232..450
  sig_peptide 232..411: Von Heijne matrix score 4.19999980926514 seq ALFKLCFHHICQC/LT
caaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctagctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtcc

SEQ ID NO: 1866 - DNA, 503 bp, Homo sapiens
  CDS 20..343
  sig_peptide 20..76: Von Heijne matrix score 4.19999980926514 seq AVAASAASGQAEG/KK
agcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggtaaagtgttaattactcaggttaagatgcttattttaagcctagtattttgcatcatgaattttgtgctttttgttgaacaatggtcactgaagtatgtaggttaaagataaagacctatgtaatattgacaacgtttaatattgtcaatctcattaactctcataat

SEQ ID NO: 1867 - DNA, 934 bp, Homo sapiens
  CDS 166..435
  sig_peptide 166..363: Von Heijne matrix score 4.19999980926514 seq GAMIVALAPTAAA/HS
aaaaggagtagctattagccaattcggcagggcccgctttttagaagcttgatttcctttgaagatgaaagactagcggaagctctgcctctttccccagtggcgagggaactcggggcgattggctgggaactgtatccacccaaatgtcaccgatttcttcctatgcaggaaatgagcagacccatcaataagaaatttctcagcctggccgaaaatggttggccccacaagccacgacaactggaggcaaagagggttgctcaacgccccgcctcattggaaaaccaaatcagatctgggacctatatagcgtggcgaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcggaaagcggcccccagaaccgaccacaccgtgcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaastgagaggcttgtgaaataccgagaggccaatggcttcccatcatggaatccaactgcttcgaccccagcaagatccagctgccagaggatgagtgaccagttgctaagtggggctcaagaagcaccgccttccccaccccctgcctgccattctgacct

SEQ ID NO: 1868 - DNA, 475 bp, Homo sapiens
  CDS 10..204
  sig_peptide 10..138: Von Heijne matrix score 4.19999980926514 seq LGALLXHLRLLRS/NS
gtgcgcataatgcgggtggagttctacttcctttcccagtacgtgtcgccagccgactccccgttccgccacatcttcatgggccgtggagaccacacgctgggcgccctgctggwccacctgcggctgctgcgctccaacagctccgggacccccggggccacctcctccactggcttccaggagagccgtttccggcgtcastagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacacccccagccctgcagtgt

SEQ ID NO: 1869 - DNA, 476 bp, Homo sapiens
  CDS 101..436
  sig_peptide 101..223: Von Heijne matrix score 4.19999980926514 seq MLCLKSLLKESQA/SG
attgaaatacatttggaatcttaagatcaaggaggagattgtggttataaatgtctgatggcatctctacatctcaggtgaagcatggaggatttcacagatgaatgagaaacagagcatgaatctgaagaagtcatacaaacgtgagaaagaagttgagaaagagattttcctgcgtaagaaaatgctgtgtttgaaaagtctgttgaaagaaagccaagcctcaggcaagagactgaaaattactagatcaccacatccagacaatgaaatcccagaactctcattccttatgattccttccttacctctccccaattcctattttccttcatttagttatatttcttcccagctatataaaccctcatttttagctgggacaacagagcattttgtgacttatctccctttctcttcagcttcagcacctgaataaagacttattccatgacaaaaaaaaaaaaaaatgcgaa

SEQ ID NO: 1870 - DNA, 509 bp, Homo sapiens
  CDS 21..497
  sig_peptide 21..170: Von Heijne matrix score 4.19999980926514 seq LLMVRLAVLVAVT/LT
caaatatttccatcacggggatgcttgtcatgtacctgcttgccgccctctttggttacctaaccttctatggagaagttgaagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggagcatggcactcattataattgactgga

SEQ ID NO: 1871 - DNA, 448 bp, Homo sapiens
  CDS 219..443
  sig_peptide 219..347: Von Heijne matrix score 4.19999980926514 seq AGSLVATLQSVGA/AG
  misc_feature 16,29: n=a, g, c or t
actactgactccctcnccctcccttcywnccctccccttcccttcctccctccgctccttgcttccctccccctccctccctttctgcccttctctctcctctttctcccctttcccatctccctctgccttcccctggcactctctctctagaacgggcagctgctgctsagtgggaggagccctggcagtgggggctgtgcgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttgggggaattcaccttcttcttctctcccagctgaac

SEQ ID NO: 1872 - DNA, 505 bp, Homo sapiens
  CDS 136..357
  sig_peptide 136..288: Von Heijne matrix score 4.19999980926514 seq LSLLPTLPCASLP/EW
attttttcggtggagcagctctgctttctcaggtctctacttacttatataagatggcatcaagaagaaggacctgaccactggcccctgactacatggtctttggaacccgtggcattggaagatgtcagagacatggcacatggatgtgatcttcaaaaactgttacagcctcatctcattggattggtctacacatcaaggtgctggaagtgtcgcatgcccagagatgaaggaagctctatacccctttcccttctgcccaccttgccctgtgcatctcttcctgaatggcttctcctgaattgtatcctttataataaactggtaaataggaaagagataatatcttctacttaatcctggatactatatctgaagtcagagcatccactccaaagcagagaatttctgaaaacaaaataatgtcatcatatgatgttagaattttttttcaaatgatggttcctaatacttcacattagaagaactcgaatttgatgac

SEQ ID NO: 1873 - DNA, 935 bp, Homo sapiens
  CDS 111..386
  sig_peptide 111..281: Von Heijne matrix score 4.09999990463257 seq ALLFSTSHLPSTP/CK
atcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctargcatttgggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataagaaaaaaaaggtaaagtctttggtagcttctat

SEQ ID NO: 1874 - DNA, 514 bp, Homo sapiens
  CDS 214..378
  sig_peptide 214..255: Von Heijne matrix score 4.09999990463257 seq GLGLLMVLNHCAS/LV
cataataaaggggcttgccgacaaacacttgctcataaagacttgtactcacatgcacagaacccaattaaagcaaactattatcagtttccatccttcatgcatcgctagtgatatgcaaggtgtcacatttgataggcatagtcaatcatggctgtccacttggggccttcttatggtccagaaaacagacactagtgcagtgaataagacatgggtttggggttgctaatggttttgaatcactgcgcttcacttgttttcagggaggttatggtcggagttaagttcacaattcacatggccaagacaattcataatggaaagctgctagttgtccggagatcaattttcttttgggattgctctggaaagctctaaactcgcagtgaaatctgctgatgtgcatagctacaggcctaatttcaaggaagaagagtcacccatgaggggtttctcaccccgttctctggaaggactgagaatcattatatcacagcttttgacaatggta

SEQ ID NO: 1875 - DNA, 726 bp, Homo sapiens
  CDS 6..287
  sig_peptide 6..80: Von Heijne matrix score 4.09999990463257 seq ISLSHLFLDLSRS/LW
atttgatgtgcttcttagtctcgtttaacttgccgattcatatatccctgtctcatttgttcttagatttgtcacgaagcctctggtttttggcttgtcctggtttgaacttggtgtatctggctcttgactcattttctgacctcagaccatccttaaatctgcttttctactttgtaccaggctttggcgtctccaagtacctgacctcagctcaacctgtcttgggttttcttctcctccctgacattgacaacccagccctcctaggcacagagagatggagctgagtgtggttttcctgaaataaagcttgcattatgagagggaataaacagaagaaaaaaatagtaagtaaaatcttgcttgcctctcagtaaaataaagctctatttttcgttttttttttttccaacttcctgtacaaaaaagggaaaactttagcttttgggggaaatttggagctagcctgttggtactgttgagcttagtgtatctataactatatattattccacaatatcttaaatactttataaagatattttcataaattacagcaatcctggctttagatgattgatggccatttttaaacaattaaagctaatttctagctttttatgagtttggtattaagcacagtagtttcttagaaagtctccagggaatgcattttgcaaaataaaaatcagctaatgacccaaaaaaaaaaaaaaatgcgaa

SEQ ID NO: 1876 - DNA, 436 bp, Homo sapiens
  CDS 29..304
  sig_peptide 29..73: Von Heijne matrix score 4.09999990463257 seq ISSCLLFINFXNG/NF
tttgwwcgatttttttggymtattctagatgttaatctcatcctgtcttctgtttatcaactttrtcaatggtaactttgasaaatttttagttttgatatakccccaktccattaatttttgccttaggwtgcactttaagagtataagatattkkkccttaccccaagattacraagatattctgtattctgtcagctttccagttttacctttcacattgasggctttattctawttgaagttcatcttcatatatgggaaaacaaaggaatctcacattatttttttcctttccattctgtgagacagttttcctaaatcatctattaaacagtgtattctttccttcatatagttttgtggagccacttttatcatacctcagattcccacagacacatatyagwwtactttttcaactttattaagagtt

SEQ ID NO: 1877 - DNA, 667 bp, Homo sapiens
  CDS 174..443
  sig_peptide 174..269: Von Heijne matrix score 4.09999990463257 seq SSLAFCQVGFLTA/QP
aaaaaggaactttcagtgataatgaacaaaactcaggagctatgtggatgacaggagcacctagatgaccgactttacccacttcaaatgctaccttgaccctagcactctctccaccctgcatcctcacctcagaccatcagttggttaggccaacagctcaccatcaattcatgccctgcctagaccaacakctcactgttcatgccctaccctgccctgcccagccctcctctctggccttctgccaagtggggttcttaacagcacagccttcacctccgagaaggcgcaatgggaaagacagatacacgttggttctgcaacaccaggaatgccaggatgatttagccacctcctcacttgtctacctttccctcccctgcttcaaagacttgggtcgatcgaagcaccaaagcatcactgttgctgacactaacaagtagtgccaagggattgcctttaaggaagatcaggagcggaacatctggtggcaaagaaaatctttctaatagccccattctagtgaccaccttcaacctcctcatagcaggagagtttgggagtaggggacttaggatgttttgttcttttaatcaattcagaaaatatgtatgtttgaaataaaaataaaaatacttgagccaaaaaaaaaaaaaaatgcgaa

SEQ ID NO: 1878 - DNA, 787 bp, Homo sapiens
  CDS 152..673
  sig_peptide 152..208: Von Heijne matrix score 4.09999990463257 seq LLLGQRCSLKVSG/QE
actagccaatggctgcctgcctaagctgggtccctggtctcctgggactactagccctttgttgatagggagaagccaacatctcccgcagaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccatttgcatgcaaaaaaaaaaaaaaaaaaaaaaaaaaaaaaaaaaaaaaaaaaaagtattaacaaaaaaaaaaaaaaaaaaaaaaaaaaatgcgaa

SEQ ID NO: 1879 - DNA, 493 bp, Homo sapiens
  CDS 152..448
  sig_peptide 152..208: Von Heijne matrix score 4.09999990463257 seq LLLGQRCSLKVSG/QE
actagccaatggctgcctgcctaagctgggtccctggtctcctgggactactagccctttgttgatagggagaagccaacatctcccgcagaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactgggtcctagctaaacactttgaaccacaggatgccaaggccgtgctgcagctgct

SEQ ID NO: 1880 - DNA, 466 bp, Homo sapiens
  CDS 50..253
  sig_peptide 50..238: Von Heijne matrix score 4.09999990463257 seq LELFLFGHLGSTC/RD
tgactaggaaagggaattccctgacccgttgtgcttcccgggtgaggcaatgcctcgccctgcttcagctcaagcttggtgcgctgcaccactgtcttgcacccactttccaacactccctagtgagatgaacccggtacctcagttggaaatgcagaaatcacacgtcttctgcgtcgctcacgctgggagctgtagactggagctgttcctattcggccatcttggctccacctgtcgagatattttacattaactttctatgacatacttatagcaaaacttattttttcatgcagaatagtctatattctatatttattgtaaagcatataccgtacatggtgactagtcaccatgctgtacaataaattttctgaacttagtcaactgtatttacgtattattttacagagatctctccaaatgcctctttttttctgaataaacaagcatccagtaatca

SEQ ID NO: 1881 - DNA, 472 bp, Homo sapiens
  CDS 22..432
  sig_peptide 22..318: Von Heijne matrix score 4.09999990463257 seq AELSATAAPRTSA/DP
aacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggcgaggccgaggccgtggctgccggctggatgctcgatttcctctgcctctctctttgccgagctttccgcgacggccgctccgaggacttccgcagacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttt

SEQ ID NO: 1882 - DNA, 501 bp, Homo sapiens
  CDS 27..203
  sig_peptide 27..131: Von Heijne matrix score 4.09999990463257 seq WLLDCGLFSPQNC/EP
  misc_feature 19: n=a, g, c or t
attcactctcttgctttmnctgtcgcatgcactctcttgcccttccacctagtttccatgttatgatgcagcaagaaggcccttgccagatgtggctcctggattgtggacttttcagcccccagaactgtgagccaaacaaacttcttttgttcataacttccccagtctgtgatatcctgttacagcagcagaaaatggactaagacacccagggatgtacctggaacctggaaaaaggaaaggaggcactgagggactcacatgaagctactctgtcagcattctaaaacttctgacattcttttctatgaagataattgaatcaccaaatttgatgaaatgttccccaaatatcagagaccatcaagcttcagatgatgatgcaacaaaggtttcagccagttcccggtgaagacaccacccttggacatcaagaagctaccctgcctccactagatagagcagggagagttctgtgatcccaatagggcctttgta

SEQ ID NO: 1883 - DNA, 515 bp, Homo sapiens
  CDS 184..438
  sig_peptide 184..291: Von Heijne matrix score 4.09999990463257 seq SLTFLGVSERGSG/RP
  misc_feature 86,89: n=a, g, c or t
tagaaaagtaattggtcagctctactgtaaaagaaataagtatgtagtacagttttgtaaatgtcaggtctgttctgttgttttgnganctgaagactgtcaaactggttgataatcaaagaaaaggttggtggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcasgattacmtccaactccactcatctactatcagcatcar

SEQ ID NO: 1884 - DNA, 521 bp, Homo sapiens
  CDS 179..475
  sig_peptide 179..295: Von Heijne matrix score 4.09999990463257 seq PSLIAGLFVGCLA/GY
  misc_feature 418: n=a, g, c or t
gcgtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgcnggtttggttgcaggtttaagcctcatgatgatcctgagacttgtcttgttgctgctctgagcatctggaggcctaaacctagccccaaacccactccacctta

SEQ ID NO: 1885 - DNA, 392 bp, Homo sapiens
  CDS 237..389
  sig_peptide 237..278: Von Heijne matrix score 4.09999990463257 seq VKALLWLPHVLEG/LT
acacaaaggttctccaagtccccactcaacccagaagcccagctggcttcacctctcatttgctgtctttggaagtccttcaagctcagttggagcaaccatcccccactgaaggctcttgggggcccactgcaacggccacacaatgggatctctctgcttctgagtgtaacacaactcactcttcccagccaccagagtgtcactctacaacataacttggatcctatccctgaatggttaaagcccttctgtggcttcctcacgtgctggaaggtctcaccccatctcaggaagacgtcaggggtcatcaaaaggacaaactctgggttgatgagtcattctgggagaaggccaatcataggatggagtatcccagttgcgtcttctga

SEQ ID NO: 1886 - DNA, 646 bp, Homo sapiens
  CDS 75..596
  sig_peptide 75..131: Von Heijne matrix score 4.09999990463257 seq LLLGQRCSLKVSG/QE
aacatctcccgcagaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccatttgcatgcgaaaaaaaaaaaaaaatgcga

SEQ ID NO: 1887 - DNA, 515 bp, Homo sapiens
  CDS 214..378
  sig_peptide 214..255: Von Heijne matrix score 4.09999990463257 seq GLGLLMVLNHCAS/LV
cataataaaggggcttgccgacaaacacttgctcataaagacttgtactcacatgcacagaacccaattaaagcaaactattatcagtttccatccttcatgcatcgctagtgatatgcaaggtgtcacatttgataggcatagtcaatcatggctgtccacttggggccttcttatggtccagaaaacagacactagtgcagtgaataagacatgggtttggggttgctaatggttttgaatcactgcgcttcacttgttttcagggaggttatggtcggagttaagttcacaattcacatggccaagacaattcataatggaaagctgctagttgtccggagatcaattttcttttgggattgctctggaaagctctaaactcgcagtgaaatctgctgatgtgcatagctacaggcctaatttcaaggaagaagagtcacccatgaggggtttctcaccccgttctctggaaggactgagaatcattatatcacagcttttgacatggtatg

SEQ ID NO: 1888 - DNA, 455 bp, Homo sapiens
  CDS 144..428
  sig_peptide 144..233: Von Heijne matrix score 4.09999990463257 seq LVPAGMAVQEIGA/QM
gctcatagggagaaaggaagctgcgctgcgttctgcgggacgaaccctgctccgcgcgagaatttttttgattccttcttatttggagaaatctccagctgctctgatcatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccc

SEQ ID NO: 1889 - DNA, 457 bp, Homo sapiens
  CDS 274..432
  sig_peptide 274..381: Von Heijne matrix score 4.09999990463257 seq VFILIYKCNFCWA/QW
ctttatagaaaaataacaatcattattttcagttgacatgattgtttacctaaaaatatccaaaggaaccaactgaaaaaaaaattttaagattactggttaaaagttcttttatataaaaatcaatagccttccccaatgttagctataatcacatagaagatatagtgatgaagtattttttcaggtatttcagcaaaaattaaatacctaggaataaacttagatgtgcagggcttttatcaaggacaggacaaaattttgctgagtggaatgaaagatttgcattctatgttcctggatgagcagatttcatgttataaatatgttagttatcaccatgtcttcatattaatttataaatgtaatttctgctgggcacagtggctcatgcctgtggtccaaacagtttgggaggctgaggcgggtagatgacaattagctgggtgtctgtggc

SEQ ID NO: 1890 - DNA, 465 bp, Homo sapiens
  CDS 4..180
  sig_peptide 4..48: Von Heijne matrix score 4 seq FFLSSTCFHSGQQ/FY
agcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcttttatttstctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggta

SEQ ID NO: 1891 - DNA, 640 bp, Homo sapiens
  CDS 98..361
  sig_peptide 98..355: Von Heijne matrix score 4 seq LFILLTSVSGHLP/DT
agtcaggaaaatgaagctgaacatcaagtcccagcaagaaaagaaggaaaaggaatgccaagcagtcatgttagcagtttgaaggggctggagcaagatggaatcaggaataaggagtcagtgggaccatgtacaacactggaagacacgtatcccttcgcctggacaaggagcacttggtcaacatatctggagggcccatgacatacagccaccggcggaggagatccgactacactttgggagtgaggacagccaagggtcggagcacctcctcaatggacaggccttctctggggagcttcaagagagggatttgttcatcttgttgacttctgtatcaggacatctgcccgatacatagaaaaagtctgctgacccctgaattacagtatgagccattcggaatgcatttctctttaaaagttctcgcctcattcagtgtctggaacacagtgggtgctccccaataggtgacaccttcctcaagtttccttgggagaacagactcaatgtcggatccacaaaggagacctgcacatacctaacccctatttctgcagaagctgaagctgtattatctattgcttgcataataaatattgcataacaacaacagaaaaaaaaaaaaaaatgcgaa

SEQ ID NO: 1892 - DNA, 443 bp, Homo sapiens
  CDS 143..418
  sig_peptide 143..301: Von Heijne matrix score 4 seq XLXCFGGPXAGTX/XP
  misc_feature 364,387: n=a, g, c or t
ctttctacgctgggccggttatcgacccggyccagtgcgcaggcgcgggaaagttgaactaataaagtttgtwcgagttcagtggaggagaccgcaagttgagtggaggaggcggcggtggggcccckkaccakgtgcctscatggcargctctgaagagctggggctmcgggaagacacgctgagggtcctagctgmcttccttaggcgtggwgaggctgccggktctcctgttscaactycacctaggcccarstactscakacttmtatgctttggtggmccascggctggaacagstkgtccaagakcakstgaaatstscgcccagsccagaattacagggtsccccatcgacagaganggaagccatactgcggavgctgntggccctgctggaggaggakgcacaagtcattaaccagaagctggcctcggacccc

SEQ ID NO: 1893 - DNA, 497 bp, Homo sapiens
  CDS 167..493
  sig_peptide 167..220: Von Heijne matrix score 4 seq VAVGLTIAAAGFA/GR
agttttccggcctagtttgcggctgctcctgccgtgttgcgtagggcgcctgtgcttgaggttgggggttgcgtcgctctctggtaaaggcgtgcaggtgttggccgcggctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaagatttactaga

SEQ ID NO: 1894 - DNA, 741 bp, Homo sapiens
  CDS 61..429
  sig_peptide 61..147: Von Heijne matrix score 4 seq RSSLLLADQASRA/DE
tcttccccccatcgcggcccagcaacctgggggtccgcgtgacttctccctggccgggggatggaggatgcgctctcctctgtcccttcaaggcctcttcctcgtcccaggtcgagtctcctccttgctgaccaggcatcgcgagcagatgaatcctctgggcggttgtccctgtcaggctgtcaggacctgattttccctgggcaggtaacatttctgaaaggtcaggcagctaaaaagcagacagctttctggcacattagagaaacaaaagaaatgttggagactggaatgcctgctgtgtcaaggcacctaattagaaaacaacgtcagagtgaatttgtcgtgcgagtctccagctctgccagaagaactaaaagaaatgtgtcaccagaggaatcacaaattgctttggaaatcatgtggacctagctcttggcaacacagaatccacatctaacctcgttctactcagctctgctgtcccaaaggaactgactcagcgcaagaggacagcttcgactgcctgtgacttcatctccaacccagccaatcagcactcccaaatcactgcccccacccaccaaattatccttaaaaattcggatcccccttggggatactgatttgagtaataataaaactctggtctcctgcatggccaaaaaaaaaaaaaaaaaaaaaaaaaaaaaaaaaaaaaaaaaaaaaaaaaaaaaaaagaaaaaaaaaaaaaaatgcgaa

SEQ ID NO: 1895 - DNA, 542 bp, Homo sapiens
  CDS 62..430
  sig_peptide 62..148: Von Heijne matrix score 4 seq RSSLLLADXXSRA/DE
tcttycccccatysssggcccagcaacctgggggtccgcgtgacttctccctggccgggggatggaggatgcgctctcctctgtcccttcaaggcctcttcctcgtcccaggtcgagtctcctccttgctgaccakvcatcgcgagcagatgaatcctctgggcggttgtccctgtcaggctgtcaggacctgattttccctgggcaggtaacatttctgaaaggtcaggcagctaaaaagcagacagctttctggcacattagagaaacaaaagaaatgttggagactggaatgcctgctgtgtcaaggcacctaattagaaaacaacgtcagagtgaatttgtcgtgcgagtctccagctctgccagaagaactaaaagaaatgtgtcaccagaggaatcacaaattgctttggaaatcatgtggacctagctcttggcaacacagaatccacatctaacctcgttctactcagctctgctgtcccaaaggaactgactcagcgcaagaggacagcttcgactgcctgtgacttcatctc

SEQ ID NO: 1896 - DNA, 482 bp, Homo sapiens
  CDS 95..475
  sig_peptide 95..229: Von Heijne matrix score 4 seq PVLMTTVAMPVFS/KQ
ctctgcaaatccaggacacacattgtgctccgcgctccactaaaggcttgagtgggcactgttccatctcaacagcccctgttttggaaaggacatgattgtcaagggggtggcctccagaactgtggtttccagaccgttccccggtaactggcttttctcttccatccagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgagaaggaaaaaagcgaagggaacctaactatagtagcgttgacctctctgagtggagtgggaagaccgagatgacgtg

SEQ ID NO: 1897 - DNA, 467 bp, Homo sapiens
  CDS 24..209
  sig_peptide 24..158: Von Heijne matrix score 4 seq AAHVLSLIFHCQS/KS
ttatagtgactcggggattgcagatgacgcaggctcctccaatcttcatgcgaggcttccctggcaggggaagagaatatggagaactgcacgctggctcttcgtgcttccacctgaaagcagcacatgttctttctctcatatttcattgtcaaagcaagtcctgcagccacacctcaagaggggtgaggatatgtaatcctattgcctagaagaggagaactggagctattgaccacagaatccttttcttctcctgcgcttgctacctgggggatctcatcagatcctgtggttccaactccgaagtgtgcctctccagccctgtccttgcacctgaacttgacccgtgtggcccactgcctacccccagctctgccaggcacctccaggtgggggccctttagttccacacaagcaagccagagcccacccccatttgtttgcagaggaaactgaaaagtcat

SEQ ID NO: 1898 - DNA, 480 bp, Homo sapiens
  CDS 61..429
  sig_peptide 61..147: Von Heijne matrix score 4 seq RSSLLLADQASRA/DE
tcttccccccatcgcggcccagcaacctgggggtccgcgtgacttctccctggccgggggatggaggatgcgctctcctctgtcccttcaaggcctcttcctcgtcccaggtcgagtctcctccttgctgaccaggcatcgcgagcagatgaatcctctgggcggttgtccctgtcaggctgtcaggacctgattttccctgggcaggtaacatttctgaaaggtcaggcagctaaaaagcagacagctttctggcacattagagaaacaaaagaaatgttggagactggaatgcctgctgtgtcaaggcacctaattagaaaacaacgtcagagtgaatttgtcgtgcgagtctccagctctgccagaagaactaaaagaaatgtgtcaccagagggatcacaaattgctttggaaatcatgtggacctagctcttggcaacacagaatccacatctaacctcgttctactcagctctg

SEQ ID NO: 1899 - DNA, 484 bp, Homo sapiens
  CDS 148..414
  sig_peptide 148..249: Von Heijne matrix score 4 seq YFLFLHFFSCSKP/CV
cgagacaccttagcctcttcacatataatagataatcctttattttgtaaatatgttcataggccagctttagtgacaaagcwcagagaccaatttmcaacttwcacagctaatagaggaaatggatctgtggggatagttgcaggtatggttggatctaggagctcaagcaagatmatgaaggttctttttcmccttttttctcctttctactttttgtttctccatttcttctcctgctctaagccctgtgtgtcactgccttgctttgggtctggcctcattctcttcatgcattgggtaagacggattctagcattgtcctatttgttgtgttcctctcttccttcctcagaaaagagaagcaataccttccscstccccatctatctatcaaaaatagcggcagggcactgattgtccttactcggttaatgaagcsatccccttacctacaaattgagaggggatagtacatatttga

SEQ ID NO: 1900 - DNA, 498 bp, Homo sapiens
  CDS 139..327
  sig_peptide 139..180: Von Heijne matrix score 4 seq FYMVCVLGSGAQP/LS
tcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcatttcaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaa

SEQ ID NO: 1901 - DNA, 559 bp, Homo sapiens
  CDS 285..512
  sig_peptide 285..431: Von Heijne matrix score 4 seq HFLILYLPGWVDC/MY
cacatcacattggctaaaattatcttttgttaataaggattatattacatataaaagtatttaaatattttaatgactcttacccttaggatagggtctgaactccttagcaggcttcatgatatattaaccttgttgacctctttggtctctctcagtacttctcaattcatactttgctcttcagccacagtaagttagttttagttccctgagtatgttatcagctctctggattctgggctttgctcatatttcctctattcaaaatactcttatacttcatgtctttcttgccacaccccccaccccttcccaccagcatatgtgtatgtatcacaattactcatccttcagatcagattcagtttaaatggcatttctttgggaagcatttcctgattctctacctcccaggctgggttgattgcatgtatagcaccttctactgtagtacccttttcatggcatttacttaccatagcctatttgttattgccctcaagctccattagggcaaattgttttttcattgttttaaagtcagcacctaaatctc

SEQ ID NO: 1902 - DNA, 494 bp, Homo sapiens
  CDS 38..310
  sig_peptide 38..166: Von Heijne matrix score 4 seq AAWCSLVLSFCRL/HK
cttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaaagcttcctgtggagtcgatccagattgtattagaggaactgaggaagaaagggaacctcgagtggttggataagagcaagtccagcttcctgatcatgtggcggaggccagaagaatgggggaaaaactcatctatcagtgggtttccaggagtggccagaacaactccgtctttaccctgtatgaactgactaatggggaagacacagaggatgaggagttccacgggctggatgaagccactctactgcggg

SEQ ID NO: 1903 - DNA, 481 bp, Homo sapiens
  CDS 125..313
  sig_peptide 125..271: Von Heijne matrix score 4 seq ISIKISLFPYARG/AP
gtaaaagtttgtctcagctcgagcattcctagcgccaacacgccctcaggtaaaggtggaagtaaatggccacgctgtattgacagagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatacactgcctctaggactgggacagatagccactgagtacctgcttcaaatcaccctgcacgttttc

SEQ ID NO: 1904 - DNA, 501 bp, Homo sapiens
  CDS 126..398
  sig_peptide 126..386: Von Heijne matrix score 4 seq TMIILGFPTCAWL/CP
acagttctgcacgttgcaatcctgtgtcgttccgtccaatctaatccaatctcaaagaccccagttcctgagcaaccctggcttggctcggccaaagggaagcgtctacagaatctgagtctagaatgcccggagtctgtacttcttgctgttttcaggagattcaactgcaaagccctccccaagtcatccacattggctcacgtttctgtgccccacccttcctgcctgggaggacccttcttgttcagccaaaaaagcaacctgagggtggggtggtagcagggactcacccatttctctttccatcttctgtcgcggatgcaaccctggaagaagacctcaggacgatgatcatcttaggattcccgacctgtgcctggctttgtcctgaatattagccttggcagcctggcctgggctccatggtggatgaacttggctttccacgggctgccacctccagcctgcgctgtggagagaccagatcctcggaacagt

SEQ ID NO: 1905 - DNA, 540 bp, Homo sapiens
  CDS 175..354
  sig_peptide 175..309: Von Heijne matrix score 4 seq ENFLSLLSKSCSA/DP
attttaaaatggaaattggggcgaggggttggcggctgggcgaagggagcattcaaaagcggagaatgtcactttacccgagaaattcactacgatgggccattggtttctgctcggctcgcaggcgcactgcacgagtggaggtgtggctagtggctgtgatgagataaatccatgcatagccttttcattgcgagcttgaaagttcttttttattacagttttagctttaggtttaattggttcgactgccttctccacaatttgggcgagaatttccttagccttctcagcaaaagttgttctgcggacccgtctgggtcaactttcatgagggacattgagacaaacaaatgaaatatgggttaaagtactctgagcagctacaaaaagaagaccagtctatcctgctggagacagtggccacgtgaagaaagagctcttgcagtatgaagaccacatggaaagagaggccacatggaaccaacagtcagcatcttggtttcggacacgtgaagaattcatctcagactgtgtatc

SEQ ID NO: 1906 - DNA, 486 bp, Homo sapiens
  CDS 124..351
  sig_peptide 124..306: Von Heijne matrix score 4 seq LPTLVPLVSSGLS/EM
ctggatgctgctgcagctgaggccgaagcccgggctgaagcaagaacccgcatggaattggagatgaggctgtgtctgggccctggagctgggatgacattgagtttgagctgctgacctgggatgaggaagkagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaag

SEQ ID NO: 1907 - DNA, 474 bp, Homo sapiens
  CDS 222..380
  sig_peptide 222..350: Von Heijne matrix score 4 seq SLDLIGHWALVRP/QT
ttattggctagttagctttctttatcaacctgctcactcacaaatgtgtgccctcagccagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgt

SEQ ID NO: 1908 - DNA, 485 bp, Homo sapiens
  CDS 65..316
  sig_peptide 65..256: Von Heijne matrix score 4 seq LTPVIPALXEAEA/GD
ttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaacmagccctggtgtagcagacactgcaacagatgcctcctagaaaatgctgtttgtggccgggcgcggtggctcacgcctgtaatcccagcactthrggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcarargttgcagtwagccaagatcacaccactgsamtccagcctgggtgatagagtgagacactgtcttgac

SEQ ID NO: 1909 - DNA, 499 bp, Homo sapiens
  CDS 186..446
  sig_peptide 186..428: Von Heijne matrix score 4 seq LWSITQFFTEIAA/AS
agttccttggttaccaggggtatagatacacaaatatcatagacacagaagttacatatgcttttattaagagttaatgatttaaaaaataacctaatgatatgagtgctaaatttgtaaataattgaaatgagtcactttcttctggtaacaccttcctggggtttttagcttcaagagccaccatgctgacaagtaagcactttcattaccaatacttctttcaggctattccattccaagatkaccaaataggaacagctctggtctggagctcccagcgtgcccgacacagaagacgggtgatttctgcattttcacagagttattcctttgtagttgtgatccagcatggatgtggtgtggttgtatcagtgactgcaggtagtctgtggagcattacacagttctttacggaaatagcagctgcaagtgaccaggaccactgacagcagaaggcacctcacttaccatggtaaaaagcagtttagaaaaatct

SEQ ID NO: 1910 - DNA, 460 bp, Homo sapiens
  CDS 70..354
  sig_peptide 70..159: Von Heijne matrix score 4 seq ILSIVAFCPHVTP/CK
  misc_feature 420..421: n=a, g, c or t
ttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttactttattaaaaaagaaaaaacagtctgttggcttctcagtctgcatcttggaggcagggaggtgagggcaggtgcccctcagacacttcaggaaggtagtttgcattctatttaaaaaaggaagtggggagcaaatgaaaatcaaatgtggggggaaaacactaaagggggcaagtannaaaggaattacaaaccctctgctctttgtatttctctgt

SEQ ID NO: 1911 - DNA, 462 bp, Homo sapiens
  CDS 122..352
  sig_peptide 122..184: Von Heijne matrix score 4 seq STLAFLLLAGPRS/WR
aaagaaggtgtctctaggagggaagagctgggaggtgggaagtgggggaggggccccagaccaggctcagagcatatccttgctcctggcctccaccgcagaaggtggctcacccctctgcatggaacagtctctctccattccctctaccctggccttcctcctccttgcaggccccagaagctggagggggctggtcggggttgggctcacagacacagtggtggagctcacagaagtgcccccacccaccaggagcccagggtgggcctcagccagccgggggaacctggtttccccaccctggaggccagcgccaaaggacgttcacgtgcagctcaaccacacaatataagagctactgtctcsaattaacacttggggacactgaggcaaagagcctggctgaatattgtgcccgtgaagacagagggacagcctattttgtttgctgctgtatcc

SEQ ID NO: 1912 - DNA, 503 bp, Homo sapiens
  CDS 205..408
  sig_peptide 205..267: Von Heijne matrix score 3.90000009536743 seq LLLGGSYCPPLQP/LT
aaaaataaagtcagaacacctggcttaataggcctcactgtgcagatgaggaaactgaggcccagggaggaagagcgatctgtggagatatttctagaacccctgcaagctgagccccagtgaaggagagaaggtccagtaggagcttgctaagctcaaaatcgaagaaaggttcagcaagactgtcagggtgacctcaaagcaatggcagccatcagaggagccccattgctattaggaggctcctattgccctccccttcagcctctgactttcacctgtgctacccaattctggttccttsactcccattcaaaaatggaccccagaaaagccttattttgtggagtacctagttcccttttgggtttgtctcttgactgctacgggcattgcccagggcaaccatgacagtgaagatgactggccaagcttgtggactggccagcaagcttgggctgcctgagacgctttgaaatggctgccttctgagttggtcttga

SEQ ID NO: 1913 - DNA, 509 bp, Homo sapiens
  CDS 78..233
  sig_peptide 78..173: Von Heijne matrix score 3.90000009536743 seq KLAIATAGTGTQA/AP
ctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagcgggcccgctgtgtgctcccccggaaggacagccagcttgtaggggggagtgccacctgaaaaaaaaatttccaggtccccaaaggttgaccgtcttccggagacagcggatcgactaccatgtgggtgcccacaaaaattccacctctgagtcctcaactgctgacccyggggt

SEQ ID NO: 1914 - DNA, 456 bp, Homo sapiens
  CDS 170..346
  sig_peptide 170..280: Von Heijne matrix score 3.90000009536743 seq SLSLRGFSLPVSP/FE
actgtgatcaccgtccatggccgcctgcgatacccacgccgtgctcagaagagggctctgaggccacgcccgcctgtggggtcggtggccgggcttccgggaccccagaggagtcgtcgcgcgctaggtggaggggacccctctggaatccggcgatccccgggcgcagatgcaggagcgggtggggagagccgcgttcctggcatgtttgcctcgagttagtcacgaaggaatcgaagagagccttagtcttcgaggcttttcccttcctgtgagcccctttgaggccagcacattgatttttttttctttcgcagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgta

SEQ ID NO: 1915 - DNA, 506 bp, Homo sapiens
  CDS 30..356
  sig_peptide 30..152: Von Heijne matrix score 3.90000009536743 seq LLLLPGQLQQVTL/LQ
ctaccctccaagctgtagttccagcgctcatgccggaactggaactggcactccaggccgaggtgcatggcgtcccacagggtctcagccaggctgggctccctcccgcagagctgcttctgctgccgggacaacttcagcaggtcacactgcttcagatgggccctgcctgtgctggggccaccgcagtgcccagtcctgggaagggcatcaggacctcccacctggtcaggctggagacggcgagaggacagagacgggctgaactcccttgttcaggcaaccacccagaaacacatgaataccgtcattctcctccgccaaggccggtatcagcgcctcaaggaaaacaactctgaagtcgaacgcccactgcttcaaaacccacacgccgagtacagcacccctattcggaaggaagtagccagacaatcaacaacacaacacccctcttccttttatattaaagtaaaaggcaagaatgttagccaaactgcaccatgtta

SEQ ID NO: 1916 - DNA, 469 bp, Homo sapiens
  CDS 13..441
  sig_peptide 13..372: Von Heijne matrix score 3.90000009536743 seq LLLSSMNLPGGEL/RR
attggsgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagctttgcaatgagaggtttcttacaggaaggggaccttatcagtgctgaggtccacgcagtgttctctgacgga

SEQ ID NO: 1917 - DNA, 484 bp, Homo sapiens
  CDS 291..455
  sig_peptide 291..446: Von Heijne matrix score 3.90000009536743 seq SLLKIQTLAECGG/MQ
atcgaaaataataacaatgtattcttgaaaactacaaagagtaaactttgtttcttgtcacacaaaaaaatttatgtgaggtactgtgtatgttaattacctcgctttagccattccactatatatacacgtatcaaaacatcatagtgtgtctaatttttgtcaattaaaaaatcatcaaaacaaaagatagaaaactttaaaaacatttggcaattaaacagtacaattctgataaattcataggtcaaagaggaagcctahagaaaaataaaatactttgaattaaaatgtttgggccaggcgtggtggctcacgcctctaatcccagcactttaggaggctggggtggatggatcatgaggtcgggagatcgagaccatcctggccagcatggtgaaacccactctctactaaaaatacaaacattagctgagtgtggtggcatgcaactgtagtctcagcaacttggggggctgaggca

SEQ ID NO: 1918 - DNA, 453 bp, Homo sapiens
  CDS 69..299
  sig_peptide 69..164: Von Heijne matrix score 3.90000009536743 seq FSQLALNCSLASA/GC
gactgtgtggaagcaccaggcatcagagatagagtcttccctggcattgcaggagagaatctgaagggatgatggatgcatcaaaaggtgagtgggtgaaatctccatggagccccacatgccccttcagccagctggccctaaactgctctcttgcctctgccgggtgcctggggccattgccctctcaccctgacttgtggccctggtgctgcttgctttctgtctcatccctttttagaaaacccacaaacttttcatttaggcataatttcagatttacaaaaagattgcaagaataaaaagaagaatttccatatatcctttatccagattccctaaattattactgcatttgctttatccttctcgatcagtggacagatagatgatatagacagatagatagacaaatatatattttttgaactcttgagagtaagttgcagatat

SEQ ID NO: 1919 - DNA, 471 bp, Homo sapiens
  CDS 15..179
  sig_peptide 15..116: Von Heijne matrix score 3.90000009536743 seq WLLKTGTCPSASP/VP
atcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaggcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagagsccctgcccaacccggagactggatagcgacttccttgccgtgctaagtgactacccgtctc

SEQ ID NO: 1920 - DNA, 663 bp, Homo sapiens
  CDS 199..618
  sig_peptide 199..408: Von Heijne matrix score 3.90000009536743 seq FKVLTQPLSLLWG/CD
aactggatagagtactgcccccttcagcccatggagaaaggcaaatgcctccttcagagtctacctaatgctttctcagataaataagcatgaagaaaagtcaaagtccattctagctctaaaataaggaatgaaatgttttcctgatatgattttttgttttcatctgataataattttatatatcacagaaacagcatggttcttactaaacctcttcaaagaaatggcagcatgatgagctttgaaaatgtgaaagaaaagagcagagaaggagggccccatgcacacacacccgaagaagaattgtgtttcgtggtaacacactaccctcaggttcagaccacactcaacctgtttttccatatattcaaggttcttactcaaccactttcccttctgtggggttgtgatcagaagcctcgtactgttcctacccttggaaacggcgcatgggatacctgccaacaacacatacgcacttcatcatggacagcaaacacactcgtcattcaaaaccagcattcacgggaaagcactgtttctgtttgcctttttatgttaatccgcatgcaacatattttgaaaacagatacacttcaacagttcagaatatgctagtactaataaaaccaacatgttaaaaaaaaaaaaaaatgcgaa

SEQ ID NO: 1921 - DNA, 488 bp, Homo sapiens
  CDS 138..368
  sig_peptide 138..200: Von Heijne matrix score 3.90000009536743 seq WAFSCPYLALVDG/GM
aagccttagcgaggccatgggggaaaaagtctaactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatgagaccgggacttgctgtgttgcccaggctggtcttgaactcctggtcttaagcaatcatactgctttggccacccaaagcactgggattacaggcgtgaaccaccacacccagctcttaaaaccacagtatttctagagacagcatctcgtatgttgcccaggctggccttgaaagcctggcctcaagccatcttcctgcctcagcctcccaagtagctgggatcacagggttgtggcatcacagctggctata

SEQ ID NO: 1922 - DNA, 492 bp, Homo sapiens
  CDS 226..411
  sig_peptide 226..372: Von Heijne matrix score 3.90000009536743 seq LELLSSGDPTVSA/SQ
taaaggtgtatgtttttaaatgtatcatctgtgtgtgcccccattaatattcttatttaaaagttaaggccggacatggtggcttacaactgtagtcccaacagtttgtgaggccgaggcgggcggatcacttgaggtcaggagtttgagaccagcctggccggcatgatgaaaccttgtctctactaaaaataccaaaaaaaatttagccaggcatggtggcacatgcctgtagtcccaagtagctgggattggaggtccccaccaccatgcctggctaattttttgkacyttcagtgraraatggggttttgcsatgttggcmaggctgttctcgaactcctgagctcgggtgatccaactgtctcggcctcccaaggtgctgggattacaggcgtgagcaactgtgcctagcctgagccaccacgccggcctaatttttaaattttttgtagagacagggtctcattatgttgcccagggtggtgtcaa

SEQ ID NO: 1923 - DNA, 388 bp, Homo sapiens
  CDS 91..366
  sig_peptide 91..132: Von Heijne matrix score 3.90000009536743 seq DVIHLLCVLPAFQ/KV
attttaggtgagctgccacgtccggagagggcagcaagaatgaaagacctctagttttccagactcccggagccctggtctctacaccacatggacgttatccacctcctctgtgtcctcccagcatttcagaaggtgatccacggcaaagcgtcccttcaaatccgtctttgtgcccactgccatagtcaaccccgtgagaagcacagccggcmctgggactttaggacaagggtctcttcggaaagggcggasagcatgagaaagagtaagtggtggcagagagcaagtcaaaaccgtgagatttcagaattacagccctcctcccaccaaacattacacctcccatcccacctccggaaagcctgaacagccagccamcctcaag

SEQ ID NO: 1924 - DNA, 473 bp, Homo sapiens
  CDS 119..421
  sig_peptide 119..223: Von Heijne matrix score 3.90000009536743 seq SFLGAQLPPEVAA/MA
aggggcgcttccggggaccaggcccgcttttggctgcatcagcggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggccgctactaggggacctagacaggagcacgttcagaaagttgctgaagttgtggtcagcagcctgcagggggaggactgccgagagstgtgcagcgtcttggggtcagcgccaacctgccggagagcagctgggtgcccctggcaggcatgcacacactgctccagcaggccctccgtctgccccccaccagcctgaagcctgacaccttcagggaccagctcmaggagctctgcatcccccaaga

SEQ ID NO: 1925 - DNA, 487 bp, Homo sapiens
  CDS 17..193
  sig_peptide 17..109: Von Heijne matrix score 3.90000009536743 seq VVLGSPCSLEIHS/AD
caatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatca

SEQ ID NO: 1926 - DNA, 464 bp, Homo sapiens
  CDS 18..266
  sig_peptide 18..254: Von Heijne matrix score 3.90000009536743 seq LFLGTLPLCPVTS/PV
tgtgttcaatcgtgtgaatggccggcgggcccstccacgtccccatccttcgaggggacccaggagacctacacagtggcccacgaggagaatgtccgctttgtgtccgaagtagcgagcggggccagagggtgcggcataggctgctgggtcgcaaaaccatggacccgggatggccccacttcaagctgacccacagccgctgcatggctgtgcttttccttggcactctgcccttgtgtcctgtgaccagccctgtgtggggctgagtccagggtgaccatcaggccctgggtgggcgatggggtgcctgggacctggctcagcccgactgccctsctcccacagcctggcagcaggtgcasagcagctsgatggtggcccagccggtgagggcgggccaaggcctgtgcagtacgtrgagaggaccccaatccccggctgcagaactttgtgcccattta

SEQ ID NO: 1927 - DNA, 475 bp, Homo sapiens
  CDS 7..354
  sig_peptide 7..348: Von Heijne matrix score 3.90000009536743 seq AWALWTGWRPSQC/GS
ttcaccatggccagctatccttaccggcaggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtgagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttcsagtcggtggactcagatcacagtggctatatctccatgaaggagctaaagcaggccctggtcaactgcaattggtcttcattcaatgatgagacctgcctc

SEQ ID NO: 1928 - DNA, 496 bp, Homo sapiens
  CDS 25..267
  sig_peptide 25..153: Von Heijne matrix score 3.90000009536743 seq AGLAALQFFRSQG/AE
taaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtaagtctgtgggcccgtcctcccttcgctggcccagatttcgggctccgactcctacctggagtgtgaatggcagtccttgacggacagccttcaccgtttgctgggcccctagcctggcccttggtttctgacctttattctcccggctcggcctcccttccccacctcgcgtctcgccagcttccctcatgtccttccttcccccgggcatcttcgttttctgcacagaaccacccccgccgcccgactttcttcccccagttactcatcgcgatatctatgttttaatgtctgtgtttctctact

SEQ ID NO: 1929 - DNA, 471 bp, Homo sapiens
  CDS 41..220
  sig_peptide 41..187: Von Heijne matrix score 3.90000009536743 seq PLLCVNLTSPALA/PL
acttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtacatgtcccttgctgtgtgtgaacttgaccagcccggccttggcccccttgtggctgcagcctgtagtgatggggccgtaastctttcttttgcaggattctgggcggattctgcagctccttgctgaaaccttccaccataagcgatgtgtcctcaaggtccactcctttacacacgaggcacccaaccagaggcggaggctcctcctgtgcagcgcastactgatggcagcctggctttctgggatctcaccaccatgctagaccatgactccactgtcctggagcctccagtggatcctgggcttccctaccggctttgcaacccc

SEQ ID NO: 1930 - DNA, 488 bp, Homo sapiens
  CDS 13..360
  sig_peptide 13..354: Von Heijne matrix score 3.90000009536743 seq AWALWTGWRPSQC/GS
gtcagaatcaccatggccagctatccttaccggcaggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtgagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgctcatgatgat

SEQ ID NO: 1931 - DNA, 535 bp, Homo sapiens
  CDS 269..418
  sig_peptide 269..331: Von Heijne matrix score 3.90000009536743 seq LLTTMLSLQGLRP/SL
tttgggtgcgtgagaagggaagggtggatcctaaaagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccatgctgagtctgcaaggacttcgtccaagcctttccgtccaggacctcaaacagatccaatcacaagaagagagatttcaggaaagagaaaattattcctatcatcggggtttttgaaacacatgaaatgactgggaaaataatcatgttaagtggaaaaaaaaaagaaatctatctgttgtaattttcaaataatttttaaataaatttgaaaaattaagagaacttaaa

SEQ ID NO: 1932 - DNA, 509 bp, Homo sapiens
  CDS 241..495
  sig_peptide 241..309: Von Heijne matrix score 3.90000009536743 seq AVGRILLCRPGWS/AV
gattatctaaagtagaacagtttcatcccaaaaacatcctaccaccctggtctgtgaaaaaactgtcttccataaaaccattccctagtgccaaaaaggctaaaaatctcatagagagatttttttaatcaacaagtagaaattcttggcagacgtgcagaacaattacctcaaatatactatattgaaggtactctccaaatggtttggattaatcgctgctttccagkaatggaatgaatgtccagcaacatccaaaatgtcctgagtgctgtgggacggatcttgctctgtcgcccaggctggagtgcagtggcgggatctcggctcactgcaagctccgtctcctgggttcacgcccttctcctgcctcatgsgcccgagcagctgggactacaggsgcccaccaccgtgcccggttgtgtaggatggaatcttccagagctgcatgggggaatggaggtgggacagtgtgatctgcagccctggatcatataacccccgtgatg

SEQ ID NO: 1933 - DNA, 451 bp, Homo sapiens
  CDS 105..287
  sig_peptide 105..182: Von Heijne matrix score 3.90000009536743 seq LTLKSLEAGWTLS/GP
taatgtcctggatatttcttgtggcagggggtggtcaaagagcctgattgctgacccagtctcaggcctgtggtcgatgacctctcggtagtttcaaagggggcatggggatatttgacttgtttttttcgaaatgtagccttctaaccctcaagtctttagaagctgggtggactcttagtggtcctgcagcgtatcctaaaagactacctttgaaacaggattcttgtatggccaggatcgtgtctgggaacagaaaccctacaccctccccctccagggaatgctgagttccagttttgagcagaggtgaggcagaatccactgtagccttccgcsctggtatttggggggatgaccagcccaggcgttgggtgttagtctgcatgagtttgtgagaggaaatagctgggtgtcctggcagtgccttgaagttggttaggaccttcct

SEQ ID NO: 1934 - DNA, 530 bp, Homo sapiens
  CDS 1..291
  sig_peptide 1..159: Von Heijne matrix score 3.90000009536743 seq SYILSLYLHVSLS/IG
atgattatatgtgatttagaacacttgctatttatgtctgatcccacaaatcagcactcactttatttgcaaagcaccaaatttcgtgtaagaggtgtagtaattgggaatgtgaagctaagttacattctttctctttatttacatgtctccctttctataggcctctttttccccccctttttgagacggagtctctggtcgccaggctggagtgcagtggcgcaatctcagctcactgcaacctccgactccctggttcaagcaattctcctgcctcagcctcctgagtagctgggattacaggcatgcaccaccacgcccagctaatttttatatttttagtagagacaaggtttcaccatgttggccaggaaggtcttgatctcctgacctcgtgatctgctcactttggcctcccaaagtgctgggattacaggtgtgagccactgtgacctgcctctataggcttcttaaaccatttactcaaggcatatgtcagaccctggtcaaagtaatacaaaaaaggt

SEQ ID NO: 1935 - DNA, 542 bp, Homo sapiens
  CDS 189..464
  sig_peptide 189..266: Von Heijne matrix score 3.90000009536743 seq KECLVVLLPSIGA/KY
  misc_feature 61..62: n=a, g, c or t
tttggactctcccctcttatgtacctcttttagtcattttgcttcatagctggttcctgcnnaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtcttgtggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcgacscacagaaagagagcactgaccccgatggcgatggactactgaagccctaactcaagccaaccttactttacagcataaggggagcgtagaatctgtgtagacgaaggggggatctgg

SEQ ID NO: 1936 - DNA, 650 bp, Homo sapiens
  CDS 344..577
  sig_peptide 344..553: Von Heijne matrix score 3.90000009536743 seq YWMVQTWLLGCGA/GW
aaaaaaacgataaactagggaaagcgccccattgcctggcacgtggtgggtgcgcaataactgttaggtgactttcctcgagtggcttatcaaagctttacccaagctgagaaacactagagcatcagtaggatgagactctctatggactccttgatctctcccctctaagctctcctctcattgaggactcactggcagtctgttataatatctgaacattctacttcaaatcagccctgcacgttggaagggctggcttctgtccccttgaaggggaagaaagatttgaacataccccagcctgaggatgccactatagcctgcgtgttctcatgtgctaatggctaggagctgtgactttccattgagccgggacccagccagatctcaaaacaaggagccaggagagacacctcaactatgttctccttcaccccttcagtctgttgccggtgcttgcctttggctgagctctactgaaaaccagaagacaagaaagttcagcttgatgtactggatggtccaaacctggcttctaggctgtggagcaggttggagaaaacgtagggaagattagggtgggagaaggaagctattcagcataaagagagatctccatactcagcaaaaaaaaaaaaaaatgcgaa

SEQ ID NO: 1937 - DNA, 302 bp, Homo sapiens
  CDS 34..195
  sig_peptide 34..189: Von Heijne matrix score 3.79999995231628 seq LGAVAGACSPSCS/GG
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaaaaaaa

SEQ ID NO: 1938 - DNA, 471 bp, Homo sapiens
  CDS 84..296
  sig_peptide 84..131: Von Heijne matrix score 3.79999995231628 seq AFSLYMWPSNILC/LE
acctccctccctgccttcccttccttcctgccttccttcttccttcctcccttttttcttttctcccttccttccttcttaatatgtttttggccttttctttatatatgtggcctagcaatatcctgtgtttggaaaagtataaacctaaggcatcacctttacagaaaatatcttccacggaaacatctaaaggccacagatcagccctggggttcagagggatcctgacagctactcctcaagatcctctctgttgtgattcatccccccggggccctacagtttctccttcctgactcttacatttctttggatggcatcattatttacctgtctcctcccatagttaggtgccaagcactgtggattctgcctctcagtgtccagacacccattttccttcccactgttccttcccatggagaagcctgtggtggtctgacagcagagagagatgctcaacttgga

SEQ ID NO: 1939 - DNA, 294 bp, Homo sapiens
  CDS 34..195
  sig_peptide 34..189: Von Heijne matrix score 3.79999995231628 seq LGAVAGACSPSCS/GG
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaattggctgggcgcggtggcgggtgcctgtagtcccagctgctcgggaggctgaggcaggagaatggcctgaacccaggaggtggagcttgcagtgagctgagatagtgccactgcactccggcctggtgaaagagcgagactccgtctc

SEQ ID NO: 1940 - DNA, 294 bp, Homo sapiens
  CDS 34..195
  sig_peptide 34..189: Von Heijne matrix score 3.79999995231628 seq LGAVAGACSPSCS/GG
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctca

SEQ ID NO: 1941 - DNA, 427 bp, Homo sapiens
  CDS 8..169
  sig_peptide 8..145: Von Heijne matrix score 3.79999995231628 seq ISFLPLLAASTLP/HI
ttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaataaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgcttttttttttttaactgg

SEQ ID NO: 1942 - DNA, 302 bp, Homo sapiens; identical to SEQ ID NO: 1937
  CDS 34..195
  sig_peptide 34..189: Von Heijne matrix score 3.79999995231628 seq LGAVAGACSPSCS/GG

SEQ ID NO: 1943 - DNA, 310 bp, Homo sapiens
  CDS 34..195
  sig_peptide 34..189: Von Heijne matrix score 3.79999995231628 seq LGAVAGACSPSCS/GG
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcgagactccgtctcaaaaaaaaaaaaaaaaa

SEQ ID NO: 1944 - DNA, 281 bp, Homo sapiens
  CDS 34..195
  sig_peptide 34..189: Von Heijne matrix score 3.79999995231628 seq LGAVAGACSPSCS/GG
taaaaggaagttcttggccgggcgcggtggctcatgcctgtaatcccagcactttgggaggccgaggtgggtggatcacgagatcaggagatcgagaccatcttggctaacacggtgaaacccatctctactaaaaatacaacaaattggctgggcgcggtggcgggtgcctgtagtcccagctgctcgggaggctgaggcaggagaatggcctgaacccaggaggcggasttgcagtgagctgagatagtgccactgcactccggcctggtgaaagagcg

SEQ ID NO: 1945 - DNA, 654 bp, Homo sapiens
  CDS 195..530
  sig_peptide 195..521: Von Heijne matrix score 3.79999995231628 seq RLLPHAGADGCWG/QR
agtgcgcactggcgtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccagaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctcgaaaaaaaaaaaaaaaa

SEQ ID NO: 1946 - DNA, 521 bp, Homo sapiens
  CDS 139..330
  sig_peptide 139..279: Von Heijne matrix score 3.79999995231628 seq FILGIMQNQPSSG/DE
ctttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactgtagcctaagaaagagacttttcttcctgtttttctctctccccattttttggggtaagttttgcaaagatcagtgctgc

SEQ ID NO: 1947 - DNA, 1013 bp, Homo sapiens
  CDS 333..482
  sig_peptide 333..443: Von Heijne matrix score 3.79999995231628 seq LHSFCLESTDCLS/QR
agaagcgaggcagccgtgagsggaggacaggctgggggatcccaaagggtgcgctccagcccccaacccaggcactgactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccgggatgaagctgtgccaccctgtaggaattagaagaccatgtccaggaattgagcactgggtgcaggatccagtcttctgaggccctgaaaccacatgaagcaacttagccgtctcgccttgcggcctggaacccctggcaatttccggagcaccggcaagagacttttgcacagtttctgcttggagtctaccgactgtctgtctcagaggtctggacagctgcttgttacatttggctcacgctagcttaaaaaaggaatttatggaccttactgcagaacgtcccaattcttcaggccaaggtgcctgtgttcctgctcggtttctggattgcttggtacttaaatgaaacatcttattaatcatttcccgggaatgctgtgcaggcaaaaggaaaacaaaggcattaggagccacataagctgctggatcaattctgccctgacaccaacctctccacgaaatagagattcgagaataaatgtgaaggtaaccagggaataaaactgtttgagaagtttcacaaaagaagctgaactctgctaatcagaaagtagatccatctttaattccgaaatgaccgcacagcaattcagcagtccagaggacaggcagagtttctcagccccggggtggaatggatggcttcctatctctgtcctgccaaggctgcgttctcacatcttccaaaatgtccattaaccccagctggcccctcaccccaccaagatgatgtaaatataatgattaaccaattcaaaaaaaaaaaaaaaa

SEQ ID NO: 1948 - DNA, 510 bp, Homo sapiens
  CDS 285..506
  sig_peptide 285..500: Von Heijne matrix score 3.79999995231628 seq FLEAFGLSAHAHS/SH
tcctagcggcggaacggtgggcggagggagagaaagctgccgtctcgagtgcggaggcaggctgagagctcctcgaggaagcgaggctgagtcctgcaggaattctcaagtactgtattgatatttctgtagtaagcttaaaagagaattaatacaagcacagtccgtatcgcgtggggttaccgtcttccaatggagtctggttacacgtttatgagacttggagccaagaaatactactcgcttgtcgagggctactgagaaaagaataaagacggtcataaatgatacatgatgccttagagtcaagagaaggccagatgctgtcttggtgcgctgtacaagggaaggtattgcacaagtttggagcgagaggaatgggagacattcgcaatccttccacagccggtggaggcaggccaacctcacagaattgcacggggcacgtgcattcctgttcttttctggaggcgtttggtctttcagcacacgctcattcatcacattaat

SEQ ID NO: 1949 - DNA, 472 bp, Homo sapiens
  CDS 122..271
  sig_peptide 122..262: Von Heijne matrix score 3.79999995231628 seq VCPMLATPGWGLG/RS
  misc_feature 19: n=a, g, c or t
cacgcagccttccttcggnttcggcasagacaggcatccgccgccgccggccgcagcccacccgcccctccagcagcccccgctctgsgtgaaagtcttcccagcgtccagtgcagcgcaaatgcagattccagcatcccagtgccgtctagatggagccaagacgcctgcagaaatacgggggctgccgggcctcctgggtcaggagagctgtagggcccatgtctgtcccatgctggctacaccgggctgggggctgggaaggtccgtttagtttacggatctttctccaccagcccacggcagcctccttgggccaggaccacgtctgagtcgcccctgtccccccaggcccagcttggtgcttgctggtcgagacctctgtgggttcccaggggtgccctgggggccctctcaggcatggccccttttgaggggggccgccctcccgtgtttctcctggtctggggcg

SEQ ID NO: 1950 - DNA, 533 bp, Homo sapiens
  CDS 206..403
  sig_peptide 206..319: Von Heijne matrix score 3.79999995231628 seq ACYLSPSPPPLTS/RT
  misc_feature 525: n=a, g, c or t
ataaacaaaatagtatgcaacttacagcaatgtctctcccacttataataaaacacctaactctcatgtagcattttatccatattgagagctctgtgagatagaaattattatattacaagtcacagatatgtaaactgagatgcagagacatcaataacttgctcaaggttacaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagccggcttgccagcactgacagcaacaagcagaacctgcggcagtntttgaaga

SEQ ID NO: 1951 - DNA, 427 bp, Homo sapiens
  CDS 82..297
  sig_peptide 82..132: Von Heijne matrix score 3.79999995231628 seq GFVAALVAGGVAG/VS
aaacatggcggcgccagcggcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttaataaggctggtggttttcatggaatatatgctggcgttccttctgctgctattggatcctttcctaatggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagatc

SEQ ID NO: 1952 - DNA, 479 bp, Homo sapiens
  CDS 189..347
  sig_peptide 189..251: Von Heijne matrix score 3.79999995231628 seq GLLSTAASSVSYC/LR
attttattctttttgatgctactgtaaatggaattgttttcttaatttcctttttgaattgtttagtatatagacatgcaactaatttttgcatgttggttttgtatcctgcatccttgctgaatttattagctgtgtgtgtgtgttgtgtgtgtgtgtaatctttagggttttctacatatgaaatcatgtcatcttcaaaccagaggcaaggcctcctgtctacagcagcttcctcagtttcctactgccttaggaggcccctgcttgtgctcagggaaggcctcttcatgggcatgttcctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgcaaccctgtacagaatcgagtgctgtagcct

SEQ ID NO: 1953 - DNA, 515 bp, Homo sapiens
  CDS 133..327
  sig_peptide 133..315: Von Heijne matrix score 3.79999995231628 seq STCASFSFSSSFS/FL
aacctcaaggagccctgttgtgctaccgactgcagagctcatggacatccatcaggaagcctccaatacccaaaccaggggtagttgcctaatccatatccatgtggatagctctttacttaggaaaccttgatggcttatttggatgacaaaggttcccttttggcgatacatagccatgcgagacaacatagccatgaaacaaaccaagtccaccagtggcttcctaggaacacatttgctttcctgataaaagaggacagatgcagttgcagaagtacctgtgcctctttttctttttcttcttctttttcttttttaatctcttaaatgcagatataagaactggtactgaagcagccatcttgtgaccataaggaagaagccaagaacatcagaaccagtggcctagccattgcacagtcatctaaacacacctctggacttgttattatgtaaaaaaaaataaacacctgctcttgttatttgcaatccaaaaaaaaaaaaaahtgcra

SEQ ID NO: 1954 - DNA, 509 bp, Homo sapiens
  CDS 133..327
  sig_peptide 133..315: Von Heijne matrix score 3.79999995231628 seq STCASFSFSSSFS/FL
aacctcaaggagccctgttgtgctaccgactgcagagctcatggacatccatcaggaagcctccaatacccaaaccaggggtagttgcctaatccatatccatgtggatagctctttacttaggaaaccttgatggcttatttggatgacaaaggttcccttttggcgatacatagccatgcgagacaacatagccatgaaacaaaccaagtccaccagtggcttcctaggaacacatttgctttcctgataaaagaggacagatgcagttgcagaagtacctgtgcctctttttctttttcttcttctttttcttttttaatctcttaaatgcagatataagaactggtactgaagcagccatcttgtgaccataaggaagaagccaagaacatcagaaccagtggcctagccattgcacagtcatctaaacacacctctggacttgttattatgtaaaaaaaaataaacacctgctcttgttatttgcaatccaaaaaaaaaaaaaa

SEQ ID NO: 1955 - DNA, 506 bp, Homo sapiens
  CDS 189..347
  sig_peptide 189..251: Von Heijne matrix score 3.79999995231628 seq GLLSTAASSVSYC/LR
attttattctttttgatgctactgtaaatggaattgttttcttaatttcctttttgaattgtttagtatatagacatgcaactaatttttgcatgttggttttgtatcctgcatccttgctgaatttattagctgtgtgtgtgtgttgtgtgtgtgtgtaatctttagggttttctacatatgaaatcatgtcatcttcaaaccagaggcaaggcctcctgtctacagcagcttcctcagtttcctactgccttaggaggcccctgcttgtgctcagggaaggcctcttcatgggcatgttcctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgcaaccctgtacagaatcgagtgctgtagcctggccagaccccagagcccttgtgccat

SEQ ID NO: 1956 - DNA, 482 bp, Homo sapiens
  CDS 16..243
  sig_peptide 16..231: Von Heijne matrix score 3.79999995231628 seq VLVEIGFHHVAQA/GL
agtttccatggtgagatggtcaacaagcctgtacggagtctcgctctgtcgcccaggctgaagtgtagagtgcagtggcatgatctcagctcattgcaacttccacctcctgggttgaagcaattcttctgcctcagcctccggagtagctgggaatacaggtgcaggctgccacgcccggctcatttttgtgttttagtagagatagggtttcaccatgttgcccaggctggtctcaactcctgagctcaggcaatcctcccgccttagcctcccaaagtggtaggattacaggcgtgasactgcacctggccctcgactcacagattttcaaaatacttttgaacagtaagctgaggacagtgtttattatgactatactggtctcctttcactagctcacaaaatttaactacatcacttgtcagtctcctaaaaatgcagtgtatgtgctttgaaacttgtgaatgatctgcctgatt

SEQ ID NO: 1957 - DNA, 486 bp, Homo sapiens
  CDS 195..407
  sig_peptide 195..371: Von Heijne matrix score 3.79999995231628 seq LDFLGSSDPPSSA/SQ
atttgcacgtatttcttcttcatttcaactcaggcccatgtattattgagagagctccggatatagtttgggatagagatttccatcttgagagatgggagcagcagcttctgacaaaattgctgggttggcagggtttgcagaaaaagcagtttgagcctgagttacattgtcttccttcaagtcttcaagagatggatagagagacatttttgcaggattcttctagctcacaaggacccactcgctgccgctgtcgcctccggtcactggcaccgacttctgaggcccgagggctggagtgcagtgatgtgatcgtggcttactgcagccttgacttcctgggctcaagtgatcctccttcctcagcctcccaagtgtctaggactacaggtgagctcccagattagaggtgagggagttgggaagacaagacataaccaagccctatacaccaatgccaactcagtctcactctgtcactca

SEQ ID NO: 1958 - DNA, 479 bp, Homo sapiens
  CDS 189..347
  sig_peptide 189..251: Von Heijne matrix score 3.79999995231628 seq GLLSTAASSVSYC/LR
attttattctttttgatgctactgtaaatggaattgttttcttaatttcstttttgaattgtttagtatatagacatgcaactaatttttgcatgttggttttgtatcctgcatccttgctgaatttattagstgtgtgtgtgtgttgtgtgtgtgtgtaatctttagggttttctacatatgaaatcatgtcatcttcaaaccagaggcaaggcctcctgtctacagcagcttcctcagtttcctactgccttaggaggcccctgcttgtgctcagggaaggcctcttcatgggcatgttcctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgcaaccctgtacagaatcgagtgctgtagcct

SEQ ID NO: 1959 - DNA, 450 bp, Homo sapiens
  CDS 80..301
  sig_peptide 80..166: Von Heijne matrix score 3.79999995231628 seq VNCGLHLVIQTSS/LP
ctctttcgggtctctttgaatctccgctgtagcgtcacctggaagcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcaattgtcatcatttcctattcttcaacgttcttctgaagagaaaattctttactcagacag

SEQ ID NO: 1960 - DNA, 552 bp, Homo sapiens
  CDS 171..419
  sig_peptide 171..257: Von Heijne matrix score 3.79999995231628 seq XVFMTVAAGGASS/FA
catcgtccgtgcgcaccgcccggcgtccaggtgrgtctcccatctgcagagacgcggacgcgccggcccgcagttggcctgcggasgcggtggacggtttggcgcccaccaggcgatcaatactttggatttttaatttctagatttggcaattcttcgctgaagtcatcatgagctttttccaactcctgatgaaaaggaaggaactcattcccttggwggtgttcatgactgtrgcggcgggtggagcctcatctttcgctgtgtattctctttgraaaaccgatgtgatccttgatcgaaaaaaaaatccagaaccttgggaaactgtggaccctactgtacctcaaragcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtatcgataccgtcgaa

SEQ ID NO: 1961 - DNA, 668 bp, Homo sapiens
  CDS 98..634
  sig_peptide 98..187: Von Heijne matrix score 3.79999995231628 seq LDSLLALGGLVLL/RD
ataatcacctctcattccagactatgttaggtcttaatggtgggaggacgcccgagtgctcggcccgtttcaccccgaggaggaaggacactgggtcatgacgccatcagaaggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtcaaaaaaaaaaaa

SEQ ID NO: 1962 - DNA, 508 bp, Homo sapiens
  CDS 209..397
  sig_peptide 209..319: Von Heijne matrix score 3.79999995231628 seq LAISALRARTATG/SP
actataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagcatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggaacagcagcacggcactgccacccggctgctgatggctggtgcagctsggagtcctcc

SEQ ID NO: 1963 - DNA, 482 bp, Homo sapiens
  CDS 248..469
  sig_peptide 248..382: Von Heijne matrix score 3.79999995231628 seq STMLTSYILPVSS/DT
ctttttttttcgcgtctgsggtgcycggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgcctttatttgttggttcacaggttagagcagccagc

SEQ ID NO: 1964 - DNA, 534 bp, Homo sapiens
  CDS 93..341
  sig_peptide 93..263: Von Heijne matrix score 3.79999995231628 seq LLLRVSLFQVERA/IR
ccgccattggattttcacatttcacatgttttgacagtcaaccttttggtgttgcctaagtaaggagtagctatttactcatttaaagtttcatgttactaagtgacaggacacgtacagttattaggtgttactgtagtgacagacaggtgtgtaggtacattcacttgactccttttatagatgtaagtcaaagggtcagggaagcaaagggagctctgttattgttgttacgtgtaagtctatttcaagttgaaagggcaatcaggatcaaaacaaaagaaaatctccagtgtgaaatagcaaaggaagagaagggggagtgggaaaaagacattcattagctttttcttgtaccagaaagtcttttagtttctttcagtggcagagaaaaaaaaaacacgataggttaaatgtacttttttttgagacgaggwcttgctttgttgtcwaggctagagtgcagtggagcattcawggctcactgcagcctctaccwcctggactcaagcagtcwcagcctcagcctcccaa

SEQ ID NO: 1965 - DNA, 491 bp, Homo sapiens
  CDS 206..403
  sig_peptide 206..319: Von Heijne matrix score 3.79999995231628 seq ACYLSPSPPPLTS/RT
ataaacaaaatagtatgcaacttacagcaatgtctctcccacttataataaaacacctaactctcatgtagcattttatccatattgagagctctgtgagatagaaattattatattacaagtcacagatatgtaaactgagatgcagagacatcaataacttgctcaaggttacaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagg

SEQ ID NO: 1966 - DNA, 497 bp, Homo sapiens
  CDS 17..391
  sig_peptide 17..307: Von Heijne matrix score 3.79999995231628 seq LANQFLAPGVCQP/QP
gtagggccgggcgataatggcggcgtcgaggctggagctaaacctggtgcggctgctatcccgctgcgaggcgatggcagcggagaaacgggacccggacgattggcgcctggagaagtacgtgggagccctagaggacatgttgcaggccctgaaggtccacgcgagcaaaccggcctctgaggtgatcaatgaatattcctggaaggtggattttctgaaggggatgctgcaasccgagaagctgacctcctcctcagagaaagcactggccaaccagttcctggcccctggcgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtctgcagctgagctagacctcgt

SEQ ID NO: 1967 - DNA, 549 bp, Homo sapiens
  CDS 252..440
  sig_peptide 252..362: Von Heijne matrix score 3.79999995231628 seq LAISALRARTATG/SP
aatagtcccagcggattctctctcgtgtcgggccgccctcggggtcctttctcttcacggcccatctttgatgctgtcttcagaattgccggacgcaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggttagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataagtgccatcttcagctaccactgcaaggccctgagggcaacagcagcacggcactgccacccggctgctgatggcctggtgcagctgggagtcc

SEQ ID NO: 1968 - DNA, 609 bp, Homo sapiens
  CDS 142..411
  sig_peptide 142..366: Von Heijne matrix score 3.70000004768372 seq LLLRLQSTAQLIQ/MQ
catcattcttcatggactmctttcactcctttaacaaaaaccttgcttccttatcccacctgatcccagtctgaaggtctcttagcaactggagatacaaagcaaggagctggtgagcccagcgttgacgtcaggcaggctatgccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcagkgggttggagactcagcaggctccgtgcagcccttgggaacagtga

SEQ ID NO: 1969 - DNA, 708 bp, Homo sapiens
  CDS 29..367
  sig_peptide 29..292: Von Heijne matrix score 3.70000004768372 seq LGELAMVLDQIEA/EW
cttttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggccaagatcttggagcatgatgatgtgagctacctgaagaagatcctcggggaactggccatggtgctggaccagattgaggcggagtggagaagaggaagctggagaacgaggggcagaaatgcgagctgtggctctgtggctgtgcttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgacwrmmaaaaaaaaaaaa

SEQ ID NO: 1970 - DNA, 496 bp, Homo sapiens
  CDS 126..350
  sig_peptide 126..290: Von Heijne matrix score 3.70000004768372 seq TQLLAAVWLTTRS/SP
gtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcagtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtct

SEQ ID NO: 1971 - DNA, 488 bp, Homo sapiens
  CDS 7..186
  sig_peptide 7..111: Von Heijne matrix score 3.70000004768372 seq LCITVWFCFFCCC/LF
tcatagatgggaacttttgttttcagtgcaaacaatgttggagctgtaatagtaagagctttcttaacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgaaaaaaaaa

SEQ ID NO: 1972 - DNA, 570 bp, Homo sapiens
  CDS 92..340
  sig_peptide 92..325: Von Heijne matrix score 3.70000004768372 seq NLLTAFFSSPSTS/TF
tcaagaatatggatagtttaccttctggtaargrkrsatcgaaaagtgaaaataatattaggacgaaatagaaaagaaaatctggaaccaaatgctgaatttgataaaagarctcgwrattttttyacacgrgrrgaaaacagaatttgtagttcaccggtacagtcttttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttaagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtaaaaaaaaaaaaaaatgcgaaaagctt

SEQ ID NO: 1973 - DNA, 467 bp, Homo sapiens
  CDS 229..405
  sig_peptide 229..270: Von Heijne matrix score 3.70000004768372 seq VLACYVLFSYSFS/YK
cagcagccctcgcgcggtccggcacagcggacaccaggactccaaaatggcgtcagttgtaccagtgaaggacaagaaacttctggaggtcaaactgggggagctgccaagctggatcttgatgcgggacttcagtctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcgctccgcaaataccactgaagaggacacactctgcacccccccaccccacgaccttggcccgagcccctccgtgagaacacaatctcaatcgttgctgaatcctttcatatcctaataggaattaacctccaaataaaacatgactggtacgtgtgmmaaaaaaaaaaaaaaaaa

SEQ ID NO: 1974 - DNA, 502 bp, Homo sapiens
  CDS 233..424
  sig_peptide 233..385: Von Heijne matrix score 3.70000004768372 seq LVATLQSLGATVC/PR
aaacacatccaagcttaagacggtgaggtcagcttcacattctcaggaactctccttctttgggccacggaattaacccgagcaggcatggaggcctctgctctcacctcatcasgcagtgaccagtgtggccaaagtggtcagggtggcctctggctctgccgtagttttgcccctggcacaggattgctacagttgtgattggaggagttgtggccatggcggctgtgccatggtgctcagtgccatgggcttcactgcggcgggaatcgcttcgtcctccatagcagccaagatgatgtccgcggcggccattgccaatgggggtggagttgcctcgggcagccttgtggctactctgcagtcactgggagcaactgtatgcccccgacccccgcagaggcagaatgaacccatagggagctgatcgtaatgtttatcatgttacttccccacccctacattttttgaaataaaataaggaattttaaaaaaaaaaaaa

SEQ ID NO: 1975 - DNA, 470 bp, Homo sapiens
  CDS 99..410
  sig_peptide 99..401: Von Heijne matrix score 3.70000004768372 seq APLLLSVLLVPFA/QV
tttggtcatcaccaggattacaccaggaagcaaggcgcagctgccaacctgtgtcctggagatgtcatcctggctattgacggctttgggacagagtcatgactcatgctgattcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccggattgactgtggcagtggacgcagcaccccttcttctgtcagtactgttagtaccatttgcccaggtgacttgaaagttgcggctaagctggcccctaacattcctttggaatggacttcctggtgtgaag

SEQ ID NO: 1976 - DNA, 398 bp, Homo sapiens
  CDS 80..238
  sig_peptide 80..175: Von Heijne matrix score 3.70000004768372 seq LMPVISALWEAEA/GG
taagattaggcttaacactaagcctcttacaaacttcaagttttcaaaaaggctcaaggttttctggtacagaggtactatgggagcacagttcagatttaacttaacattacgttatttaggccaggcacggtggctcatgcctgtaatctcagcactttgggaggctgaggcgggcggatcacgaggtcgggagatggagaccatcatggctaccacggtgaggccccatatctactaaaaatacaaaaaattggccgggtgtggtggcgggcgcctgtggtcccagctacccgggaggctgaggcaggagagtggcgtggacccgggaggcggasttgtggtgagccgagatcgcgccactgcgytccagcctgggtgatagagcgggactccac

SEQ ID NO: 1977 - DNA, 478 bp, Homo sapiens
  CDS 203..433
  sig_peptide 203..397: Von Heijne matrix score 3.70000004768372 seq LTFSLGLSFIIYT/RR
actgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacagcagcgcagtgggaacgggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgaca

SEQ ID NO: 1978 - DNA, 491 bp, Homo sapiens
  CDS 19..474
  sig_peptide 19..66: Von Heijne matrix score 3.70000004768372 seq YAAAAGVLAGVES/RQ
gtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattaatttcaaggagacaa

SEQ ID NO: 1979 - DNA, 450 bp, Homo sapiens
  CDS 15..221
  sig_peptide 15..197: Von Heijne matrix score 3.70000004768372 seq PVSLTGLTLVVVA/AQ
gattttggctgaaaatgaaaccgggtaacgctcctgggcctctcccgggtcaagggtctccaggtcccgctgcctcggcgtggatctcggacccagagactcggggagacccgggcggtccgtgggggatgtggaggggtagtgacctgcgcccccggccggtgtcactcacaggcctcactctggttgtagtagccgctcagggtccgcagttcactcggtaaaactgtgctttggccttggcggtccctgtctcctcttcccaatattccggcccctcctgctccatccacggcgcccgcggctccatcctgggactcgtggcgtcgctgtcgagccgcacgcactgcgtgtcgtccacgtcgcccacggagaggaagcgggatccgcgcggccgggccgggacatggtggtgtggaaatacctcaaggagtggaagcctggggagca

SEQ ID NO: 1980 - DNA, 370 bp, Homo sapiens
  CDS 97..327
  sig_peptide 97..207: Von Heijne matrix score 3.70000004768372 seq RIVSAALLAFVQT/HL
gtgggcaacttgcccttctcaaacatggccgccacggcgcctctggaagggaaccgctctgggccccgcctttgatctcgttggtggggctgggggatgagagctgcaccgcgcgggacaagtcgccggcggccccgacggagcagaagagagagcatggagctggagaggatcgtcagtgcagccctccttgcctttgtccagacacacctcccggagccgacctcagtggcttggatgaggtcatcttctcctatgtgcttggggtcctggaggactgggcccctcggcattycargaggagaacttcgatatggaggctttcactgagatgatggaggcctatgtgcctggcttcgccacatcccca

SEQ ID NO: 1981 - DNA, 334 bp, Homo sapiens
  CDS 64..234
  sig_peptide 64..147: Von Heijne matrix score 3.70000004768372 seq VVFTLGMFSAGLS/DL
agtaggtcccggcaaccgcaggctcgcggcgggcgctgggcgrggwtccgactctagtcgttaatggaggcgggckgctttctggactcgctcatttacggagcatgcgtggtcttcacccttggcatgttctccgcyggcctctcggacctcaggcacatgckaatgacccggagtgtggacaacgtcagttcctgccctttcttaccayggaagtyaacaacctgggctggctgagttatggggctttgaagggagacgggatcctcatcgtcgtcaacacagtgggtgctgcgcttcakaccctgtatatyttggcatatctgcattactk

SEQ ID NO: 1982 - DNA, 471 bp, Homo sapiens
  CDS 41..352
  sig_peptide 41..193: Von Heijne matrix score 3.70000004768372 seq VLCSGLFSHSAKS/HH
tagctaaaaattgagggttctaaatactaaggaagaagggatgaatagatattgtggcaagatatttgtctctgtcatggttaaattgcaaaaaaataaacttacctccttccccaggcagccattgttaacattttttgaatatctagaaaaagtcctttgttcaggattattttcccactctgccaagagtcaccatgacctgctcacacgccacccttatgaaactgccgcgccacttctcagctcccatttgattctcacagaagctctacgaaatgggttgggcaaatgtcatgatcctcatttcacaggggaagaaactgaggcccagagggggaaactgactacctaaaattgccatgtaggccggcgcggtggctcacgcctgtaatcccagcactgtgggaggccaaggcgggtggatcgcgaggtcaggagatcgagaccatcctggctggcacttgaagc

SEQ ID NO: 1983 - DNA, 512 bp, Homo sapiens
  CDS 180..455
  sig_peptide 180..401: Von Heijne matrix score 3.70000004768372 seq IASFGLLSALTLC/YM
gatctgcaatgaattttagttttcctttgtaacatttctgagaggagatctctgtgccttttgaagaaaaactcttagggtgagagaagaaggagtaggtaggtgggcagataaatgagaggacatcacaggaaaagaacctgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaaccta

SEQ ID NO: 1984 - DNA, 834 bp, Homo sapiens
  CDS 385..768
  sig_peptide 385..552: Von Heijne matrix score 3.70000004768372 seq KWSLCQVVWAAQG/SG
  misc_feature 820: n=a, g, c or t
attagcacctggcactaggcggagagaggcggtaagcgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaaccggaaacaggaaactacaactcccacaaggcctagggcacgtcccgccgtcctcggctgctgagcctgatgggacaagtagttttgcgaacggcttaacctacagattgaagaggtcggaagctctgaggcccggggcttccggagtcgcggagatggaattggagcagagagaagggaccatggcagccgtgggctttgaggagttctcagcgccgccagstcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgcagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgggagtgctggactcctacggggatgactaccgggccagccagttcaccattgtgctggaggatgagggcagccangggcacggatgccc

SEQ ID NO: 1985 - DNA, 507 bp, Homo sapiens
  CDS 83..325
  sig_peptide 83..292: Von Heijne matrix score 3.70000004768372 seq MLPLPLSVCFCLS/LS
tattctctttggattaatctgccttgaactctttgctgagggctgtgggtgacaggattaggcacatataggattgtgggacatggggagctttttcctccctaaaaggggaaactcgagagctgatgataccactggaaaatatcccttttctactgacaagcagctgcctgaacttttcagtgtcactgcaatgggtgggtctttctgtggtctccctgagcacctggccttccccaccctgcctcaagcaatgcttcctctccctctctctgtctgtttctgtctctctctctctgtatgtgcaaactggttgaatgaacggtaaaaatcattgtttatctcctccgtaaaagtttagattaatggaaaaaaaggatttgtgaggctagtcctaagctatagtgaatctggtgtgctttgtgtgtctttctgtattgctctgccataaagaggggtatcataggatggaacatggtcttaggacacctgtaagccgactgttcc

SEQ ID NO: 1986 - DNA, 491 bp, Homo sapiens
  CDS 7..258
  sig_peptide 7..90: Von Heijne matrix score 3.70000004768372 seq IFCCFFLLRRSXL/SP
ttaaaaatgtcctgtgcaggtgttggtgagggtaaattgaaaacattttttattttttgttgtttttttttattgagacggagtcyactctcgcccaggctggagtgcagtggcacgatctcggcccactgcaagttccgcctcccgggttcacgccattctcctgcctcagcctcccgagtagctgggactacaggcggccaccacggcgcccggctaattttttgtatttttggtagagacggagtttcaccgtgttagccaggatggtctcgatctcctgtcctcgtgatccgcccgcctcggcctcccaaagtgctgggattacaggcgttaaaggcaattcacatgtcttccttggatttgtcagggatggcaggtgtatacattgggttagtagatgaggatattatacagactttctatttaagacatttctattttaatatgaaatatattaaaaggtgggaagatcactcgagcccaggagt

SEQ ID NO: 1987 - DNA, 413 bp, Homo sapiens
  CDS 102..398
  sig_peptide 102..212: Von Heijne matrix score 3.70000004768372 seq SLLSLCFLRTAGV/WV
  misc_feature 230,371: n=a, g, c or t
avcccagccccgcctcttctccggcaggatcgcggccgagcagtctgcccagagacttagcgacagacagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtanctctgggtccttggtcccatctacctcctcttcatccaccaccatggccggggctacctccggatgtccccactcttcaaagccaagatggtagctgccatccctgggagcctggaaccaggcaatgttcgggggaggcangggacaggctggaacctggtgaagtcttaaagtagaactcct

SEQ ID NO: 1988 - DNA, 350 bp, Homo sapiens
  CDS 98..331
  sig_peptide 98..313: Von Heijne matrix score 3.70000004768372 seq VVSTTGFSIKAXA/IP
  misc_feature 308: n=a, g, c or t
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcangtgccattccargaatgccatcttgaatgtaaaaggaacttg

SEQ ID NO: 1989 - DNA, 458 bp, Homo sapiens
  CDS 52..255
  sig_peptide 52..192: Von Heijne matrix score 3.70000004768372 seq LLFERVFLLGLDG/GD
ttatctgatattggtgtgtagtgggaattgtaggtttgtaataagacagacatggatttcagtcctggtttcatttctagatttgtatttgtacctcattttgcaagtaatgtacataaagcacaatgtattggcactcaatacatgataccattattatttgagagagtttttttgcttggtttggatggaggtgattatcgccttctttgttgctcgctacacatgctgttaaagttggctttccgcttttcctaatagaataactactgccatgcctcctcacctctagaggcctagatgccatacagcgagcagtccctctgtatctgtggggaattggttccaggacccccataggtaacaaaaccagggatgttcaaattccttatgtaaaatgacataatatttgcatgtaactgcatacattcttctatatactttaaattgtttctaga

SEQ ID NO: 1990 - DNA, 487 bp, Homo sapiens
  CDS 76..339
  sig_peptide 76..228: Von Heijne matrix score 3.70000004768372 seq FLVEMGFHHVAQA/GI
kktttttgttgttgttctgttttgttttttttgcgactgagtctcgctttgtcacccaggctggagtgcaatggcatgatctcggctcactgcatcctccgcctcccaggttcaagtgattctcctgcctcagcctcccaagtagctgggatcactggtggacaccaccaagcccagctaatttttgtatttttagtagagatgggatttcaccatgttgcccaggctggtattgaactcctgacttcgggtgatccactcgccttggcctcccaaagtgctcacattacaggtgtgagccactgtgctcggcatcttccccccaccgcgctttttttttgagatggagtcttgctctgtcgcccaggctacagtgcagtggcgcacgatctargttcactgcaagctccgcctcccaggttcacgccattctmctgcctcagcctcactagwagctgggactacaggtgcccaccacaacgcctgg

SEQ ID NO: 1991 - DNA, 538 bp, Homo sapiens
  CDS 162..356
  sig_peptide 162..212: Von Heijne matrix score 3.70000004768372 seq LGYFLSTCRFVAG/RA
  misc_feature 384,475: n=a, g, c or t
agctgcggaatccagtcaggttcctaaatgttgctccttagcacgctgtgaactttgccccacactcattagcatcagtgtttagggtgggttaggacatcagtaactgttgatctgagactgctgaccctttctgagtcctgggcattaaataacagaagatgatgtggggattaggttattttctatccacttgtcggtttgtagccggacgagccacagacaagaaccgctcagacaccgagttatggaaggaaagggctttattcagctgggagcattggcggactcacatcttcgaaaaccgagctcccggatatcatcgagaaaggagaagaacactgtggacatctaattgaggcccacaaggaatggcatgacganscctaggatttaaaatatgaaatggtggtctsctgtgtgaataaataattcctgaagaatgaagaagattaattttgggagttctttgacnraactttratatgtgraaaaaktatttataatttattgtaagragaaagtaaaatattactag

SEQ ID NO: 1992 - DNA, 453 bp, Homo sapiens
  CDS 236..391
  sig_peptide 236..328: Von Heijne matrix score 3.70000004768372 seq LMPVVPALWEAEA/GR
tgaaggaagatgagggagtgtgacacatttggggaacggcaagaagttaggtaggagcggctgggttatagcatcttgtgcatcacgctcgggaatttggacttgatcctgaagatgatgggatccactagaatattttaggtgaagggacagtgggggccagtcagggtttgaagatcactttagcagcagcatggagcatgggctgaaagtgggggagtccaaacaaccctgaatgcctgaaactgatgtgtacttaagagatatctgtcagggctgggtgctgtggctcatgcctgtagtcccagcactttgggaggccgaggcgggcagatcacttgagttcaggagttcaagaccagtgtggccaacatggcaaaccccatctctatgaaaaatacaaaaattagccaggcatggtggtgcatgcctgtaatcccagctattcccaga

SEQ ID NO: 1993 - DNA, 486 bp, Homo sapiens
  CDS 301..477
  sig_peptide 301..408: Von Heijne matrix score 3.70000004768372 seq QWAMIASLHSSLS/DR
  misc_feature 452: n=a, g, c or t
cattcatagatctataactaaatgtcagttttgttttgcttttaacttttggggaagggataagtaatgcaaataatttgacattttagactcacaggatgattgttgaggagctgttaaatcatttaactttaagatagatcttagcctcacgtggtggctcatgcctgtaatcccagcactttgggaggccaaggtgagaagatcccttgagtccaggagttcgagaccagcctgggcaacatggtaaggcctcgtctgtactaaaaataaaatcaaattacctgggtgtggtggcacatgcctgtggcctcagctgcttgggaggctggggcgggaggatcgcttgaacccaggaggtcaaagctgcagtgggccatgattgcatcactgcattccagcctcagtgacagagcaagaccctgtcccaaaaaacaaaaccaaaatacaancaaacaaaaacaacccatagatccatagatcttt

SEQ ID NO: 1994 - DNA, 482 bp, Homo sapiens
  CDS 99..290
  sig_peptide 99..206: Von Heijne matrix score 3.59999990463257 seq LASLAGSQSXSAS/AS
aaaacttctgtgacaacctgtgagagggtctgaggtgtttgtgtgtggaggggattatcagtgaggagagatgcccagctcctcctttgccttctgccatgattgatttctgccttctcgaggcctcctccgaacctgagcagatgccagtgagaggtgacaacgtgctagcatccctcgctggctctcagagcycctcggcctcggcgtccactctagccacgcttgagaagcccttcagcccgccgctgcactgtaggagcccctctctgggctggctggcgtggagctgagtgtggaattaaatcttgctgttgctcactctttgggtccgcactgcctgtatgagctgtaacagtcgctgtgaarrtctgsagcttcactcctgaagccagcaaaaccatgaacccagcagaaggaagaaactctgaacatgtctgaacatcagaaggaacaaactccggacacatcatcttcaagaa

SEQ ID NO: 1995 - DNA, 621 bp, Homo sapiens
  CDS 150..569
  sig_peptide 150..239: Von Heijne matrix score 3.59999990463257 seq LLLQAPSGEFVNA/FD
gaccttgccagactgcctgctttcacggatagacataaaaaccttcagcttgaatgttaacaccttgatgggaaaggtggctcatggaatgttttcttatcctttgaacactcctcatttcagaagctttgcttctgttgcaaccaaacatgacacttagcgtgctgagcaggaaggacaaggaaagagtaattcgcagactgttattacaggccccttcaggggaatttgtaaatgcctttgatgatctctgtctgcttatccgtgatgaaaaacttatgcaccaccaaggtgagtgtgcaggccaccaacactgccaaaaatattctgtaccactctgcatcgatggaaatccagtactcttgtctcaccacaatgtaatgggcgactaccgattttttgaccatcaaagcaaactttctttcaaatatgacctgcttcaaaatcagctgaaagacatccaaagtcatggtatcattcagaatgaggcagaatacctgagagttgttcttctgtgcgccttaaaactgtatgtgaatgaccactatccaaaaggaaattgcacatgctgagaaaaactgtcaaaagtaaggagtacttgatagcttgcattgaagatca

SEQ ID NO: 1996 - DNA, 511 bp, Homo sapiens
  CDS 94..276
  sig_peptide 94..189: Von Heijne matrix score 3.59999990463257 seq SICISLNCPRASA/MN
tacttagccttgtccctacctctttactcctctgtaggcagtaattcttttttcttttctttctttttttttcttttggtgtaacagtatcgcatgagccaagactgtcatgaaactatttggatactgtactctggttccttcatctcctccatctgcatcagcctaaattgtcctagagcctctgccatgaacccggggataagtgaggaaagaaatttttcctccttcacagtatcaagtgccaggccagggcactttgtccaggcctcactgtgaagaaagagtaatgttcaaggatggcagcaggaaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagacaaaaaaaaaaaaaaaaaaaaaaaaaaaaaaatgcgaa

SEQ ID NO: 1997 - DNA, 477 bp, Homo sapiens
  CDS 94..276
  sig_peptide 94..189: Von Heijne matrix score 3.59999990463257 seq SICISLNCPRASA/MN
tacttagccttgtccctacctctttactcctctgtaggcagtaattcttttttcttttctttctttttttttcttttggtgtaacagtatcgcatgagccaagactgtcatgaaactatttggatactgtactctggttccttcatctcctccatctgcatcagcctaaattgtcctagagcctctgccatgaacccggggataagtgaggaaagaaatttttcctccttcacagtatcaagtgccaggccagggcactttgtccaggcctcactgtgaagaaagagtaatgttcaaggatggcagcaggaaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagacaaa

SEQ ID NO: 1998 - DNA, 543 bp, Homo sapiens
  CDS 211..534
  sig_peptide 211..333: Von Heijne matrix score 3.59999990463257 seq LLLTLPVPEGLHS/PW
attcatttcctttttgtttttgttgttgatgtgaccgcgtgtccacaaccctgggattccctcgccctcagattccagaatccaatttcttggatttcagtgtttttaaggtgggaggtctcgctatgcttcccaggctsgactcaaattcctgggctcaagtgattcccccgcctcagcctcctgagtagctgggactacagatatggcatgtcagtctggtggtctagccagaggaagactcctggagctggtgaactgtgcatggatatgcagtcacgggcagcccacctcctactcctcaccctccctgtgcctgagggtctgcactcaccctggtcttgctttattgcccaggctggagtacagtggcgcaatcacggctcactgcagcctcaacctcttgggcccgagcaatcttcccaccttggtctcctaaagtgctgggataacaggcatgagcaccacatctggctgaggcccacattttcattttgtgctgagacttgtaaattaggtagctggtcctggctgtagcagatg

SEQ ID NO: 1999 - DNA, 355 bp, Homo sapiens
  CDS 6..164
  sig_peptide 6..137: Von Heijne matrix score 3.59999990463257 seq AQLACGRLSPSSS/RS
aaaaaatggcggttggtgtgtcctcggtttctcggctgctgggtcggtcccgcccacagctggggcgcctatgtcgagtggcgcccatggcgaagagggctcagctcgcatgtggaagactctcaccttcttcgtcgcgctccccggggtggcagtcagcatgctgaatgtgtacctagaagtcgcaccacggagagcacgagagacccgagttcatcgcctaccccsatctccgsatcaggaccaagccgtttccctggggagatggtaacsatactctattccataaccctcatgtgaatccasttccaactggctacgaagatgaataaagagaatctggaccastacccgg

SEQ ID NO: 2000 - DNA, 497 bp, Homo sapiens
  CDS 119..304
  sig_peptide 119..244: Von Heijne matrix score 3.59999990463257 seq SFCTWCLHQSLYA/CV
ttataagctcatcccagctgttctaaaagatatgtcaaatttaaatttcagtaagcagttctgttttacaagtaatagattcataaataataaagttgtaacttgcgagatatgagggatggtgagactaggccttaaccaaatcagtttgtctgtttccctgatacaatggaaagttgaacctaaaagtaaatggaagtttagtagtttctgcacctggtgtttgcatcaaagtttgtatgcctgtgtgactagaggctatctttttaatggtaactgtctcttattgtgtcttatcgcaatttaaaaccatcacaccaaattcttatcaacagtctgcactccataagtgagccctgtcatcattactccctggggacctctgatcaaggctggtacaatttggtacaaaaatactcaattttgaacctaatttctcttggcagtagagagacagtcatttgctatcatttctcctcattcctgttaatattatt

SEQ ID NO: 2001 - DNA, 486 bp, Homo sapiens
  CDS 106..348
  sig_peptide 106..159: Von Heijne matrix score 3.59999990463257 seq LQCXLAACPSSWX/WA
acacaagcsgctttaggagcgaggttcggagccatcgctgctgcctgctgatccgcgcctagagtttgaccagccactctccagstcggctttcgcggcgccgagatgctgtcctgcsgcctccagtgcgsgctggctgcgtgtccatcgtcctggyyctgggctgtgtcaccggcgctccctcggaccccagactccgtcagtttctgcagaagtccctggctgctgccgcggggaagcaggaactggccaagtasttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacc

SEQ ID NO: 2002 - DNA, 453 bp, Homo sapiens
  CDS 7..234
  sig_peptide 7..162: Von Heijne matrix score 3.59999990463257 seq IVGLCSFPQPSRL/XG
  misc_feature 292..293,316: n=a, g, c or t
catctgatgttaaattcttacacttgctttctctttgttaccgtttgtttgatattttttcatcctttgattttcaacctttttaatgtagttttgagttatatgttctcgggmaaaccacatatagttggattgtgttcctttcctcaacctagcagactcagkggttttttttggttgttkgtttttagagacagggttttgctctgtcacccaggctggagtgtagtggcgtgaccatagctcactgtaactgaaaactcctgggttcaagccatcatcctgcctcagnntctcaagtagctaggactacavnbwtgcaccaccatgcccagctaacagactcagtcttttaatacactatattttaatggttagtttaaaattaacatatcttttataatatgcatagaattaacttccaaatcctctagttgtttttcttccttaaca

SEQ ID NO: 2003 - DNA, 567 bp, Homo sapiens
  CDS 98..340
  sig_peptide 98..250: Von Heijne matrix score 3.59999990463257 seq ICFVCGVFFSILG/TG
acttccggctggtctgtggggtttcgggttcggggtttcctggtgggcgtcaggggcaggcaacagagtggcggccgctacggcctggaacggggccatggagaagctgcggcgagtcctgagcggccaggacgacgaggagcagggcctgactgcgcaggtccttgatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttascagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctc

SEQ ID NO: 2004 - DNA, 490 bp, Homo sapiens
  CDS 108..350
  sig_peptide 108..260: Von Heijne matrix score 3.59999990463257 seq ICFVCGVFFSILG/TG
gcgggaccggacttccggctggtctgtggggtttcgggttcggggtttcctggtgggcgtcaggggcaggcaacagagtggcggccgctacggcctggaacggggccatggagaagctgcggcgagtcctgagcggccaggacgacgaggagcagggcctgactgcgcaggtccttgatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttascagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgc

SEQ ID NO: 2005 - DNA, 626 bp, Homo sapiens
  CDS 211..570
  sig_peptide 211..378: Von Heijne matrix score 3.59999990463257 seq LQIALGLAXPLLX/DL
atttctgagccgatgcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaaacagcctgtcggaccacagcctgggcatctmamcggagcaaaacccctgtggacgacccgatgagcctgkstatacaacatgaacgactgctactccaagctcaaggagctggtgcccagcatcccccagaacaagaaggtgagcaagatggaaatcctgcagcacgtccatmgactacatcttgggacctgcagatcgccctgggactcgcathcccactattgtsagacctgcatcacccagagacccggggcagaaccaggcgtccaggacgcggcttgaccaccctcaacacgggatatcagcatcctgtccttgcaggtaagacctgctccggggtccccgcmccgcmgccgcacactcccgcggtcgtctgggctgtcactaggagatccgtagcccagacggtgactttcgtatgagctatttaactttattttcttcagaatctgctgtagattgagctgtgcgtgta

SEQ ID NO: 2006 - DNA, 800 bp, Homo sapiens
  CDS 403..792
  sig_peptide 403..510: Von Heijne matrix score 3.59999990463257 seq PLLWGLQCQSARA/GC
  misc_feature 778: n=a, g, c or t
aacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaaagtagaacttattgaccttgscggatccggatgcagcagaatgtgttcttgcctttgcgaagattcctccaccaaccccccaggtcgtctggtatgccccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcstcctcctcctccgactcctccaccaacctgcatagcccaaatccaagtgatgatggagcagatacgcccttggcacagtcggatgaagaggaggaaaggggtgatggaggggcagagctggagcctgcagctagcagtgggnccctgactacagactgaccacg

SEQ ID NO: 2007 - DNA, 432 bp, Homo sapiens
  CDS 79..297
  sig_peptide 79..216: Von Heijne matrix score 3.59999990463257 seq FLLCQQWGRKTSA/LR
ataaacctaatcatcgcaaggcacacggttttcatttcaactgcctttaatcctgcggcccctgagaaaggagatgtgatgacatctcttcaaagtgcgaggccaagtctgctgggaaatggccacagatttctcatggaaaaggacggcctggagcctttgaacagggtctgtgtcttcctcctgtgtcagcaatgggggaggaaaacgagcgcactacggggtaaaggaggtcacccaagatctcaagttcacgagtggcagcctggattcaagtccctgcctgcctccagaacctgagctctgaaacgctggactaatcagaacctcttggccctgaaaaatgaggcctattgaacaaagacatttgtgagaaaagggactattacaacctagtgtaaagtaacaagcaaataaaaaatgaaatggcaa

SEQ ID NO: 2008 - DNA, 495 bp, Homo sapiens
  CDS 58..228
  sig_peptide 58..186: Von Heijne matrix score 3.59999990463257 seq LLLQCSLFQFIAT/PS
atttttctactttgataagtcccaaaatgatatcttctgtttatattcaactttagaatgccagacctgtcatctctagctgcctatctcagaggcaccttaaattcaacctgttcaaagatcatcttgtgccttaacccagattcactgcttctccaatgttccctgttccagtttatagcaacaccatcctcagtttctcattccaaaagcccaggagtaatgtgctgaggataacagtgaacaggagttggctctgtgaaggacctgaaatgtgaggaggacagactgagagaagatcacctgcaaactctctgaagcagatggtgtagtctgtgtagcactagaatgcagatgtccacttcacatgatggtgtgagtttgcacagggccatttccttggtgacctgtgtgtcctaaatccaaggggactctcccagaacattctgttgtgataaagattcttgggattttctgattcctgagatgggaaga

SEQ ID NO: 2009 - DNA, 522 bp, Homo sapiens
  CDS 125..373
  sig_peptide 125..259: Von Heijne matrix score 3.59999990463257 seq LIFMTNTVNAVLA/SG
aaaaatctcattacggatcccggctgaaagccattttgtttttcagctcacttcaagggtacctgaagcgaattggcaccaaagcagcagctgtattgccgcagttctagcttcaccttcmacgatgtttcccttggtcaaaagcgcactaaatccgtctccaagtttcgaagcatttcagcaaacaaatggcaaggcagagccaccagaaacgttacacctgattttcatgacaaatacggtaaatgctgtattagctagtggagccactttctgtattgttacatggacatatgtagcaacacaagtcggaatagaatggaacctkgtycccmtgttggcagagttaccccaaaggaatggaggaatcyagtaatcatcccagctggtgtaataatgaattgtttaaagaaacagctcataattgatgccaaaattaaagcactgtggtacccatttaatatatggcattattgaaagaaataaagtacatttgaaaccttcaaaaaaaaaaaaaaaagg

SEQ ID NO: 2010 - DNA, 421 bp, Homo sapiens
  CDS 148..315
  sig_peptide 148..273: Von Heijne matrix score 3.59999990463257 seq ALTHIFSMPGTQP/AR
ttttaacactagggggctggcccactaggagggctggccctaagatacagacccccccaactccccaaagcggggaggagatatttattttggggagagtytsgasggsgagggagaatttattaataaaagaatctttaactttaaatggtttggagaggcagtgatccccgactgactcccctgagctggagggagggagtgagtcagccagccgcgggggcgggggtgagggctctgactcacatattctcaatgcctggaactcagccggcaaggacctggctggccctaacagttttccagggaagatcttgaggagaaaccccagcatcccgcgcctctgccctctccaccatccccaaaagccccaggttccagactgaagccttcctttgctcagcaatctttattcagttct

SEQ ID NO: 2011 - DNA, 514 bp, Homo sapiens
  CDS 295..474
  sig_peptide 295..363: Von Heijne matrix score 3.59999990463257 seq SFLRCHDSSPAWA/VV
aaatccatccatctgagatggggtcctgttgtttattatcactctagaagttatacattgatatttattctttctgtccccacgttgtgcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagccctggatcctgtcgatctttacttgtggcggastaatggtcacattgatagttgattacactgtggcacgaattaatgcagaacactgttattaataaaggaagtaaagggctgcaagatttgagagctgca

SEQ ID NO: 2012 - DNA, 461 bp, Homo sapiens
  CDS 62..244
  sig_peptide 62..157: Von Heijne matrix score 3.59999990463257 seq SICISLNCPRASA/MN
gtaggcagtaattcttttttcttttctttcttttttttttcttttggtgtaacagtatcgcatgagccaagactgtcatgaaactatttggatactgtactctggttccttcatctcctccatctgcatcagcctaaattgtcctagagcctctgccatgaacccggggataagtgaggaaagaaatttttcctccttcacagtatcaagtgccaggccagggcactttgtccaggcctcactgtgaagaaagagtaatgttcaaggatggcagcaggaaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagactctaaaaaaaaaaaaaaaa

SEQ ID NO: 2013 - DNA, 481 bp, Homo sapiens
  CDS 219..374
  sig_peptide 219..323: Von Heijne matrix score 3.59999990463257 seq LEPGLSSSAACNG/KE
  misc_feature 30: n=a, g, c or t
aattattcacagatagtaccctagtaaganaaagaaggtggagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaakraggagattcttcaattgagctggaacctgggctgagctccagtgctgcctgtaatgggaaggagatgtcaccaaccaggcaactccggagtgccctggaagtcattgcctgacaataactgatgttcccgtcactgtttatgcaacaacgagaaagccacctgcacaaagcagcaaggaaatgcatcctaaatagcaccattaagtcttttgtcaa

SEQ ID NO: 2014 - DNA, 518 bp, Homo sapiens
  CDS 271..426
  sig_peptide 271..375: Von Heijne matrix score 3.59999990463257 seq LEPGLSSSAACNG/KE
atttgacaatgtctatagacattttgggctgtcacaattttgggagaggggtactctttgcatccagtgggtaaaggccttgaatgctgcgaaacatcctacagtgcacaggacagtatcctccctccccagctaagaactatctgatcccagctgtgaatagtgtcatggttrwgaaaccctgaattagaaggataactgttacgaaggagaaataaaggttgctatgaaaacttagataatgggggttataaaagttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggagtgccctggaagtcattgcctgacaataactgatgttcccgtcactgtttatgcaacaacgagaaagccacctgcacaaagcagcaagaaaatgcatcctaaatagcaccat

SEQ ID NO: 2015 - DNA, 462 bp, Homo sapiens
  CDS 218..373
  sig_peptide 218..322: Von Heijne matrix score 3.59999990463257 seq LEPGLSSSAACNG/KE
  misc_feature 29: n=a, g, c or t
attattcacagatagtaccctagtaaganaaagaaggtggagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggagtgccctggaagtcattgcctgacaataactgatgttcccgtcactgtttatgcaacaacgagaaagccacctgcacaaagcagcaaggaaatgcatcctaaatagcac

SEQ ID NO: 2016 - DNA, 479 bp, Homo sapiens
  CDS 218..379
  sig_peptide 218..322: Von Heijne matrix score 3.59999990463257 seq LEPGLSSSAACNG/KE
  misc_feature 331,441: n=a, g, c or t
attattcacagatagtaccctagtaagaaaaagaaggtggagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatntcaccaaccaggcaactccggagtgccctggaagtcattgcctkacaataactgatgttcccgtcactgtttatgcaacaacgagaaagccacctgcacaaagcagcaangaaatgcatcctaaatagcaccattaagtcttttgtca

SEQ ID NO: 2017 - DNA, 635 bp, Homo sapiens
  CDS 284..439
  sig_peptide 284..388: Von Heijne matrix score 3.59999990463257 seq LEPGLSSSAACNG/KE
acttgcgtgtcaccgttaccgtagcgactgggcttctggactgtatatcctagctgccttgtcaacatcttcgagcatcggcagctccggagccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcaractcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggagtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgagaaaa

SEQ ID NO: 2018 - DNA, 502 bp, Homo sapiens
  CDS 184..492
  sig_peptide 184..243: Von Heijne matrix score 3.59999990463257 seq RVLLTWLFTLLFL/IM
gttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattyattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgtaaactggaacagtttactaccatgaatctatc

SEQ ID NO: 2019 - DNA, 603 bp, Homo sapiens
  CDS 54..350
  sig_peptide 54..116: Von Heijne matrix score 3.59999990463257 seq QVTLLGSVIFTFQ/HT
ataacgaattttgagaggttggtaaaaggagattggaaascagaaggtgatgaatggmtgaagatgtcataccctgccaagtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagcgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaattttctatgtatgtgatgtgaaatgaagactatatatatggaatggaggtgacagaaagaaagaaattctttgtttgagggagacttcccctttctggattgtatttgtagagtgttacgagtgtatcatgtgat

SEQ ID NO: 2020 - DNA, 473 bp, Homo sapiens
  CDS 14..469
  sig_peptide 14..244: Von Heijne matrix score 3.59999990463257 seq LTLTATSYPLSST/IH
gtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagctaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgagacgggaggctggtagagaagacaacctatgac

SEQ ID NO: 2021 - DNA, 515 bp, Homo sapiens
  CDS 7..330
  sig_peptide 7..168: Von Heijne matrix score 3.59999990463257 seq LTHLLLPASEGDT/EP
aatcttatgaacagaaccaggacagggaggctggccggagttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggagtgcagaaagccaggaccaagagacaggcagctcaccagggtggacaaatcgccagagatgtggtaagtgatcaagggtccctgagatgacacagactccattcccttcatcttctcaagaaaagcgctcaagggccaggcatgatggctcacacctgtaaccccagcactttgggaggctgaggcgggaggattgcttgagcccaggactttgagaccagcctgggcaacataaggagaccctgtctctatt

SEQ ID NO: 2022 - DNA, 436 bp, Homo sapiens
  CDS 104..367
  sig_peptide 104..343: Von Heijne matrix score 3.59999990463257 seq ILSFWSRAGWLLA/LP
gaccgccggcaactgttgtggctgccgcattgctcccgccggctgtagctgggcgastgggggccggtgagtttgagttcctgagatctagttggtgagagacatgatgttctactggttgctgtcgattgttggaagacaaagagccagcccaggatggcagaactggtcctctgcaagaaacagcgcatcagctgccgaggcgcgttcsatggccctgccacccaggcacaggtggtcgtctgtggaggtggaatcacgggcacttctgtggcccatcaccaatccaaaatggggtggaaggatattgtccttttggagcagggcaggctggctgctggctctaccaggttctgtgctggcatcctgagcactgccaggcacttgaccattgagcagaagatggcagactactcaarcaaactctaccatcagt

SEQ ID NO: 2023 - DNA, 229 bp, Homo sapiens
  CDS 24..185
  sig_peptide 24..86: Von Heijne matrix score 3.59999990463257 seq RLHACLCVCGLDS/QG
ggaattagaatccccaactgagtatgcgcaaggtcgcgctggccagccgtcttcacgcgtgtctctgtgtttgtggactggattcacaaggtcatgagactgggttaggcccagccttgacgccatatgctttggggaggacaaaacttttaagtacagtcaacgacaagacttgtactcaaggttgagatttaataaaattaatatttttactaaaaaaaaaaaaaaa

SEQ ID NO: 2024 - DNA, 594 bp, Homo sapiens
  CDS 161..589
  sig_peptide 161..502: Von Heijne matrix score 3.59999990463257 seq AIALIGVCVFILA/II
aaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatcctcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgact

SEQ ID NO: 2025 - DNA, 465 bp, Homo sapiens
  CDS 32..187
  sig_peptide 32..118: Von Heijne matrix score 3.59999990463257 seq ALSMHDLCAWISS/LP
aaccaagagcttttggtggtcatcactgaagatggaaactgtggcagatggaagtctctgcttcttgaagagaaactatgcattgagtatgcatgatctgtgtgcctggatatcatctttacctgctttgttctgtatgttgtcaaagaggatcgctttggggagcattgtgtctgtacactctggatgaacccctttgaagcaggagagccagcacactggacccagctgattctaaggagcagagtggatggcccattatactcagaacccttggcatccaaattgtcagcaactcatcagctagtgtttcttccttgaagggcgaagtctcaatcctcaaatgttctaggaggtgtgctggagtttgctggaggtccactccagatcctttttgcctgggtatcacaagtagaagctgcagaacagcaaagattgccacctgctccttcctctggaagctcc

SEQ ID NO: 2026 - DNA, 466 bp, Homo sapiens
  CDS 88..312
  sig_peptide 88..198: Von Heijne matrix score 3.5 seq FFFFISKLLPVFS/MM
  misc_feature 289: n=a, g, c or t
tgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctcctttttttcttctttctttttttttttcatttcaaaattgctgccagtgttttcaatgatggacaacagagggatatgctgtaragtgttttattgcctagtttacaaagctgcttttgaatgctggkggttcwattcctttgaanctacgcacttttawaatacatgttaatgctatatgacaaaatgcyctgattccwagtgccaaaggttcaattcagkgtatataactgaacacactcatccatttgkgctttkgtttttttttatggkgcttaaagtaaagrgcccatcctttgcaagtcatccatgttgttacttag

SEQ ID NO: 2027 - DNA, 525 bp, Homo sapiens
  CDS 21..290
  sig_peptide 21..149: Von Heijne matrix score 3.5 seq RVLGLXLQEEGRG/CP
rsrrcttwtagtcaagagggatggcctctcgaaacagwgggggtgacctggaggatcttagcattccaggcacaatcctagcctsgcctgggagaactgccactcagatgagggtcttgggcctggygctccaggaggagggaagagggtgcccctggagagacgkggcgctcccattttacatcctccagatagctctggggccacgctcctgtgctccaactccattgagtcctgcatgcagctcggtgttccccggccacatcgtaaaaagatttacaagactatgttaaactggcaggatcctccactgggctctggagttcagaggttcaaggttaaagtgaaaagaaggctgagcatggagacaacaggagacttcaagtcccacttgacagttcctggctaagtgatcctaaacaagcstcttaacctctctgagactcagtatgcccatctatgcaatgagaatttgtaacaataaatcaaaaagcctcctctgccaaaaaaaaaaaaaaatgcgaa

SEQ ID NO: 2028 - DNA, 345 bp, Homo sapiens
  CDS 57..248
  sig_peptide 57..134: Von Heijne matrix score 3.5 seq MCVLGXXSRVAFA/CR
tttggttttctttttccattttgggttccttttgtttcaggcacggataacagcaaatggaattctgtatttattattatttaagtgtagcgcagatgtgtgtgcttgggsgtrtttctcgtgtcgcgtttgcgtgtcggctcttgcggtggagtcctgttgctgtgagggagtgctggccgcasagcctcgagtcaccgccaggctcacaggctgtgccacccgtcsctccgacagctccaatactgtgaccctccttcctcaggaagcgcgttgaacccacagcactccgtggtgtgtttgcagggtgatttcctaataaaagtccactctgactgtgaaaaa

SEQ ID NO: 2029 - DNA, 470 bp, Homo sapiens
  CDS 53..454
  sig_peptide 53..241: Von Heijne matrix score 3.5 seq ILQGAGAAAAATA/VN
gttttcccatggagaagcttgaaagcccccttacctgtcacagcttcatctcatgcctcgatgtagcctatcagaccgccggtgggcgccccagccaaggaggacaaggatagggcggaactacggaggatgcggggtgcgtagatcctgctgggataatccgtggggcggcaagcgctatacagccgccgtctccccagtgatactgcaaggtgccggtgccgccgccgccgccactgcagtaaatcagctgacaccagccccaactgccgtgactttcgctgcaactgtcgcaaaaatgagggggcgggaaagactcaccatttccctacatgcaaagcctaagccggcgccgagagagccagccgcgttacgatggagaccgaaagtggagaaaaggccagctgtgggcaaggagtgcacggccgccatcttggttgtgggaagtctcgtctaggctgtcctctctc

SEQ ID NO: 2030 - DNA, 534 bp, Homo sapiens
  CDS 174..530
  sig_peptide 174..317: Von Heijne matrix score 3.5 seq VMVVAGVVVLILA/LV
ataacagcttccgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagaaccagctcctgggcgctattgtgtcagcaggcgacacatccgtcctccacctggggcatgtggaccacctggtggcaggccaaggcaaccccgagccaactgaactcccccatccatcagaggacaagcaggtgcaggcagcagcagtccagaggcccccctgagatctgag

SEQ ID NO: 2031 - DNA, 291 bp, Homo sapiens
  CDS 130..288
  sig_peptide 130..234: Von Heijne matrix score 3.5 seq GLVEVVAVGVVRS/DQ
agtctctgtcggagtctgtttcccagtgcacccaacttgtgatagaaggtatatgttctgctgaaaaagagaaaaaggaaaaaaaagaataaaagcagagagcagagaaggacagggtctggctgccgcatggaggggaggagcaggagcaggaaagcctgtctggaggttgctacagtaaaccaggtcttcgtggggttggtcgaggtggtggcagtgggggtggtgagaagtgatcagattaagaatatgtatttaaaatacagccagcatgatctgctgatggactag

SEQ ID NO: 2032 - DNA, 450 bp, Homo sapiens
  CDS 187..342
  sig_peptide 187..276: Von Heijne matrix score 3.5 seq VKLLLKMVSSATT/ER
attctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtga

SEQ ID NO: 2033 - DNA, 558 bp, Homo sapiens
  CDS 221..466
  sig_peptide 221..337: Von Heijne matrix score 3.5 seq SLLKLGHLMSSSC/RW
gaatgtatgtgggttctggctgatggtgccattttggtaacatcttctggtgcacctgggaaaccataggtcatcatgatgttgagttttatatttcaagttgcctgggcctgtgggtgcccagattaacattatttctggctgtgtctctgagggtatttctgtaagactagcagttgaattggttgattaagtaaagtaggttgcatttccagtgtggatggggctcatccaatctgttgacggccagaatagattgaaaagtagagaaaggcggaattcatcactttttcttgcctcacttcttaagctaggacatcttatgtcatcttcctgtagatgggttgacatttacatcatcagcttccatggtttttgggcatcgggactcgaaccaaattatcccaccagctttcctgggtctgccagcttgcagagggcagattatggaacttcacagactccataattgctaagaaggccactgggagtattctccaaagcagtgtcttcctgatggaaagtgagaagaacattctatgtggtgatggagagggc

SEQ ID NO: 2034 - DNA, 506 bp, Homo sapiens
  CDS 22..357
  sig_peptide 22..183: Von Heijne matrix score 3.5 seq PLWVTRLSDLVFS/KE
atagaatatacacaaaaggaaatgagaaagaaatgtaaatgcttcactataaaaaaaacaaatacatacgaagaaagtaatgcaggaaatgaaggacaaaaagaagctataagcatttgtatttgcagaagagatggtttacttcctctgtgggtaaccaggttatcagatttggtgttttccaaagaaaaggcacatggcatgattccacttcttggctcccatagggaaaagaagacaagtaaagagatgaagacttcttccaggaacctgaggtacttcattgtctgcagagatgcctcatcctacacccctcagtcactcatatctggatacattggaccttgtcaacatcaataatggacatacctctgatatttgaactctgaatctcactctgtgaccacaactttgtatctttctaagtctttaatcttcaacctcacagaactcttcataccctaaaatatagtattttcacctggaaaaaaaaaaaaaaatgcgaa

SEQ ID NO: 2035 - DNA, 492 bp, Homo sapiens
  CDS 102..377
  sig_peptide 102..239: Von Heijne matrix score 3.5 seq FLVETGFLHVGQA/GL
tacaccttcacatttttatttatttatttttatttttattttttgagatggagttttgctgttgttgcccaggctggagtgcaatggcgtgatctcggctcatggcaaccttcacctcccaggtgcaagtgattctcctgcctcagcctctgagtagctgggattacaggcatgcaccaacatgcccagctaatttcgtatttttagtagagacagggtttctccatgttggtcaggctggtctcaaactcctgacctcaggtgatccgcctgcctcggcctcccaaagcgctgggattacaggtgtgagccaccgtgcccagcctacatcttcacatttaaatactaatttggctggacacaaaattctttataattaaaaaaagggaacttttaacttagaatattatgtcaactcaaactggcattcaaatggaaagtcattctccattcttataatatactttactggtaattagatttattagaagc

SEQ ID NO: 2036 - DNA, 587 bp, Homo sapiens
  CDS 266..502
  sig_peptide 266..403: Von Heijne matrix score 3.5 seq LIRCLLRTFVSQT/RE
tttacccaccatccaaaaaaattaaatggaaaattctagaaataaacaattcataagtttttagtcatgtaccgttctgagtggcctggggaaatctcctgcgctcctgctccacctcgccttggatacaaatccttcttttgtccagcatatccacactttctacccacccatctgttagtaacttcatagccggctcaattaccaggtggactgctgtggtattgcagtgcttatgttcaagtaacccttcttttacttcatcatggcctcaaagcacgagagtagtgatgctgacaatttggatataccaaagagaagctgtaaaatgcttcctttcagtgaaaaagtgaaagttctacatttaataaggtgtcttctacgaacatttgtttcccaaaccagagaaacccttattcactcattaaccattgggatttttgttcaaaggcccatgaattattgctactttaaatttgcaagcaaatttataattggatcctgatgtcccagcacccataaatattttataataattgtacaaacaacacttacattaaggacatgaacgattaaaatagggagac

SEQ ID NO: 2037 - DNA, 507 bp, Homo sapiens
  CDS 36..224
  sig_peptide 36..182: Von Heijne matrix score 3.5 seq WMFWAMLXATATT/TY
acagtcgcgtgctagactccggacccgccagtggtatggctgagccgactagtgatttcgagactcctatcgggtggcatgtgtctcccgagctgactcccacgttagggcccctgagcgacactgccccgccgcgggacagctggatgttctgggcaatgctgscsgcmaccgccaccaccacttacgtcctcgcttcccgcagccgggtcaaagccttcctctgagtcgcagccccccatggaggcccagtctctccccggggctccgcccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcagttaaaaattcttattatccacgaaagtatgatgcaaaattcacagacttcagcttacctc

SEQ ID NO: 2038 - DNA, 466 bp, Homo sapiens
  CDS 128..367
  sig_peptide 128..223: Von Heijne matrix score 3.5 seq LYFTLCNMRGLHA/SS
  misc_feature 68: n=a, g, c or t
tgaggataaactagtgtctactaaaaaggtagaaaaagtcacttcacacgccatagtaaaggaagtcncccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttt

SEQ ID NO: 2039 - DNA, 480 bp, Homo sapiens
  CDS 157..318
  sig_peptide 157..300: Von Heijne matrix score 3.5 seq LQKLCFSPSRILG/CD
tgcvggatccaaaggcttacacagagtagggtgccgctctgacgcccaagagcsaawtagaagagggtagcctccgcgctaaagctggggcgctggggagccccggagaaaccaacgtttcctagtctgtggctcagtccctacttccggctcccgatgcgcasagcgggagggcgacgccggcaccgcggcgactcctggagccgaggccacggtggaagcgcgaatgggaggtggagcggascactgcgccgagggacgcttcagaaactctgtttcagtccttcgcggatcctaggatgtgacaggtgttcgagttaaagggtcttaagccaatcgtttgatccaaaagcagctgaatctttaggagccccaggcaggaggatcgcttgaggccaggagttcgagaccaccctgggccacagagggagagcccatctctacaaaagaaattttacaaatcagccgggcatgatggcg

SEQ ID NO: 2040 - DNA, 501 bp, Homo sapiens
  CDS 115..288
  sig_peptide 115..171: Von Heijne matrix score 3.5 seq ILVNLQSSNEVLT/SY
acaattgttcaaatgcaggtacatattatatagacagatcgaaaccttgggggctgctaatgtgagaagataaatccctcctcataaaacgagtattagtagcaatctgcaccaatgcctttaatttctcatatccttgtaaatcttcagagctcgaatgaggtgcttacttcctattactttattcagatcagaaggtttagaataaccctaaaaatatctttttattttttcaaacctgcttcatttcatcctcaaaaacactgtagcatcaacattaaacagagctagttaacaggggttttaagaaaattaaaggtgtggccaagtctagacatcccaaaataagtggatgggggatacaggcttttggtccagttatttcggccaccttcttaatggacaatttggatcactgcacagtcaatccgcttaattgcatctgtgttggccattaaaacaaattgaatgcgctatggccaatttggtcatgtcataaag

SEQ ID NO: 2041 - DNA, 395 bp, Homo sapiens
  CDS 102..377
  sig_peptide 102..239: Von Heijne matrix score 3.5 seq FLVETGFLHVGQA/GL
tacaccttcacatttttatttatttatttttatttttattttttgagatggagttttgctgttgttgcccaggctggagtgcaatggcgtgatctcggctcatggcaaccttcacctcccaggtgcaagtgattctcctgcctcagcctctgagtagctgggattacaggcatgcaccaacatgcccagctaatttcgtatttttagtagagacagggtttctccatgttggtcaggctggtctcaaactcctgacctcaggtgatccgcctgcctcggcctcccaaagcgctgggattacaggtgtgagccaccgtgcccagcctacatcttcacatttaaatactaatttggctggacacaaaattctttataattaaaaaaagggaacttty

SEQ ID NO: 2042 - DNA, 494 bp, Homo sapiens
  CDS 126..290
  sig_peptide 126..260: Von Heijne matrix score 3.5 seq VTLVCRLPSKLQA/YS
gaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccaaccaaccctgtgtggaaaktgttgtggcgctbcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctga

SEQ ID NO: 2043 - DNA, 483 bp, Homo sapiens
  CDS 52..315
  sig_peptide 52..153: Von Heijne matrix score 3.5 seq LCCAFSTDGSVLA/AG
gtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatgacttctagcaagcctcgctaacctcg

SEQ ID NO: 2044 - DNA, 481 bp, Homo sapiens
  CDS 40..318
  sig_peptide 40..285: Von Heijne matrix score 3.5 seq PSWLASWTSQSRS/SG
atttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccatccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttga

SEQ ID NO: 2045 - DNA, 471 bp, Homo sapiens
  CDS 272..430
  sig_peptide 272..391: Von Heijne matrix score 3.5 seq LPPALTSLTPTLP/QA
tcaggtctcagcatttcatctgtgaaagaggcatggccctgggttagaaaggagggcaggagacatggaggaactggggggcaccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagcactggtgctttgaagcttttgtttttataagatggtttttgcaaggggaca

SEQ ID NO: 2046 - DNA, 462 bp, Homo sapiens
  CDS 23..352
  sig_peptide 23..229: Von Heijne matrix score 3.5 seq LDLALLFLMGILE/AV
accggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggcgsccagcctggccctcacggctggcaccgcctcctctctgcccacttcctgctttggcaggccctagtgttgtrggcggactgggccctcagcgccacgctcctggcccttcacggcctggaggchycctgcaggtggttgccatcgcggccttcaccaggtagctacggacac

SEQ ID NO: 2047 - DNA, 594 bp, Homo sapiens
  CDS 212..400
  sig_peptide 212..382: Von Heijne matrix score 3.5 seq LDIFLLNLWLAFP/KH
ctacaaataaaaaatataaattttatttctcagagtaagctccatcagggtcaagacacttttgtaagcaatgataccagacatttattccatccctaaagaacagggtcttgggaatttcaccacatcagtgccatctttttaacattattaactgaagaaaaatgggtgctctgacagatttttttaagattaggaaacaaaagtccaaatgagccaaatcaggacagtaaggtggatgcctagtgacattccactgaaactctggcaaaattgcccttgtttgatgagaagaatgagcagaagcattgtcatggtggagagggagtctggtatagctttcctggacatttttctgctaaacctttggctagctttccccaaacactctcataataagtagatgttatcattctttggcctttcagaaagttaacaagcaaaaagacttaagcatcccaaaaaactgttgccatgaccttagctcttgactgcttggcttttctttgactgcaccacatccccttcttggtagccattactttgattgtgctttgtcttcaggatcataccagtaaagctatgtttcatctc

SEQ ID NO: 2048 - DNA, 526 bp, Homo sapiens
  CDS 155..433
  sig_peptide 155..337: Von Heijne matrix score 3.5 seq LLHTSPLCLQLLS/AG
atttttccccccttgctcgggatggtgccacaggaggctgtgcgggccccgctccgcttcgaatggtggatgctgtggggcaccacctccttgaggaccaaggcactccagctgccaggaatttggctgctaacctcacacagctgagccttccatgaaaattgctctctgccaaagagaacttcctagtccaaggtcatgtctactctccagagatgtgactggagtgatttgcacccggatgcctagactcgccatctgctcaaagactgctcagaaagccctcccatgcattcccctgctgcataccagcccactctgcctgcagctgctgtctgcaggacttcatatctatgccacactgtgtaaaagctgtgcttcaagaaatcacaaaaacattttcctgcacctactacacagcctgagtgcggcataagttgaccttgcttgctaagaaatggggcaagaaatgcttttttgtatgtgtcatgtctgtttgtttttcaattaagagaggaaagcatta

SEQ ID NO: 2049 - DNA, 421 bp, Homo sapiens
  CDS 102..377
  sig_peptide 102..239: Von Heijne matrix score 3.5 seq FLVETGFLHVGQA/GL
  misc_feature 386,403: n=a, g, c or t
tacaccttcacatttttatbkrtttatbtttatttttattttttgagatggagttttgctgttgttgcccaggctggagtgcaatggcgtgatctcggctcatggcaaccttcacctcccaggtgcaagtgattctcctgcctcagcctctgagtagctgggattacaggcatgcaccaacatgcccagctaatttcgtatttttagtagagacagggtttctccatgttggtcaggctggtctcaaactcctgacctcaggtgatccgcctgcctcggcctcccaaagcgctgggattacaggtgtgagccaccgtgcccagcctacatcttcacatttaaatactaatttggctggacacaadhgtctttataattaaaraaangggaacttttaacttangaatattatgtcaactca

SEQ ID NO: 2050 - DNA, 483 bp, Homo sapiens
  CDS 147..389
  sig_peptide 147..356: Von Heijne matrix score 3.5 seq NFILIPLSSTSFG/TG
ttacaggatgtaagtcaatctagttcataagaaaaattgagttactttatataaaatttgatctctatttatccttgtctgtcagctactttcagtctgcagtcaaartcamcagagctccccacatgctcatctctctttaaaatatgcattttgttgtttttctcgacacaaaaatagtgcatcatgcatgtaacacattttttaaaaatactgatgacctagacttatttctgaagaacttcaaacactgtagatttaggaggagcttatactcttcctccactactaacctcaatcctgtggccaagaattcaaattttatcctcattcctctgtctagcacatcttttggtacaggtgctcaaaagcacagaatgactctaggatgaccaagctcagtccctgagccacccaggacccctgtatgtggtgtgaatgttgagccctagtgaagggaactcggggattaaatggagataa

SEQ ID NO: 2051 - DNA, 539 bp, Homo sapiens
  CDS 114..449
  sig_peptide 114..314: Von Heijne matrix score 3.5 seq STCIASSSGCTHS/RC
ggcgtgcgagactcggcgggcgctgttgagggagtcgggccgcgactgtggtcgtttttataccttcccgcgcggacgccggcgctgccaacggaagggcgggctctgctgccatgaaggtgaagattaagtgctggaacggcgtgccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaactcatt

SEQ ID NO: 2052 - DNA, 399 bp, Homo sapiens
  CDS 21..290
  sig_peptide 21..149: Von Heijne matrix score 3.5 seq RVLGLXLQEEGRG/CP
rsrrcttwtagtcaagagggatggcctctcgaaacagwgggggtgacctggaggatcttagcattccaggcacaatcctagcctsgcctgggagaactgccactcagatgagggtcttgggcctggygctccaggaggagggaagagggtgcccctggagagacgkggcgctcccattttacatcctccagatagctctggggccacgctcctgtgctccaactmcattgagtcctgcatgcagctcggtgttccccggccacatcgtaaaaagatttacaagactatgttaaactggcaggatcctccactgggctctggagttcagaggttcaaggttaaagtgaaaagaaggctgagcatggagacaacaggagacttcaagtcccacttgacagw

SEQ ID NO: 2053 - DNA, 820 bp, Homo sapiens
  CDS 52..315
  sig_peptide 52..153: Von Heijne matrix score 3.5 seq LCCAFSTDGSVLA/AG
gtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttctttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctacta

SEQ ID NO: 2054 - DNA, 402 bp, Homo sapiens
  CDS 102..377
  sig_peptide 102..239: Von Heijne matrix score 3.5 seq FLVETGFLHVGQA/GL
tacaccttcacatttttatttatttatttttatttttattttttgagatggagttttgctgttgttgcccaggctggagtgcaatggcgtgatctcggctcatggcaaccttcacctcccaggtgcaagtgattctcctgcctcagcctctgagtagctgggattacaggcatgcaccaacatgcccagctaatttcgtatttttagtagagacagggtttctccatgttggtcaggctggtctcaaactcctgacctcaggtgatccgcctgcctcggcctcccaaagcgctgggattacaggtgtgagccaccgtgcccagcctacatcttcacatttaaatactaatttggctggacacaaaattctttataattaaaaaaagggaactttttaactta

SEQ ID NO: 2055 - DNA, 662 bp, Homo sapiens
  CDS 21..566
  sig_peptide 21..212: Von Heijne matrix score 3.5 seq RLLCIWQLRTILS/GY
gtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtatttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacactcagagctccttaataagcattatagtcagtttttggcagcaatagaatcactaaaggcattctgggatgtatggatgaatcgatgagagactgggtactgagcaga

SEQ ID NO: 2056 - DNA, 425 bp, Homo sapiens
  CDS 44..214
  sig_peptide 44..88: Von Heijne matrix score 3.5 seq LTALSSYMSGIIQ/NV
tcttacccagcccctggcaaccatcattctactttctgtctctatgcatttgactgctctcagttcttatatgagtggaatcatacagaatgtgtcctttkrtgtccggcttatttcacttagcataatatcctcaaggttcatccttctagttcattcttacaataaaggaagtacaacttgtgaattgggaaaaagcagattggatattttttagtcacaaaacatatttattgtcagaagtgaagcaaacaaagttgttcaaagacaaagctaaatatttgtcgaacttcacctcattcctgccctcctgaggtgacctgtgttaacagcctggtgtatttcctttcacacgtttctcctggaagggcaatttttctaaaatgtaaatctcatgagatttactcttctgcttcagatctttc

SEQ ID NO: 2057 - DNA, 262 bp, Homo sapiens
  CDS 1..189
  sig_peptide 1..129: Von Heijne matrix score 3.5 seq LTCLYIVLLISFS/XX
atgaaatctttattttggctcttgtatctttatgtccagaattgctatttgattcatttttatatttttaaaatatttttattgatattccttacttgtttatacattgttctcctgatttcctttagtwttwwtgtttgtatgtdtgtttttgtttttcatggtttccttcaactctctgagcatatttaagacagttaaaatctttgtctagtaggtccattgtctgggcttgctatggggtggtttctgtcaatttcty

SEQ ID NO: 2058 - DNA, 475 bp, Homo sapiens
  CDS 88..312
  sig_peptide 88..198: Von Heijne matrix score 3.5 seq FFFFISKLLPVFS/MM
tgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctcctttttttcttctttctttttttttttcatttcaaaattgctgccagtgttttcaatgatggacaacagagggatatgctgtagagtgttttattgcctagtttacaaagctgcttttgaatgctggtggttctatycctttgacactacgcacttttataatacatgttaatgctatatgacaaaatgctctgattcctagtgccaaaggttcaattcagtgtatataactgaacacactcatccatttgtgcttttgtttttttttatgggcttaaagtaaagagcccatcctttgcaagtcatccatgttgttacttaggcattttatc

SEQ ID NO: 2059 - DNA, 483 bp, Homo sapiens
  CDS 36..353
  sig_peptide 36..254: Von Heijne matrix score 3.5 seq TELSQLSLPSCLA/FV
tttcacttgatccctctctggcctgggtcacatttatgacatcccccctctgcaacctttctctctgggggctgtaccaaaggcatggtacctcagtctggtatccagactgtgaaatcagcctctgggccaaggagggtcctacagacaaggtggcatctcaacctcacccaagaaacccccgggactttaccccagcaggctgccactggggcaccgaactaagccagctcagccttccaagctgcttagcctttgtcaaccatcaaagtggggaaagggtctctggccttgcaaggatttgggcaggatggaagtctttgtctaggtctgaaatcaagggcttgggaatctagagcagagctcctggccagcgtttgaagcctggcctcccacctggggcatttastgasaccctgtcgccagcctagaacatcctgctctgaatgaacagagcccagatgggggtcagagctaagtgac

SEQ ID NO: 2060 - DNA, 483 bp, Homo sapiens
  CDS 225..455
aaatcccaaaatatgtggaagattaaacaacttctaaataatacatagttcaaagaaggaatctcaaaaacacttaaaaatattttgaaataaatcaaaatgaaaatacagtttatcaaaatttgtgagatgtagtgaaaccagagcttagaggggaatttattggattgaatgcatttattagaaaagatgaaagatccaaaattggccgagcgcggtggctcatgcctgtagtcccagcactttgggaggccgaggggggtggatcacgaggtcaggagattgagaccatcctggctaacatggtgaaacctctctctactaaaaatacaaaaaattatccgggcgtggtggtgggtgcctgtagtcccagctacttgggggtgccgaggcaggagaattttgtgaacctaggaggcggasttgcagtgagccgagatcgcgccactgcactctagcctgggcgacagagtgagactccat

SEQ ID NO: 2061 - DNA, 466 bp, Homo sapiens
  CDS 65..265
  misc_feature 32: n=a, g, c or t
ttcctccttattgacaaacagagcggtcgcgncggcgatctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgagaagaaaaagctggatcacttaccagtaactggagttctcctattgggtaatctccacagatccacattgtttgaagttattgtgagtgcctcgaggaccaaggaaccgttgaaatttccaatttcaggaagttccagtggatgcccatcaggaagattctcatgctgaacagaagggcaagagaggtggatctgtgagggaaaagacccaataggataactcaagttactggaaacctcgacctgtct

SEQ ID NO: 2062 - DNA, 422 bp, Homo sapiens
  CDS 9..161
  misc_feature 346: n=a, g, c or t
gaaggactatggcaggggagaacttcgctacgccgttccacggcacgkggccgcggcgccttcagcgacgtgtacgagcccgcggaggacacgtttctgcttttggaygcgctcgaggcagcggctgccgaactggcagggtgcgaggaggggaggggctctgacgggaaagggttgcggctttctgaagaagtgcggtggaggagggccggaacgtgactatcaccgccctgagccggagcaggcggggtccatttgcagatgattgacagccaggacgccgtaattgagaattttcctgtagctacaagtaatgagtgtgccggggacgcatctcctttgccangggggctgctctgtctcatgagctccctgactgcttaccatgcaaaggcgtatctttttcctgtcgcctgttaatc

SEQ ID NO: 2063 - DNA, 490 bp, Homo sapiens
  CDS 231..404
  misc_feature 155: n=a, g, c or t
cacaattatttaaccattgcgttgactttggagtcacttccaggttgccttcccagctccaccactatgggaccttggacaagtcacttcacctctcagaggctttgtgtcttcacctataaaatgggatgaacaccacctgctttgtaggtttncttttcacatgaaaataagtaacaggctgggcgcggtggctcacgcctgtaatcccaacactttgggaggccgggatgggcagatcacctgaggtcatgagtttgagaccagcctggccaacatggggaaagtccgtctctactaaaaatacaaaaattagccgggcgtggtggcaggagcctgtaatcccagctacttgggaggctgaggcggaagaatcacttgaacctggaaggcggtggttgcagtgagccgagatgatgccactgcgctccagcctgggagacagagggagactacacctcaaacaaacaaactaactaactaactaact

SEQ ID NO: 2064 - DNA, 341 bp, Homo sapiens
  CDS 115..288
taaatatattaaatatgtgtattatattaaatacagtattaaaaaaaaaagattgaggtggccaggcgcagtggttcatgtgtgtaatctaagcactttgggaggccgaggkmgatggatcatttgaggtcaggaatttcagaccagcctggccaacatggcgaaacccccactctactaaaaatacaaaacttagtcgggtgtggtggagcgtgcaggtcatctcagttactcggaaggctgaggcaggagaatcccttgaaccgcggggcagaggttgcagtgagctgataccgcaccactgcactccatcctgggtgacagagtgagacctcgtctca

SEQ ID NO: 2065 - DNA, 448 bp, Homo sapiens
  CDS 158..325
ctttccgctccaacgcacggagggtgaggtcggtacgcggtggtggcgtcacggcgccagctcctcccgacgccgagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgatggagtctcgctctgtcacccaggctggagtgcagtggcgcaatctcggctcactgcaagctccgcctcccaggttcatgctattctcctgsctcagcctcctgagtagctgggactacaggcgcccgccaccacacccggctaattktttgtatttttagtagagatggggtttcaccatgttagccaggatggtcttgatctcctgascttatgatccgmsctsctt

SEQ ID NO: 2066 - DNA, 222 bp, Homo sapiens
  CDS 24..173
  misc_feature 34: n=a, g, c or t
aatggtagagacaggrtttcaccatgttggccanctggtctcaaactcctgacctcatgcctgtaatcccagcagtttgggaggccaaggcgggtggatcacctgagatcaggagttcaagaccatgcctggccaacatggcgaaaccccattctactaaaaatacaaaaaattagccgggcatggtggtgggtactgtagtcccagctacttgggaggctg

SEQ ID NO: 2067 - DNA, 461 bp, Homo sapiens
  CDS 39..191
gaactgttcaagtgagtggactcattgtgagatgcctgatgcactccagagaaatcagatttaggtccaatagcataatacaagaagtcaagcacgtgagggcctcctgtgagatctcgatggggcagccaggcacggtgactcacgcctgtaatctcagcattctgggaggccaaggctggaggatcatttgagcccaggagttcaagattagcctgggcaatatggtgaaacccatttctacaaaaaaatacaaaaaaaattagctgggtatggtggtggtgtgtgcctgtagtaccagctactggtgggagctgaggtaggaggatcacctgagcctggaaggttgaggctgtagtgagccatgatcacaccactgcactccatcctgggtgactgagtgagactctgtctaataacagcaacaaaatctcaatgggacccagcatggtggctcatgc

SEQ ID NO: 2068 - DNA, 617 bp, Homo sapiens
  CDS 57..320
aaggacatggctcctgactcctgtgcggaacgtgagtasttgagcggcaaagccgaatggtctctagcgaccggcccgtgtcactggaggacgaggtctcccatagtatgaaggagatgattggaggctgttgcgtttgctcagacgagagaggctgggccgagaacccgctaggtttattgcgacgggcacggctgcagcgtcgcgtgcatcaagcttgctatggcattgttcaagtacccactggaccatggttttgcaggaaatgtgaatctcaggagagagcagccagagtggtaaggactatttatcaaaaacattaaactttagtgagtaggttaggaaattaggaactgcactcctgttgtggtttgtggggttgtcagtcatttcttcaaatatcataatgtaagagataatttaggccaaatattgacttggagtattaaacagattttgtaaaactgaaaarcaratggaatcaagtgagtatattttggatactttgaaaacaaaaatacatagtcatatttgggctttgttaactagttacagaatcaagaaagcttgaagaagtttgaaggttacactggctaatcatagttaaaatataatgg

SEQ ID NO: 2069 - DNA, 503 bp, Homo sapiens
  CDS 189..461
aaaaaaagaaactcagaaatcgctggagaatagttctttgttttcttgagttcatgaacagatgctttgaagaaaatagttatctcagccattttctaggggaaagatgacaaatgcaaacaaaaatataccttcctgagagagtcatgcaccatgattcttagagataactacttcatattttgaagatggagtctcactctgtcacccaggctggaatgcagtggtgccatctcagatcactgcaacctctgcctcccaggttcaggcgattcttctacctcagcctcttgggtagttgggattacaggcatgcacttccatgcctggctaatttttgtatttttagtagaaacaggattttgccatgttggccaggctggtctcaaactcctgacctcaagttatctgcccatttcggcctcccagagtgctgggattacgggcatgagcswaatttttgacttatgggacctatttaatgtcaggccagaaatcattca

SEQ ID NO: 2070 - DNA, 499 bp, Homo sapiens
  CDS 146..433
aatcagacccgtgcagcstcgagctggagtggccagctgggcctggagcaatgcgagcgggccccagggagcgacassacgttggcgcacggccgagtgagtcaagatctggttccaaaacaagcgatccaagttcaagaagctgatgaagcagggtggggcggctctggagggtagtgcgttggccaacggtcgggccctgtctgctggctccccacccgtgcccccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagtaaggacccagagggaagaaggaacagtggaggcgggacgccttccatctcctcggagccccgcga

SEQ ID NO: 2071 - DNA, 343 bp, Homo sapiens
  CDS 3..176
ccatgaacccaaagatccaagaaactcaaagagctccaagaagaataaatattgattcaggccaggtgcagtggctcacgcctataatcccagcactttgggaggccgaggtgggtggatcacaaggtcacgagatcaagaccagcctgaccaacatggtgaaaccctgtctctactaaaaatacaaaaattagctgggcgcagtggcatgcgcctgtaatctcagctactcgggaggctgaggcaggagaattgcttgaaccagggaagcggtgggtgcagtgagccgagatcgcgccactgmactccaacctggtgacagagcgagactccgtctcaaaaa

SEQ ID NO: 2072 - DNA, 498 bp, Homo sapiens
  CDS 42..215
agactttaacctggccaagtcagggctctgtctcaggacgcatggagcsagggctggaagtctccactgggcaggcgccaggcagcccctgcaggctggggaggtggaggctgctggagtcaagaggaaccagctcgccatggccaaacagctgcaggcccgaagctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttagacaaaagctgggtatggtggctcacgcccgtaatcccagcattctgggaggctaaggctggcagatcacctgaggtcaggagttcaagaccagcctgcccaacatgggttaccaccactgacgaagatcctggcaagtttctttggggagctgctgg

SEQ ID NO: 2073 - DNA, 351 bp, Homo sapiens
  CDS 46..249
  misc_feature 98: n=a, g, c or t
taaaaaatatatattgattaaaatgtaccactagaaaggtattacatgtgtataagtatgggtaaaaaggcaagtcactrgtttgrgatgaaaactanaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatca

SEQ ID NO: 2074 - DNA, 460 bp, Homo sapiens
  CDS 140..313
tattatgagtggtagcacctaatctccttaatgatatttcaggtgccatattgggtcatcctcactaaagacccttcaagagggttttcctccaatagccccagtattaacattggtctggccttattatttgtatctaatggggttagactttcccttccatgctgagaaaaagttgtctttaagagaatgtgctgaacaatcagggcccagaaaggcaacaacgaatattttgcatgccaagaaggaggcaaaagaggaagtggaattgtacccaaataatgcttataataggtgttatttagctgagctgtaagctccaggagggcagggtattaatatattgaggtgttggctgagcactgtggctcactcctataatctcaacactttaggaggccaaggtgggaggatgacttgagaccaggagttcgagaccagcctgggcaacatagcaaga

SEQ ID NO: 2075 - DNA, 558 bp, Homo sapiens
  CDS 74..379
aagacacagattggaaagaactgtacaggaagaggcacatacaaagaaaagaatccccgaaakgcggtttgtgatgctcctgccatcgtcaactcacaccattccattctatcccaaccccttgcaccctagaccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgakgcggccccaatgacagatttccctttagacccagcagggtcggcaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaaccttttaagagatacatttatagcct

SEQ ID NO: 2076 - DNA, 465 bp, Homo sapiens
  CDS 104..430
tgataaacatcttcatctgtgtatttatgaccgaagattttcccagctctcagaacttccccgttctgacaccctgaaggacagtccagagtcggtcactcagatgcttatggcttacctgtcacgcctttcagctatcgctggcaacaagatcaactgtgggcccgcccttacctggatggagattgataataagggaaatcaccttttggttcatgaggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccagtgtctaaaaagcacggcaagctcattacgttcttacgaacattcatgaagtctcgtccaacaaaacagaagctgaagcag

SEQ ID NO: 2077 - DNA, 456 bp, Homo sapiens
  CDS 229..411
  misc_feature 219: n=a, g, c or t
agaacccacgcagcgtctcgggccggctaggggtacaccaaagcggacaaaagccactgaggggaaggacctcggcaaaacctgagtcctgtcctctcgctttcctccccgtgcacagcgagcttcaccacttgctccgcaccttctccatcaactactacctgtccctgggatctgtccagtcgcccagctaaagtgctcagcaggtcagcagcgcgncgagcttctatgcaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaacacccacaggatagtggacggcaaagtggtgtctgagaccaacatcacagacgttcttgaggtgctaaaccagcagaa

SEQ ID NO: 2078 - DNA, 453 bp, Homo sapiens
  CDS 3..185
taatgttcgggataaaaggacagatattaatcgagtatttgctggttaatagcaaaagaaacatacttttttttctagctgaggattttcatgagttgtttttcaggatacaagcgaatttatacaattccttacctgtcagtacaacatgcattggttccccttccccccaacagatggcaaggtgaattatgaaatctcataaaaaaaaaatacaactagtctactcttggaaggtagagatatgtccttatttgaaatggtttgcggtgtttttcaaggagatgagcacctactgatctctttctttgcctattaaraccagaaatcggagctggatgtggtgggcacctctgtagtctcagctgcttgggaggattgcttgagctcaggaatttgaggccagcctaggcaacatagtaaaaccactgtccctaaaaaacacatttttaa

SEQ ID NO: 2079 - DNA, 527 bp, Homo sapiens
  CDS 273..422
aatttttsttcctaattaattggccaaacacaatgtaaataaaataggaaatgcttcagttaatatttactatataaacaaacaaacagatagtgggataatggttttatctatcaccatattctagaattgtgcctggcattcagtaagcacctaatggattaacaaatatgtacttgtagatgtctgcagaccaaggtgaatttagtgaatatcaaaaacttcttgagtgctccatcgtaacgccatttatcttgacataaactgcaaagatggctcaaatgtcgataaggatatcagttcagggtctccagtggctgcagcctatcccagaagctcagggtgcaaggcaagaagtaatcgtgggaccaggcgccgtggctctcgcctgtaatcccagcactttgggaggcagaggctggtgaatcacttgaggtcaggggttccagactagcctggccaacatgatgaaacctcatctccgctaaaaatacaaatatttaattggatgtagtggtacatgcctg

SEQ ID NO: 2080 - DNA, 469 bp, Homo sapiens
  CDS 212..427
ctttaaatgcatataggagagttggaggggagaggagacacttgtccctcttaacttgtttcttggtaatgagtgaattggtgaaaataactacatgtacacctgtagtcttgctttgtacaggttttgcatttggtagtctgccagtgctcaaaaattcctggtggtggtttttcagggataccacccagtgaccatctgtggtggtcatatgttatttgttcacccaacatccccctggggtaccaacactcctcattttataataattcgttttatccacatggttcaagtgggtctttttttaccctccagtggtgataggctgacccaagcccaggcccatcagaatgctttatcttggtcaggcatggtggctcatgcctgtaatcccagcamwttgggagaccgaggtgcatggatcacctgaggtcaggagtttgagaccagtctggccaacatggcgaga

SEQ ID NO: 2081 - DNA, 506 bp, Homo sapiens
  CDS 76..303
gagagatcctacgtgtgtgtatgggtacacacatgattacctgctttttaaaaaaacaagagaaatggcagccacatgacacacaatattckgtactttgctcttctcgaaaacattccgtggctctcccacgctgctggcatttggcaggagcttagcagcatcgagtggaagtggggacacacgcttgacctagcaagagctctcctgggtacacactccagcataacgcagccccatggggcagggagcacacgcgagaagagactagaaacaagacaaatgctcgtccccaggaggtggtgaatgaaggctccatggcaccgcacatgatagggagaatgaatgaatgaatgactacagctacatgtggatgagcatcaaagaagacgccacacagaagaggcaaaaacatcgaacaatactccatcctcggactttaaggttcaaagccaggcaaaaggaaactgcttcaggctgcatacagaggtggcaaacagagagaa

SEQ ID NO: 2082 - DNA, 685 bp, Homo sapiens
  CDS 231..584
ttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcatgccccgcgtgggggagtgcaggtggtttcggttgcggcagtcgcgtcccgggagcgtcgctgcctkgkkgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaaataaaataaaagctcacttactatcaaaaaaaaaaaaaaaaag

SEQ ID NO: 2083 - DNA, 504 bp, Homo sapiens
  CDS 140..313
  misc_feature 493: n=a, g, c or t
atgataccttgttctagctgcttagggtttgggaagtatataggacccagcgtgaactccctctcttgagcaatgtcttgcacaactccaggcatctccctatgttagttgcagcccacaagggtctagggtctttcccatgactagaatacaggagtccacggtgggaatgtgtaccactgggggtcacttacttaccctttccccacactggacaacctttctaggctcccagctgattgcagccgagcaggcttacttccttctccttccttgttttacatgtttccagtttaattccagtgttctctcttaggtgatctgttcaaagtgtaacattttaaatgaagttccacattattttctaataaaatagtggcagagtccttgtaaaaaattggcaattttgctttcaacagtacatgttttatttattaactgtgcaaaatggatttttaaataattgataatagttttgtttcttcagtaagcnaaatatcttca

SEQ ID NO: 2084 - DNA, 463 bp, Homo sapiens
  CDS 118..363
  misc_feature 60,395,415: n=a, g, c or t
agtcggccttataaagcggccgcagtcggagcctggcacgctcgcscagaggcctgcgcncacaccctctcctgtccagssttcgcmcgcctgggsagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaaggaccctaggagacgcctatgagtttgcggtggacgtgagagacttctcanctgaagacatcattgtcacnacctccaacaaccacatcgaggtgcgggctgagaagctggcggctgac

SEQ ID NO: 2085 - DNA, 456 bp, Homo sapiens
  CDS 223..444
  misc_feature 41,49: n=a, g, c or t
aaagccttcccggtgctcctccctcgtctcctcasastcgntstctgkntggggtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggwsattcagtcagargaaggctgctattgaaagagagtatgcacagggtatgcagaagttggctagtcaatacctgaaagagagattggcctggagtaaaagctgatgatcggaa

SEQ ID NO: 2086 - DNA, 504 bp, Homo sapiens
  CDS 231..455
cccatctaagcattccacactgcagggaggagtggtacttaagctcccctgccttaacctgggaccaacctgacctaacctaggagggctctgagccaaccttgctcttggggaaggggacagattatgaaatttsatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttatwattgctccgcatactgagaatctaggccaccccaacctctgttccccacccagttcttcattt

SEQ ID NO: 2087 - DNA, 496 bp, Homo sapiens
  CDS 13..195
  misc_feature 410,435: n=a, g, c or t
cagtcaggttggatgcctggtgtgagaggaaaagaggagtcaactgaaagaaagaaaaagatgacctggcctccttgtaaacgtgtgaatggcatacacatacagcacctttaccagaaaagaggtctaagagttcggatggcaaacaaactagaatctctgaatttatggggtaaggttctctggacagtgtcataagctgtgcaattaccagaggatacaatgaagatatttcatcaagtaatgaatgatgagacagtttatgtaactgagagattgcctgtgagtgattactgcatagatttcttagaggcttcatacataacccttgcccacagcacagccccaaatgccaaggtaggacctggggaggcgcgctggcgacctgaacgtctccaggtcctgcctgngtctcaggattamctgcatccttgnaattattcgtaaagctcgacactaggttagatctatgacactctgaccawgttatgaggtc

SEQ ID NO: 2088 - DNA, 432 bp, Homo sapiens
  CDS 79..378
aaagccggtcggaactgctccggaggcacgggctccgtagcaccaactgcaaggacccctccccctgcgggcgctcccatggcacagttcgcgttcgagagttacctgcactcgctgcttcagctggatgcacccatccccaatgcaccccctgcgcgctggcagcgaaagccaaggaagccgcasccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggaggaaccagcctgaaaacagcsagacgcccaccaagaaggaacatcagaaagcctgggctttgaa

SEQ ID NO: 2089 - DNA, 483 bp, Homo sapiens
  CDS 265..432
  misc_feature 395: n=a, g, c or t
cctcctacccaccaaattdtccataaaaaccctaacatcggccaggcgcagtggctcacgcctgtagtcctggctactcggcaggctgaggttgcagtgagctgagattgcgccgctgcactccagcctgggcgacagagcaagactccctctcaaaaacaaacaaacaaataaaacaaaacacaaacaaacaaacaaaaaaacacctgctaacatctgagactttgaggagactgacttgagtgttaactccagttttcccacatgggccagcctcatggccttatgccaattaaactctctactgcaatgccatggtctcagtggattgattttatctgtgtagtgggtgggaagaacttgtcaggcgattacactagtgaggatgtggaganaagggaactcttatacactgttgatgggaatataaattagtacagtcattatggaaagcagtatgaaggttgctcaaaagaaactaaa

SEQ ID NO: 2090 - DNA, 480 bp, Homo sapiens
  CDS 178..330
atgctgaccatgttgagctcattggtagtggtaccaaagtgatcctctgccttaaagaagaccagacagagtacttataagagagttgcgtcaaagaaatagtaaagaaggacttgaagttcataggctattctattaccttttatttggaaaaggaataagagaaataaatcactaatgatgaggttgaggaagagaaaggtgagaaagaaaaagaaaaagrtgrwgragraaaagcccaagattgaagatatggcttcagatgaagaggatgacagtggtatggataagaaaaagaaaatcaaggctggttgcagtggctcatgtctgtaaccccagcactttgggaggtcgagttgtactaaatgatgtgtgttagtcatgtgacaccaactgacagattcagactatgcaggtctgtggggcattatattgtgattcttgtttgaaggcagaaaaaatgaagagggcacagatcaa

SEQ ID NO: 2091 - DNA, 488 bp, Homo sapiens
  CDS 131..427
ttccgctcgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgmgcatgtggcctttgacaaaaaggtactgaaattctgatgcctatttccaagaagatgttcctatgtcaactgaggaacagtataggatccgtcag

SEQ ID NO: 2092 - DNA, 483 bp, Homo sapiens
  CDS 12..209
caaagggaaaaatgcaaaaattggctgggtgtggtggctcacacctgtggtcccagctacttgggaggctgaggtgggaggatcgcctgggcctggggaggttgaggctgcagtgtgccatgatcgcgccactgcactccagcctgggcaacagagtgagacccccctatctcaagaaaaaaaaacccaaattttgtttcataattatgtaaattaggcctgggcatggtggcttatgcctgtagtcccaacactttgggaggccgaggcgggcggatcacttgaggtcaggagttcgagaccagcctgagcaatgtggtggaaccccatctctaccaaaaatagaaaaaattagccatgcacgcctgtggtcccagctacttgggaggctgaggcaggaggatcgcttgatcctgggaggcagaggttgcagtgagttgtgatggtgcactgcactccaacctgggtaatacagtgagactc

SEQ ID NO: 2093 - DNA, 311 bp, Homo sapiens
  CDS 39..245
  misc_feature 300: n=a, g, c or t
gatagattaaaaattttctgggctgggcgcggtggctcatgccggtaatcccagcactttgggaggccgaggcaggcggatcacaaggtcaggagatcgagaccatcctggctaacacggtgaaacctcatctbstactaaagatacaaaatattagtggtgtgtggtggcgggcgcctgtagtcccagctactcaggagcctgaggcaggagagtggcgtgaacccaggaggcagagctttcagtgagccaagatcgcaccactgcactccagcctgggcgacagagcgaggttycgtntcaaaaaacaa

SEQ ID NO: 2094 - DNA, 452 bp, Homo sapiens
  CDS 167..355
ttgagaccttccttaagagaggaaagcttatctttagtttatagaaataaaaacaaaactgtatttccaagcaaaactgactttatgtaggtgtctccagagatgcagcttcagckccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatakkctctttaagaacagctcctctttaacaaaaaaacttaaaagacaaatgtgagatgggcttagagttagttctctggggaactt

SEQ ID NO: 2095 - DNA, 446 bp, Homo sapiens
  CDS 12..203
ttgtttgttttatgagacagggtcttgctctgtcacccaggctggagtgcagtggtgcaatcagagtttactgcaggcttgacttcccaagctcaagtgatcctcccagcctctcaaatagctgggaccacaggcacctgccaccctatcctgctaatttttgtattttttgtaaagatggggttttgccatgttgcctaggctgatctcaaactcctaggtgcaagtgatccctcatctttggccctaagtgctgatattaaagtgctgatataaaagccgacaagatgttatactcagaaaaagctgaagacgccaccaagaaactaatagaactgataaacaaattcagcaaagttgcagaatacagagtcagcatacaaaaatcagtagcatttccatatacccaaagtgaacaatctaaaaaagaaatcaagaaagcaatc

SEQ ID NO: 2096 - DNA, 495 bp, Homo sapiens
  CDS 279..449
gtgtccaggatgagaaaggatagataacttgactaagtataatggagaggaatgggtgcctggtgcctgttttacattcagactcttaattttttgagtctctatatttacttaaagatgcccattcatatctgtgtgcacatgtacgctcccacatgtgtgtaaaaaacagaacattcatgtgacaatggcattcttgtgtaatgaaacgtgtatatgtatattaatttatatgttaaacatatttgtagatatacatatataaacacacaaatgaaatgaaggtgaacattttggccagtaaaataatgaaatgctatgaaatttcactatgttgtttacagcattttcatacattcgtgttctgtactgagacttggagccgagctgatttgcttgtacacctgaaatgtttggaggcccttcagcagattgcagatttttataaataatggcctttcgttggccacattttgtcatggtttcctcagttgt

SEQ ID NO: 2097 - DNA, 478 bp, Homo sapiens
  CDS 179..379
  misc_feature 19,46: n=a, g, c or t
catctcccggagstggakncgcctcctcggccagtggcgtacgaantcggtgtcgcggccagccagataggggcggaggtccggaacccagtctggacccgagcggggggccatggagaaagcggcccgaggcgctgtttacaccgactagcgcgggcccgttgcggctgcaggcaccatggaccgagcccccacggagcagaatgtcaagctgtcagctgaggtggagccatttattccccagaagaagagtcctgatacatttatgatccctatggctctcccaaatgataatgggaagtgtttctggtgtggaaccaactccaattcccagctacctgattacttgttacccatttgtgcaggaaaaccagtccaatagacagtttcctttatataacaatgatatacgatggcacaaccccaatccaaaccctactggaccatactttgcctatcccattatatctgctcagcg

SEQ ID NO: 2098 - DNA, 460 bp, Homo sapiens
  CDS 119..313
  misc_feature 162: n=a, g, c or t
tattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctanagttgactttaaagttgtttacagaaatttaaactcaattccagagattgaagttgtccaaacagctcatgggcttgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagactt

SEQ ID NO: 2099 - DNA, 477 bp, Homo sapiens
  CDS 223..372
agcattttcggcaaacaatggkkccggagcagggaacgcggccagccgcctgcaatcgctgcatctgcgcccgctcctgtgctccggcgtcctacctaaccccgggaagtcagagccgctgggagtttctgacttactcgaagaagtctgtcctgggcaaagagcacacacgaatagacttcagattagctgcttctctggaaacgcataaaaaaagaccaaatggcaaagcaaccttctgatgtaagttctgagtgtgaccgagaaggtagacaatttgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggtagtcatcctagaggatataggtgatcttttcactgtgct

SEQ ID NO: 2100 - DNA, 505 bp, Homo sapiens
  CDS 168..356
ttgagaccttccttaagagaggaaagcttatctttagtttatagaaataaaaacaaaactgtatttccaagcaaaactgactttatgtaggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaaga

SEQ ID NO: 2101 - DNA, 459 bp, Homo sapiens
  CDS 85..267
aaagacacaatccatgaaagaaataagaataacctggacctcacctattagaatggccaaaacccagagcactaacaccagcatatgctgaggaggatgtggagcaacaggagctcccattcactgcaggtgggaatgcaaaatggcacaggcacttcagaagacagcctggcggtttcttacaaagctaaacatactcttaccatatggtcaagcaattgcaactttgttgatttaccaaaaggagttgaaaacttacgtccacactaaaacctgtacatggatgttttagcagctttactgctaactgcgaaaatttagaatcagctaagatgtccttgtgtaggtgaggggctgaacagatacattctgacaatggaatattatttagtgctaaaaagaaatgctttatgaagccatgaaaagacatggaggaagctgggacgtatattgctaagc

SEQ ID NO: 2102 - DNA, 374 bp, Homo sapiens
  CDS 54..224
aaaaaaatattcacattaagacaaactaagtacttgaaattaaacagtaatatatgcagatctctacccgtctacaaaataaattattcatgataagcacaaactgcagtgggaaggaggctacagaggaaaaaaatacaaactttgggctgaaaaatgagtcgtttctccagcaaagaaacactcagaaaaaatgtaagataactcacatgggctggactacataatctttaataaaggttcttttcgatctggctgcttcctctgggtctaaaacagtaactggcacgtgttaagcactcaataaatatctgttaaataaacatggatccaaaaaataataataataaaaaataaaataaaataaacatggr

SEQ ID NO: 2103 - DNA, 384 bp, Homo sapiens
  CDS 3..176
  misc_feature 359: n=a, g, c or t
ccatgaacccaaagatccaagaaactcaaagagctccaagaagaataaatattgattcaggccaggtgcagtggctcacgcctataatcccagcactttgggaggccgaggtgggtggatcacaaggtcacgagatcaagaccagcctgaccaacatggtgaaaccctgtctctactaaaaatacaaaaattagctgggcgcagtggcatgcgcctgtaatctcagctactcgggaggctgaggcaggagaattgcttgaaccagggaagcggtgggtgcagtgagccgagatcgcgccactgcactccaacctggtgacagagcgagactccgtctcaaaaaaaaaaattaaattaantaaatactgattcaaagaaaaccac

SEQ ID NO: 2104 - DNA, 554 bp, Homo sapiens
  CDS 280..504
  misc_feature 9,71,73,75,419: n=a, g, c or t
acaaargmnccrggcgcgagaggacgtgctctgccagccagtrggaaggcaggccgcgcgcgcgggagsgngnanggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggntgaaatttggccgaaattccaacatctgtcattatacttttcaggacaaacaggtttcccgagttcagttttctctgcagctgtttaaaaaattcaacagctcagttctctcctttgaaataaaaaatatgagta

SEQ ID NO: 2105 - DNA, 476 bp, Homo sapiens
  CDS 18..206
gttctgggattacaggcatgasccaccatgcccatcctgtaatggttttttgttgttgttgtttgagacagggtggtacattattgccaaagctggagtacagcggcaaatacatggctcactgcagcctcaacttccttggttcaaacaatcctcctgcctcagcctttagagtagctgggagcataagagtgcacccctatgcctagctaattttttttattttttgtagagttggaatctccacatttgccaggctgatcttaaacttatgggctcaacctatcctcccaccttggccacctaaagtgctgggattatagatgactgcgcctggccccttgttaatttatcattagttttttttccccccaatatttttgatccatggttgcttgaatatggatatgggacctgcatgcagattagaaaggccaactgtattctggtgttcttcacaggacaagtgacactcc

SEQ ID NO: 2106 - DNA, 491 bp, Homo sapiens
  CDS 196..363
taatttcttggcactacccatgttggatacctcatttgcttccccaaagactgtgcccaaaatttctgttgtttctacaatgattctgcctgccaacaaagtctgaaaatctctcaagtttgttataaaaacagcacagttagaacatgatgacattcctggagggaaaaataagtccacttatttgtttctaaaatgcctgtatcccaagcaactagaacacatagttggctatacttaatgaggagtcaagacaaaccattcaattcttctaaaaaagtaagaaagtattcaaagcaccagagtcacaatgttgagctcaggtgcaattttctattcactttacttccagcatggtcgggttaagagtggactacatagcttgaagcggatttcgttgagattcgttgtaattgaatcaacaactgaatgagcatgcctaagtagtggctccagagagtctgctttcagattttcttgccagctttgac

SEQ ID NO: 2107 - DNA, 461 bp, Homo sapiens
  CDS 10..177
taggataaaatgcacacaaatttaagaagtgaactgccttcatgcaacatgcacagaaagtgcacatggagggaattacagggtgactactcacttgcaatggggttaagaagcttatgtaacatcctgacaacaggttatgggagtggtgagaagaggaattccattgaggggcaataaaggattatgaaggagaatgaatggattctggaactgagagtaacttgtaaatagttctctttgacagtgaaagggcctgttctggtgtggtcacatttgtggtcttacaggaaggggaagtaggtatggataaaggaaattcctctatctttagactgtatggggcsgggcacggtggctcacgcctgtaatcccagctctcagggaggctaagaggcgggaggatagcttgagcccaggagttcgagacctgcctgggcaatatagcgagacccgttctc

SEQ ID NO: 2108 - DNA, 544 bp, Homo sapiens
  CDS 193..453
tactatagaagtacttcaaaaacttgtaatctgcctgaagaatttcagccagcttcacaagttcattagttgtattttccatgttctattttatagcaggtgttactattgcaagcactctgccattgcataatacagatggccctttctcaaggcttcaaaggaaatttcctactcttcttccagccttgaatgataggagtagaggctagcctccaccatgacccaatcccacatggctttatttatttacttattaatttttttgagacagagttttgctctgttgccgaggctaaagtgtggtggtgtgatcttggctcactgcaacctctacttcccgggttcaagcgattctcctgccacagcctcctgagtagctgggattgcaggcacctgccaccacaccaagctaatttttgtatttttagtggggatggggtttcaccatgttagccaggctggtcttggaactgacctcaggtcatcccacccaccacggtctcccatatgactttaggtagatgttattgatgtagaaagg

SEQ ID NO: 2109 - DNA, 515 bp, Homo sapiens
  CDS 265..495
  misc_feature 152: n=a, g, c or t
aaacttgtcacctgcagagaaagaaagaagccctagattttgtcaaaaggcggttgcagaacaaaaaaccatggccggaattggaccgataactcaggattgggagccggtggtgatccgtaagaaacccgctaacgccgctgccaascgancgagaaaactgtcaacgccgctcgtcgatccggcgccgatatcgagaccgtcagaaaattcaatgctggaaccaacaaggcggcatcaagcggcacatctctgaacacaaaaatgcttgatgatgacactgagaaccttactcatgaacgtgtgcctactgagctaaagaaagccattatgcaagccaggacagacaagaagctaacccagtcccaacttgctcaaatcatcaatgagaagccacaagtgattcaagagtatgagtctggcaaagctatacccaaccagcaaatcctttctaagctggagagagcgcttggagctaagcttcgtggaaagaagtgagccaagttctactgatg

SEQ ID NO: 2110 - DNA, 352 bp, Homo sapiens
  CDS 3..215
ccatgaacccaaagatccaagaaactcaaagagctccaagaagaataaatattgattcaggccaggtgcagtggctcacgcctataatcccagcactttgggaggccgaggtgggtggatcacaaggtcacgagatcaagaccagcctgaccaacatggtgaaacctgtctctactaaaaatacaaaaattagctgggcgcagtggcatgcgctgtaatctcagctactcgggaggctgaggcaggagaattgcttgaaccagggaagcggtgggtgcagtgagccgagatcgcgccactgcactccaacctggtgacagagcgagactccgtctcaaaaaaarrraataaa

SEQ ID NO: 2111 - DNA, 471 bp, Homo sapiens
  CDS 160..381
ctgcggttgctacataaccgcgtagtttgagccatttctgcgtctggcgggtccttctgaacttgtcaccttcgcttggggtcgcaacgaccgattatcgatgatccaagcaagggaaaagaagccttggcgagagcggaggtttggtgggggcggggaatggggtttttttcccgtccacggaagctttctgggatgggggtgctgtgctcgcatcccgggggttggaattggcggggtcctctgtgccctgctgtgagcgtttccaggactttgacctcgctcagcctgcctctctccaccctacctgtgcgaccgctttctcgcagtgtgacgtggagtgttactcaatgtccttatactttccattgctgtttttggtaatggggacattagaaccatcctagtagaatcgtttttgggaactgaaagagataacgcaaatgagaaccttaaagcagtccctgtcac

SEQ ID NO: 2112 - DNA, 443 bp, Homo sapiens
  CDS 11..349
  misc_feature 233: n=a, g, c or t
agggggaaaaatgcggcctttgactgaagaggagacccgtgtcatgtttgagaagatagcgaaatacattggggagaatcttcaactgctggtggaccggcccgatggcacctactttttccgtcttcacaacgaccgggtgtactatgtgagtgagaagattatgaagctggccgccaatatttccggggacaagctggtgtcgctggggacctgctttggaaaattcactnaaacccacaagtttcggttgcacgtcacagctctggattaccttgcaccttatgccaagtataaagtttggataaagcctggtgcagagcagtccttcctgtatgggaacatgtgttgaaatctggtctgggtcgaatcactgaaatacttctcagtaccaggggcgtggtggtgtactccatggcagacatccctttgggttttggggt

SEQ ID NO: 2113 - DNA, 342 bp, Homo sapiens
  CDS 19..222
aattcgcgctcgggagtgatgagccgccaacaccccagctccgctgctgccgccaccgcagtgctctctagtcgccattggttacctaaactttccagtacccgcracctttccgggactccgcrgcggcggggcagargcggcccaggggcggcacsggctgctccggtgcgccgggctcttttcggccgccgcacggccgggcctcacaggctgccctcctgagagaggctcagaacacggccaggtacgcgccgccgccacagttgcgctgctagcgacgaggtgagtgctargtgtttggwgggccgggcgcggggtccgcaaacttttgcgtacggm

SEQ ID NO: 2114 - DNA, 479 bp, Homo sapiens
  CDS 125..322
attctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcscatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggsttcttcctctttttctttccatacaagtggcttagggatggggtagagtagttgacttatttggatgaaaaccactatcttctgtcagaaactcaaaaggaatcattgctggcatggtaa

SEQ ID NO: 2115 - DNA, 470 bp, Homo sapiens
  CDS 47..256
atgagttaatgacctggtttgagccatgacaaagctttgtttgtagatggggaaaggctttgtgaggacactggaaaggtatttcttgtctgggaaaccctgctgtggtccccagatttccaacctgttagtgaaagacggtgtgggtccaagagggaaagaagtgggtgaagaacgaaggagaggcagaggaaaaattgtggtgttaacaagattcactgtgcttgttaagtgtgggctctgtcatcaaaggaaatgaagtaaaacagaaatcaaaagaaattggcagtgctgcattcagaagctgagctaatattcttcactgtgtaggttgaactgacctctcaggatttgaatatcctgctagctccagtctaaactaggcagagctattgaattttgcatgagcttcctgttagttgcagaacaagttgttggtgctgtttaaaaagattatcagtaaagaagat

SEQ ID NO: 2116 - DNA, 403 bp, Homo sapiens
  CDS 127..378
gtgattacatgcacctgccttagaaggtaggattttcttcccagggacctcctatcaccctaccctgcttcttgaggtccctggagccccaggtgggctgaggggcagggagccggstgtgccagtatgcctcctggaccctccagttctgccacaggtctgccgatgccctgtccactgcctacacattacagacaagtaaccccctcatgggatggggacctacctggctcctcagccagcacccagcttaacccctgccatcccatgctgggccctccaggcaagagtctcagctggccgagagtccaggccttgcctcccccgaccgccatggagggggcagcccggcacagctgctgggagcccttgtgtgtctgatcacactttttaggcgtcacgc

SEQ ID NO: 2117 - DNA, 478 bp, Homo sapiens
  CDS 25..219
cagataagggacattcaacctgtaatgtcaactcaaatgtgccaaggaaagcaaatatacaccatcagtgtgaaaaatactgaagaaaggtggggcttcattacaccctcagattcctgtacatctctgttaagttttaataaaagatgtttaattaataacttttttggcatgctgattatcctaaaagtactttgtgagaatctgataaggatttgttaaaagctcagttttttggagtttatctatatgaatataatttcaagacttcaacatttttagagttgccattgattatgttatgctgcatttgtaagaaatggtactgccctgagtatactcatggtaaaggcagttgagaattacagttttatctcatttgaatttagtgcctttaaaatctctttcaggctggtcatgggagctcacatctataatcctagcactttgggaggccaaggcaggtggatcactcgag

SEQ ID NO: 2118 - DNA, 485 bp, Homo sapiens
  CDS 152..346
attaatcatcaagaagacgtaacaggccaggcgtggtggtdvacacctgtattcccagcattttgggaggctgaggcaggagaatcgcttgaactcaggaggcagaggttgcagtgagccaaagttgcaccattgcactccatcctgggcaatgagagtgaaactccgtctcaaaaaaaagagaagacataacaatcaaatatgtgtcaacataataaaagaaattcagggccgggcgcggtcgttcacgcctgtaatcccagcactttgggaggccgaggcggacagatcacgaggtcaggagttcaagaccagcctgactaacatggtaaaaccccatctctactaaaaatacaaaaattagctgggcgtggtggcacacgcctgtaatcccagctactcgggagggtgaggcaggagaatcgcttgaccccaggaggcggagattgcagtgagccgaggtcgtgccactgcactccagcctg

SEQ ID NO: 2119 - DNA, 485 bp, Homo sapiens
  CDS 242..439
taatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtagctgtacagattgctccagtttgccttaaactatgcacatagctaagtgaccaaacttcttgttttgatttg

SEQ ID NO: 2120 - DNA, 375 bp, Homo sapiens
  CDS 25..204
  misc_feature 130: n=a, g, c or t
cagtccctggacagctacgacgccatgaatatcttgcccaagaagagctggcacgtccggaacaaggacaatgtcgcccgcgtgcgcgtgacgaggcccaggcccgggaggaggagaaggagcgtgasgnagggtgctgctggctcagcaagaggcccgtacagaattcctacggaagaaagccagacatcagaactcactgcctgagcttgaagcagcagaggcgggagcccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggc

SEQ ID NO: 2121 - DNA, 407 bp, Homo sapiens
  CDS 102..320
aatcagcttcagcaatggagcgtgcaaaacaccagtgagcttctgtcttgctggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagrgatagaggaattcaaagagaggttacggaagcggcgggaggagaagctccttcgcgacgcccagcagaactcctgaggcctccaagtgggagtcctagcccctcccctgatgaaatatacatatactcagttccttgtyattcaaaaaaaaaaaaaaaaa

SEQ ID NO: 2122 - DNA, 395 bp, Homo sapiens
  CDS 122..379
tcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggacyatctcggaaaggcctgacagctgccasccgscaggagctgctagccaaagcattggagaccctactgctgaatggagtgctaaccctggtgctagaggaggatggaactgcagtggacagtgaggacttcttccag

SEQ ID NO: 2123 - DNA, 533 bp, Homo sapiens
  CDS 115..378
aacatagctgtgatgtggccaggagtgcgcctcaaaaccacgtgcaaataataaatgcggaastcccgtttcagattttaaaagaaaagaaaagaaaaaatcctgaaaaacagaatgaagagtctagaatttcactggcctcgagatggtagtctactcctcaattttaaacaagaagagcccagagcagaaaagggacctgtcccggacaagatctcagagctaatgcccctaaacgcagcgcagtgccctgttcttaatttagatagggtgctggaaaggcgaaatcatgctggaacggaggccatcgatctcacttcctccggccccttcctsstcttcggcagatgcgcagtgaatggtcaggccctccgtgagtgaattacagattcattgaagagccgtcagatgaccggagcagtctggtttcttccctttttatcgagttctgtcattgtgttcctcaaactgtggtttgttccagaaaggaagaggttgtcttcttcacccgcctgcctaagttgcgtcaagtt

SEQ ID NO: 2124 - DNA, 448 bp, Homo sapiens
  CDS 84..248
ccggttctccgtttgcgccattgccctggtggttccgcctcgtgggttagatcccaaattacgcccgctctcgatccttaataatgggaaggggcttccacttgtcgccctccgcctcctgcacctcagtgacttccctgaccaaggaggaagaattggcgtgcagcctgggcttccctcaatggccaccattccgctggcacaatgtagtgccctgccccgggcctcagtttccccatctgtggaactgagtgtggcctcgacgtcaaaaatgtggactctggtccggtcgcggtggctcacgcctgtaagtaatcccagcactttgggagaccaaggcgggccgatcacttgaggtcaggagttcgagaccagcttggccaacatggtgaaaccccgtccctactaaaaatacaaaaagtagccgggcgtggtggtgtgtgcctgt

SEQ ID NO: 2125 - DNA, 437 bp, Homo sapiens
  CDS 12..203
ttgtttgttttatgagacagggtcttgctctgtcacccaggctggagtgcagtggtgcaatcagagtttactgcaggcttgacttcccaagctcaagtgatcctcccagcctctcaaatagctgggaccacaggcacctgccaccctatcctgctaatttttgtattttttgtaaagatggggttttgccatgttgcctaggctgatctcaaactcctaggtgcaagtgatccctcatctttggccctaagtgctgatattaaagtgctgatataaaagccgacaagatgttatactcagaaaaagctgaagacgccaccaagaaactaatagaactgataaacaaattcagcaaagttgcagaatacagagtcagcatacaaaaatcagtagcatttccatatacccaaagtgaacaatctaaaaaagaaatcaag

SEQ ID NO: 2126 - DNA, 455 bp, Homo sapiens
  CDS 169..354
tctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgwatcyctaagttacatgacctatatctttyccyctttaatagtagttttatgttaacctttaagagatttgtttttcctcaaaggrgaatttaaaggtattttttaaaattctaataagaggwtcagccgggtgcaatgactcatgcctgtaatcccagcacgttggraggccaagtcgggcggatcacaag

SEQ ID NO: 2127 - DNA, 428 bp, Homo sapiens
  CDS 163..330
  misc_feature 406: n=a, g, c or t
tttcacttttattgcccaggctggagtgcagtggcgcagtctttggctcactgtaacctctgccttccagtttgaagcgattctcatgcctcagcctctggagtagctgggattacaggcacccaccaccacgcctggctaatttttgtatttttagtagagatggggtttcaccttacttgccaccctggtctcaaactcctgacctcgtgttccacccgcctcagcctcccagagtgttgggattgcaggcgtgasaccacgccccgcctcctcagacttttaaaggtattgcttcattatagtaacttgagaaatctggtattattttgatagttgatattttatttattttattttttttgagacagagtctcactttgttgcccaggctggagttgcagtngcatgatcttggctcactgcaa

SEQ ID NO: 2128 - DNA, 359 bp, Homo sapiens
  CDS 139..324
  misc_feature 33..34,113: n=a, g, c or t
gatctctgctcgccttggggcgrrgccgtgcwnncgctgcggctcctcggcctgctccgccgtctggtggccgccccgggctgactttgacttagcgatgcctttcctgatgncggawacagtgacccagcacacctaatgsccccaaaccaaagccagatccaaaccccaaccgacctggtttcactggtgacccagcaccacctaatccccccaaaccaaagccagatccaaatcccaactgacctggtttcactgataagagcctctaaccctacggggtggtctctatgttgtttacctggcagtgatgtccgtgkcatctgagaagaggagatttcaggggctgactttgrctt

SEQ ID NO: 2129 - DNA, 546 bp, Homo sapiens
  CDS 292..474
  misc_feature 391: n=a, g, c or t
acttagctgagtgatcatatgtaggaatcaccagagttggttggctctctcagtggggtttaaagtacagtgtaaatagggtaaactcttcattgtggcatctataaatccatttacattcagacagcaagtgaagcaaagcaaataaactctactctggctgggaataattctgccctgataagctggctggaggaattttggaaggggtgaggcatacactttcttctatgttcctgaaaccacaacattgttaggactcatctgttcatgagaccagaccaatagaaaatgagcacttcgtggataaaaaatacagatggaaacttagtgaaagatcactctgactgctacatggaaaatgtgctggggagaaagaagactgcagganataagagcagtgaacaagctcttgctgtaattcaagtcaggtgtagaagctggagctggagcagccattctgaactatgtcggtaagggcggtactcccatggtggcttggaagtgagctggagggcaccaaggtgcatgatgatatcatggggt

SEQ ID NO: 2130 - DNA, 501 bp, Homo sapiens
  CDS 103..372
ctttttatggtagggctcagggtgaataacttctgtgtttcttttctagtctgcgaaacttgtatctgttttaaagaaggcacttgaaattacaaagtaagtatgaagacttctcagatagctttttgtagtaaaacggaactgctgtccagacgttctcaactccctagctcccatttcaaggagtgggaaagggtgggtgtgggattttctttcagcttcagttgtggggcagctgagattctgcaaagaagcttcccttttaaaaaaattttagttttccctgtgctccctcctgaggataggttttcccttgacatcctaataagtttaacttacttctttcctattctattcacagagcaagtcatgtgacccctcagccagaagatagttggatccctttacttattaatgccattgatcattgcatgaatagaatcaaggagctcactcagagtgaacttgaattatgacttttcaggctcatttgtactctct

SEQ ID NO: 2131 - DNA, 513 bp, Homo sapiens
  CDS 47..295
cctttttcatctagaaactattagtttttattgtctttttcttcagatgatagaagatgttttgggagaagggtcagtctctgccagtcggttcagtaggtggttctctaacccgagcagatcaggaagccgatccagcagtcttgggtcaacaccacatgaagagctagagagacttgcaggtaaaatggcttcagattctgcccttgaaggtaaacctgggtttttccctgatatggttcattttatcttcattagtcaggagtcaattagggtcaaagggtctctggacaactgaaaagccttcaatttgtgtccttttaatattgttgaaggggccgggtgcagtggctcacgcctgtaatcccagcactttgggaggccaaggcaggcagatcacaagggttaggagtttgagaccagcctggccaacatggtgaaaccccatctctactaaaaatacaaaaaatcagccaggcgtggtggcggcatctgtagtccagctactcagga

SEQ ID NO: 2132 - DNA, 388 bp, Homo sapiens
  CDS 106..366
gtaatagtaacggtccgtttccggggtggagccagggagggcgggagtttaggctgcgctgacccctctcagccccccctccaggagacgttcggagcccaggacatgtcgggaatgaggagatacgaggtggcgctggaggcggaggaggagatctactggggctgtttctactttttcccctggcttcgcatgtggcggagggagcggastcgggcgcaccccggggagcagaagctggagcctctgcgaggcctgatgagctgtctgtccagcggcctgggtcctactccccagcgttcgggtcgtggcttcccccgccgcagccccaccgccgctgcccagccagccagtgcattaaagatttaaaccaaaaaaaaaaaaaaaa

SEQ ID NO: 2133 - DNA, 432 bp, Homo sapiens
  CDS 199..420
cttttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaagggaagttcgactgcataagacaacatg

SEQ ID NO: 2134 - DNA, 277 bp, Homo sapiens
  CDS 50..208
  misc_feature 140,189,269: n=a, g, c or t
agttgggattacaggcgtgasacttgcgcctggccatcaggtaacctttatggctctttcaggaaaagtgaaatcagagaggcgtaccctagccacagctgttgtattctgctcttctttcctttttggtgagcttcatnggtggagttatcagtggtctgtactttgtggatattttgcccagcaggnagtattagacacatcagtctagaagcattgtgaaaaggttccaaaacggggacaaaatttaattcattcctcagttctgnaagtttgt

SEQ ID NO: 2135 - DNA, 503 bp, Homo sapiens
  CDS 9..200
aggcggggatgctgccgctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtccttggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatg

SEQ ID NO: 2136 - DNA, 458 bp, Homo sapiens
  CDS 191..349
  misc_feature 434: n=a, g, c or t
catctaaccaaggatcagctgatgtataaggagaatcaagaaatgataggaacaaaagcactaaaataagtgatggggaaaaggcaatctttaggaaacaaagacagtgctatttcagaagactgaaggaacttttccatagttttctcatagagttcaagaggacagtgcctcataaaacaaaaatagaatgttgtggaaagaactcaaaatttcaccagaatgcagagaagataaagtcaaggaactctctcagaaagtacccaagaaagccaaaagttggaaagtgcagagaatagataagagcgatagagaagcaatccaggccgggcatggtggctcatgcatgtaatcccagcactttgggaggctgagagagaggatcacttgaggccaggagtttgagacccacctgggcaacatagtgagacccnatttctttaaaaaaaaaaaaaaaa

SEQ ID NO: 2137 - DNA, 508 bp, Homo sapiens
  CDS 280..429
ttaaattattttatacgtatttgtkagggtcttgctatgttgcccaggcctggtcttgaactcctggcctcaagcaatcctcccatctgagccttccaaggtgctgggattacaggtgcatgccaccatgcctggccagaagatgtttttattagtgtttaaaggtatgaatggtgtcaccgggagctgatatatttgttttcatgatgttgtacatttatttttgtgcagtaacatacattaaatgattgtaattttgtgtgtttttagaacactattatgaaatatccagataatacagaatcagagctggaaggcaggcagcttgaggattatctagtccagtgtttgccagatttacctgatgataagatttacttggggctgggtgcggtggctcacgcctgtgatccaggcactttgggaggctgagacgggtggatcacctgaggaagggaattcaagaccagcctgaccaacatggagagaccttgtctctgctgaaaat

SEQ ID NO: 2138 - DNA, 476 bp, Homo sapiens
  CDS 47..226
  misc_feature 91: n=a, g, c or t
gtgcagagggagcgggassgacgggaggtcttctagctttggttctatggtggcagatccggctgggttccgggaagcgagggcctcgcgnggtggctgggttggtgaagggctactgcggccgaagggagcccgcctcacttcattcttccactctgagggacccgctctcttctggtcactacgtcttcctccctcacttcgcttagcgaaggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtactccaattttaatgagctatgtgaatcgctacatcaa

SEQ ID NO: 2139 - DNA, 479 bp, Homo sapiens
  CDS 85..297
  misc_feature 262: n=a, g, c or t
acacattagctttgagagtcagtggaggcctctctgagaatgtcattggagctgagcacctaatgatcagagggagccaacaatatgtgggatgtgtacttgagtgtagcgtasaccagaaccccgttgaacaaaacttcaaagtgtagaagagatagttggggaaattgtattcctttatggatttctgagcttgtgaggtccatgtgcattggagagcctagaggaactgtagatgatcaggtcagtttggggtcctggnasattatgatctctcccaggggtagatctctctactaggggtagagttctagagaatcagactaaaacagaatgtatgtcccatgacttatccctaacacattgcctgttaccaagagactgttattcctgggtaaagggagaagtatagttgacgagggactaactagcctacaggcctctgaacagagtaatttttctcatattctcctttggaa

SEQ ID NO: 2140 - DNA, 428 bp, Homo sapiens
  CDS 89..289
gagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttscccgacccagtgaaagagtgttaagacttcgacctaggacacattgagaaccaaggc

SEQ ID NO: 2141 - DNA, 463 bp, Homo sapiens
  CDS 144..449
  misc_feature 29: n=a, g, c or t
aaagttgcaggtcatggcgctggctgctnactgtggcgccttctgcctttccgacgtggagccgccccggggtctcgtctccctgcgggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagcctagagtatgcaaaa

SEQ ID NO: 2142 - DNA, 497 bp, Homo sapiens
  CDS 330..494
taaaacatgtccacaaaaaagacttgtatgtgaatgttcatagcaacattattcacagtggccaaaaactggaaacaacccaagaatccatcacctagtgaatggttaaacaaattgtggtatatccataaaatggaatactactcagcaacaaaagggaacaaatttacagatacatagaacagcatgcatgaattccagaaaaattgtgcagtcaaaggaataaaactcagaagaccacatacaatgttcattcatatgaagttctggaacaggcaaaactagtctgtaggtacagaaagcaaatcagtggttttctggagtttgacatgggggtactaacaagggaactttttggggtggtgggaatgctgtatattttgattgtggggatggttacatggttggatgcatttgtcaaaacacacttaatggtaatgcaaaatgaatatattttgattttatgtaattatacctcaaagtttgaatttttttaa

SEQ ID NO: 2143 - DNA, 493 bp, Homo sapiens
  CDS 287..466
tttgcctgtctcactgggcagagctgtgagtggctgagtttccatacaggacaatcagctctgtcatacttgagcaatggcccaggggaaatgggtctttgtgtaatggcagcggatggtgacctcacacctcacactggaaacacacagtggagccagctgatcaggtcgaggtaacccaagaggacatgcagccctggacgccacgagaaatcctgttgtctgtcagttgagtggatcaaaggtgcaccggcccagaaatggcctccagcaacagggtctcactatgtcacccaggctggaatgcagtggcacaaccatgactcactgcagccttgaactcctgggctcaagagatcctcccacctcagcctcccaagcagctgggactacaaggcatgcaccaccacacctggctaatgtagagtcaagagtccccagctatgttgctcaggctgaagacttctgagaagtgtaaatgctaagttcaaac

SEQ ID NO: 2144 - DNA, 533 bp, Homo sapiens
  CDS 92..256
gttattttgcgtgaattggtgaggacattaagtccgggtagaaagaaatgtcaggagtagaggtgaagactttaaagaaatacgttgttaaatgctgaatctttgcttgtttgggtgtgttttgttgttgtttgtttttgtttttgagacggagtttcgctttcgatgcccaggctggagtgcagtggcgcgatctcggctcaccgcaacctcagtctcccgggttcaagcgattctgctgcctcagcccctcgagtagctgggattacagvcatgcaccaccacgcccggctaattttgtatttttagtagagttggggtttctccatgttggtcagggtggtctcaaactcccgacctcaggtgatccacctgtttgggcctcccaaggtgctgggattacaggcgtgasmactgcgccctgccttggtgtgtttttttaaacctacttacttgtttagcctaggtctgttttcatttactttctacttaatgttgtacaactcaaggaatttctgcctttcgtttatcgg

SEQ ID NO: 2145 - DNA, 454 bp, Homo sapiens
  CDS 218..406
agcccggcctacttcctcgccagagaaactgctgtcttccccggcggtagggaagggttaatgccaccgagtatccagacccgctgaagcctagagggccttgtaccggctcaccgcgtggctgtcgctgtctcgtgtccccagtggggaggcgtcgcactgccacgtctgttctgcgtggctgtcgggcggcgtttggtcccgggagcctcgccggatggagtctcgctgtatcacccaagctggagtgcagtggcacgatcttggctcgctgcaacctccacctcccaggttcaagcaattctgcctcagcctcctgagtagctgggattacaggcgcgtgccaccacacctgacttgtatttttagtagagacgaggtttcaccatgtttctcaggttggtcttgaactcctgacctcgtgatccgcctgcctcagcctcccaaagtgctg

SEQ ID NO: 2146 - DNA, 431 bp, Homo sapiens
  CDS 83..259
  misc_feature 156: n=a, g, c or t
cacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgnbvraatcaagttactttcctcatcctcagagactttgacaattcagagctcacagatggcagggggaattctcaggcttcccttcctcctgattgacactttttaaaggaagtgatgtggaatttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagta

SEQ ID NO: 2147 - DNA, 408 bp, Homo sapiens
  CDS 56..244
gttcttcccggaagtgccctggtggtgctgggaatagggcgcaagatgtcggcggatgcagctccgaggaggtaggcagtgggagccggcgttcagtccggcccgtgccaacagtggttcctctctcccccgtagttcgaggagaccacgcgctgcccctctggcacgatcgtggatgaaccccctggcaactgaaatgggaaaggcagcgccccgactctggggactggaccgaagtccacggtagtgacagctgccagaccctgaggagaggacgagaagacccgaggcctctgctacgaacactggcagccgatggaaaattcagacggatttgggacagtatgcagagttctccaagcgacagattaacagaggctcttgaagaataactgcgtaatcacgtgt

SEQ ID NO: 2148 - DNA, 564 bp, Homo sapiens
  CDS 310..462
aggaatgcccctcccaggctatcgctcctctgcaggcttccgcagctccccagcccctgtgctcctggaccctgcctgcctcctgcccgcctgcgtgactcactgagggccccctccctatctttcactttcacccagcacccagaaggggagtaatttcctcctccatttccttcctcagctcctgggccttgaagagagctcctctctgcagcaaccaatccttgaccagacccacaggtacccctgggccaaagacaaggcaacaatcaagaccaaggcctgggacctagcctttcaggaagttctatgagcctgggagcagcagggcctggagacaacatgatccaagacggagggcagtggactgtttgtcaggcatcgtggcgcacacctgtaatcccagctactcgggaggctgaggcagaagaatcgcttgaacccaggaggcagaggttgcagtgagccaagatcgtaccactgcactccagcctgggcgacaagagcaaaactctgtctcaaaaaaaataaataaagtcttggctctacaaaaaaaaaaaaaaa

SEQ ID NO: 2149 - DNA, 295 bp, Homo sapiens
  CDS 70..237
  misc_feature 83..85: n=a, g, c or t
atcatcaccgggacgctggcagggagtgtgtgtcatggttacaatagagtgtgctaacatataacaaccatgaaagcccagcnnnaaaggctacagattccggggctgaccttggatctcactcccaggagcctgagtccaaccccatccagcccaggcagtccttgtagtcctctcttggcctttcacttttggagccctgtgtgtccaaatgctgggagaacatcaccccttggatgaattgccaccacattaaataaaacatatccaaagcccagaaaaaaaaaaaaaaagg

SEQ ID NO: 2150 - DNA, 336 bp, Homo sapiens
  CDS 160..315
gttactcagaagggaagggaaggtgtggttgtgcggcggagtttttgctttcattcttttaacgttcacagccaaagcaaaggcctttggggattgccagagtctcagccaccatcctggaaaacagcgggggaggtgggcctggaggtggcaagtgtaatgtggctcaggggccgtcattgccccttgcagaaggggctgcgggggagggagaaaacctgcgcccggttctggggagctggcgacgcagtgaaccctgctgaggctgggttttgccccgacagtcgctggtggctgtgggaagggttgggaccctaaaaaaaaaaaaaaaaaaaa

SEQ ID NO: 2151 - DNA, 449 bp, Homo sapiens
  CDS 174..440
  misc_feature 79: n=a, g, c or t
cagtttcttgagccagccccagcgcctggtgctgcagtcttatcttcagagcctgcagagcctctgttggtcaggcatncccctaggccccggaccaccggccccaggcccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggcca

SEQ ID NO: 2152 - DNA, 572 bp, Homo sapiens
  CDS 136..330
tagatttttgcaagtttttaaggagatttattttgtacaagttctaaagcagtcttggatcatgatacaaagataccttcaaaagctgcattataattttttttttctgtaaataagtcccttggccaaataaaaatgcaaaactgctttatccagcttgtacctattggctttgtccgaggaaaccagttgcctaatttctttcccttgccttatgtttgttgcagccagcccagggctgtttccggctgcagtgttgaacacaggaaccacagtgtgttgctggttgtgtgcgcaaggcacgatcaaaagcgcatgctttggaaactatgatgtgaggacctgtcttagaggataattcataggaaaaagttgaagcatattgccatcgaagcctttaatgtggggtcttctttctgtttcaatccctctccccgcccccggcaataaatcctttcttatctatcctaggcaataagatgtatttgaaaacaaaattactccagatcatctttactgccttgaagactaatacctttctttcatatgaatttgctcagtcagcagatttt

SEQ ID NO: 2153 - DNA, 398 bp, Homo sapiens
  CDS 18..239
  misc_feature 14: n=a, g, c or t
atttttttcggcanacaatggggccggagcagggaacgcggccagccgcctgcaatcgctgcatctgcgcccgctcctgtgctccggcgtcctacctaaccccgggaagtcagagccgctgggagtttctgacttactcgaagaagtctgtcctgggcaaagagcacacacgaatagacttcagattagctgcttctctggaaacgcataaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcag

SEQ ID NO: 2154 - DNA, 523 bp, Homo sapiens
  CDS 20..181
tacttatgaagcgcttaatatgcagcctcggtttctttatctgttaagaatcgggataactggggcttctgaaggggtagggtsatgtagcstggtggtyaggacstctggctttagagatggacaggttttggtttgggctctggctcagctgcctccttgstttatcagcttgagaagttaataatctccaagtttccttatctgtaaagtaaggaaaataataactacctccctcataggttgtagttaggaaaaagatgttgtgaggctcaggtggtctgagggatatagaattgctttctcaaacatgatatgttgctttgcccaatgcttaggagggagttgcggttaatagttgaagtgttctgcaagtaagtcttttggatcagtataaggctgtgataattcttattatttggtttgtgtccgtgcatgaaagcagaaagcagccagaggagtccatgattcaaggagcatgagaattactgtttgcaacaccatgttttctgaattccagtat

SEQ ID NO: 2155 - DNA, 499 bp, Homo sapiens
  CDS 288..485
gtaagagttagggtttgaccggagctagtgaggatccagcccaggctccagttgtccgcggttcctcctcctgtcgctgcccgtgtgattactgagactcagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcasccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaagcttgtcctgaaagaatgttgtgcatttcttgaaagccaacttg

SEQ ID NO: 2156 - DNA, 600 bp, Homo sapiens
  CDS 280..450
agttctgatcccggacgaccgtaagkgcaaactcaaagacctacttccaagctgccgtccatgtgctgcccaatgaagctgcaacacgtgaacctctgtggaaggcgcccaccttttctccagtccttctctcactgagtgccctatcaaaatggaagaatccctgaatgaacccatttcaagtttgaattgtgctttgagagaagaaaaatagctccaagcattctgagctctgtaaagtactcgggaccagagagacaggagtgtgagacttcagtcatgcctgcctccagccctcccctgccccatatctggggtcaattgtttaaggtagtaagtccctgcattcccaagtacttgggaggcggaggcaggaggattgctggagcccaggaattgaaggctgtggtgagccatgattacaccattgcactccagcctaggcgacggtgagaccccatctctaaacaaaacaaaattttaaaaccctacttgtaattgttgctagtcccagtgaatattcactggcagcttgaatctatgctctcgggaagcatctcaagcttggccaaataaactatttacattaaaaaaaaaaaa

SEQ ID NO: 2157 - DNA, 510 bp, Homo sapiens
  CDS 17..400
  misc_feature 452: n=a, g, c or t
aagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtggtgatcagtaccggccacgacaagtgtgtgagctggatgtgcacgcggassgnaacatgctcgggaggcacttcttcacgtcctgggcttcgtgtctgcagtatctttcag

SEQ ID NO: 2158 - DNA, 486 bp, Homo sapiens
  CDS 175..483
acaatctcaaataactccgtcccttccggccttccctctatctttcgctcgctctcggcgacastgggcgaccgtcgtcgcgccgcccttctctaggtgcccaggtcttcgccggtccctttgccgcctcttcgccgccgatgagcaccagctaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaasatcttgtagaatctgtcaggaaaacttcagcacaactgttaatgcactcactgagcctattgatatatatagtgaatggattgacgagtgtgagcgtgtcaacactgttgaaggcgacgatgatgcgtgasttgccccatgcgatgaaactgttacctaccatcgtaatgtaa

SEQ ID NO: 2159 - DNA, 488 bp, Homo sapiens
  CDS 227..472
  misc_feature 18,137: n=a, g, c or t
aaattccatggtcttttnyttttttaaattcactgctgsttcsagtttcgsgtccgastgctcgctccctgcccttccctctacctctctccctagggtttctacctcgcgcccgcttccgactagcagcgctasbncgcctaactccgaccgaggggacaacgagggtttwgggacggacgggtgggaggtttgaaggaggcagcggagggccggagaccagaccatgaggccggtgttctgcggsaacttcgacsacgacacccgccagtatgacctcgagcgcctcttctccaagtacgggcccatcagccggatcgacatgaagctaggctatgctttcatttactttgaagatgagcgtgacgcagaagatgytataaggcgtctcgaaaatgtgtcttttggttasaaccggcgcaggytctctgtggaatggtctaggcaagttgaaccgggtgccaaagagccgtgataggcctactggg

SEQ ID NO: 2160 - DNA, 503 bp, Homo sapiens
  CDS 138..311
  misc_feature 213: n=a, g, c or t
aacaaaaatgggctaaaataaaaacatttcggtctcatctccgtccacatccgtcctccagcactccagctgcatcgacgaggaccgccgtagcgatttgcgavrggtgacgggagaggaacccgaggaaggcgaaaatgatctaccgcaactggtcgctgctctcgtccacagtcgtcatttggggcggcgtcgcaccgccggcctcgccgntaatcttcctcttgggcggcaaggagaaattcaatggttatctgtgccgcgaaggcgagaggcttaggcagcaggacagagccgcgatgggccgaagctaagcgttacgttctttggtatctcaagggagcaatagcccttcgaaatttcacaagattcctgcgtccctaccagaacaagtccctatctagggactaggatggaatccatccttctgcaggctttcactttcctgataataacagtaacaataaattgacaatggtttgtgttcttctggcaaccttttt

SEQ ID NO: 2161 - DNA, 470 bp, Homo sapiens
  CDS 24..257
agatgcttgttgttctatagtgcatgtggtttatgtatgacataaagtatgactcactttggggtacgctggcaaatggacttttggacagttccaattatcatcagaatagatttgctaatttaattctactttttagagtggaattagattctgaagttttaaaattacgtgagatttgttcttctaacagaggagtctgtagcctttcattgaaaaaagaagagtctggggccggccgcggtggttcacgcctgtaatcccagcactttgggaggcagagatggcctcacttgaggtcaggactttgagactagctggacatcatggtgaaacttgtctctactaaaaatacaaagattggccaggcatggtggcgcatgctgtaatcccaactcaggaggctgaggcaggagaattgcttgaatccgggargtggagattgcaatgagctgagatcacaccactgs

SEQ ID NO: 2162 - DNA, 391 bp, Homo sapiens
  CDS 17..223
tttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggccctcctgcgcacagtgttgttcagtttcacatggtacaaataagtaaaaccaaatgagcaa

SEQ ID NO: 2163 - DNA, 458 bp, Homo sapiens
  CDS 106..276
  misc_feature 458: n=a, g, c or t
catatgtacaaggtgttgtagaggtacaaaggaaagttattcagactaggcaagagagtgattaaacttaagtattgaagaacaaatagatcatagctctaggggatgtggaacatacaaagtggaaagtttgggaagagtattcccaaggcaaaaagcttagcacatacaaacataggaggaaagcgagacactcttaaagagttgctatgctttgggaggtggaggcgggcggatcacgagatcaagagattgagaccatcctggccgacacagtgaaaccctgtctctactaaaaatacaaaaattagctgggcgtggtgcgcgcctgtagttccagctactcaggaggccgaggcaggagaattgcttgaacccaggaggcagaggttgcagtgaactgagattgtgccactgtactccaacctggcaacagagcgagactcttgtctcaaaan

SEQ ID NO: 2164 - DNA, 495 bp, Homo sapiens
  CDS 75..224
aaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatgaggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtgacagctgatatttcacccagctgctggcttgtgggtgtggctctttgctttatatatatatacacacatgtgagtctggctgggctggtattttgtttgatcttc

SEQ ID NO: 2165 - DNA, 505 bp, Homo sapiens
  CDS 79..246
ttcattctaaattatttcacattcttaaaaatacatatacatgtatacataaatatatagagattcagatttatttatatgtgggattgttttctttttccttcccaggtactaatttggtcgaagcagataaccaagcggagtgaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcaggcacctcagtgtctctgcagaacagtggcttcctctagtggaggtaaaaccacctcagctaattgattatctgcagcagaagaaaacagaaggttataccatcattggagtggaacaaactgc

SEQ ID NO: 2166 - DNA, 520 bp, Homo sapiens
  CDS 66..275
tttaaaattatttgtttgctggtcctatttactttgtttaagtcttttttttttttttttttgagatggagtcttgctcagttgcccaggctggagtgcagtggtacgatctcggctcactgcaagctcctcctcctgggttcctgccattctcctgcctcagcctccagagtggttgggactgcaggcgcccgccaccacgcctggctaatttttttttgtatttttggtggagacggggtttcgccatgttggccaggatggtctggatcttctgacctcatgatccacccacctcagcctcccaaggtgctgggattacaggcgtgagcaccgcgccctgccttaagtcttttttaaaattcatttttatttgtagttttatatagtggagtacaagtgcagatttcttacatgtagtattgtatagtggggaagtctgggcatttaatatacccattacctgaatagtgaacattgtagctaacaggtaatttttcaaccttcasccctcacccac

SEQ ID NO: 2167 - DNA, 512 bp, Homo sapiens
  CDS 197..376
agtcctcagggtccctaacgtactggacagagctaggaaagcaaacccatttgcttcttcctgcaggaaaccccttgaggttaagaccccacaatcacatgaggatggagtggctcaccctcagtcaacaggccagactcaaggggttcctggcaagtcatttctccctcgggccttcggtttcctcacctacaagatgagagggctggaccagatggaaattcagggggtaaggggatgtcctcacgcagcccacccccacccccacggaccctggagcctccatcccagttcccaccacgcacccgctccacaaatcctgcccaaggtcagcaagaaaaagaaagacactaccgatacatgcaaacaacatggatgaaattcaaaaacatcatgttggcaaaacatgccagacacaaaaaaggataatcccatctttgtgaagttctacaatgggcaaaactaatttatggtgaaagaaatcataacagtggttgccttggggtggggga

SEQ ID NO: 2168 - DNA, 398 bp, Homo sapiens
  CDS 173..322
ctacaagcmggcgcggcgggcggtgccctacaagcgccgcacggtggagtgcgcggcgggcgacgcggacggcgagctgcgcgtgttggcctgcttccacaccaaccgccacatccccacgctgctgaacctggtggaggcgtccaggggcaccgcgcgccgccgcctcaccatgtacgcaatgcacctggtggagctctcggagcggtcgtcggccatcagcctggtacagcgcgcgcgccgcgacggcatgccctttttcagcggcggcaaggagcagcgggcggasaggtggtggtggcgttcgadgcgttccagcagctgarctssgtgsgggtdcgcrccatggacggccatctcggacctggacaccatccaccgcgacgtcatcgacagcg

SEQ ID NO: 2169 - DNA, 493 bp, Homo sapiens
  CDS 83..319
gatcaaccattccccaaaacccccagccttcctagggttttgctcagcgagtcggagtcggatccagttctgcgggatcgccatgtcatcgcgtccgtcgttcaagttgaagcccagggtcaagggcgggaagaagggcgccgccgccgacgaggacgccaccgcggcatcgaaggcgatgcggatcgtgaaggagtggacctcatggacgatgacgaaggcaaaggtggtggtgcactatggcttcatcccgctcgtcatcatcaccggcatgaactccaatcccaagccctccgccttccaggtcatctcccccgtctgatcgtttctccccgacgaggcccggatgcggtcggttcgtctgsttttatagtagtttgtagctagtatttttagttgatttgctattgtccgagatcgagttgaaggtgtctgatgctttctgcccaaatttgaaggtgttttctgactatgtctactatagttcggatca

SEQ ID NO: 2170 - DNA, 532 bp, Homo sapiens
  CDS 18..497
  misc_feature 429: n=a, g, c or t
gtgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctgnaacagatgattgcacataccacgtggcgggaccttttttataaactggctgaagccatccagactgtttgatgctgaacttcactgttaagctatttctgacg

SEQ ID NO: 2171 - DNA, 419 bp, Homo sapiens
  CDS 29..214
aacagttccaggccaggtgcgatggctcatgcctgtcatctcaacactttgggaggctgaggtggttggaccacctgaggtcaggagttcaagaccagcctggccaacatggcaaaactctgtctctactaaaaaatacaggccgggtactgtggctccctgtaatgccagcactttgggaggctggggcaggcaaatcatgaggtcaaaagattgagaccatcctggccaacatggtgaaacctcgtctctactaaaaatacaaaaattagccaggcatggtagtgtgcgcctgtagtcccagccactcgggaggctgaggcagaagaatcacttgaacccgggaggtggaggttgctgtagccgagatcgcaccactgcagttcagcctggcaacagagtgagactctgtctcaaaa

SEQ ID NO: 2172 - DNA, 506 bp, Homo sapiens
  CDS 213..431
ttttgtttctagttatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgca

SEQ ID NO: 2173 - DNA, 491 bp, Homo sapiens
  CDS 327..476
  misc_feature 57,89: n=a, g, c or t
aagaaaacactgatcgcgcatctcatctgcagcaagagacagggtcccaccattttncccaggctggtctcaaactcctgagccaagtnatccacctgcctcagcctcccaaagcactgggatgacaggcgtgasaccatacccggccccagcagtacaatctgagtccgactctcttcgtcgacactcagctgaagaacagccaaacttgccggcagaatgaggctggctcaggtgactaaagagggggccgtgctgtttgccaagacacagctacaggaagaggagcccgcgggagagttcgactcttttcatcgacaacattaatgcctcaaaagaaagaaaaaggccaggcatgctggctcactcctgtactcccaacactggaggatcacttgaggccaggagttcaagaacagcctgggcaacaaagtgagatcccatctctacaaaaaaaattagctggttcaggaagctgaaggcaggaggat

SEQ ID NO: 2174 - DNA, 564 bp, Homo sapiens
  CDS 262..525
aattggctaaagccagtcacatggccaaaaccagaaataatgtatggagggactatacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaactcgtccagatattgtagaagtcagtcgatgatatcagatgtcatgatgaatat

SEQ ID NO: 2175 - DNA, 474 bp, Homo sapiens
  CDS 12..209
caaagggaaaaatgcaaaaattggctgggtgtggtggctcacacctgtggtcccagctacttgggaggctgaggtgggaggatcgcctgggcctggggaggttgaggctgcagtgtgccatgatcgcgccactgcactccagcctgggcaacagagtgagacccccctatctcaagaaaaaaaaacccaaattttgtttcataattatgtaaattaggcctgggcatggtggcttatgcctgtagtcccaacactttgggaggccgaggcgggcggatcacttgaggtcaggagttcgagaccagcctgagcaatgtggtggaacccatctctaccaaaaatagaaaaaattagccatgcacgcctgtggtcccagctacttgggaggctgaggcaggaggatcgcttgatcctgggaggcagaggttgcagtgagttgtgatggtgcsactgcactccaacctgggtaataca

SEQ ID NO: 2176 - DNA, 520 bp, Homo sapiens
  CDS 158..379
agaatatttgggtgaaggagtatatgctgtcagtggtgacctcctcttcttctgacccatgccctaggtatcaaagtctcaacagccctagaacgctgataacaaagggaagccatcaagctgaaaccacaacagaacagaaaacagctctgtgtgaatgggcaggaaggtgaagggagtaaagccagagagagaatgtgccaggtgccataatcagtcaagaaacatcacatgtcttctgcgcatcaatctgcatgattattctcttgtctcagatctgattactcctgaatttcaccaaacatttaaacagaatcaaatctttgaaaaaattaaggaggaatactcccaaactcattttatgaagccagcattaccttgatacctaagccagagatggacattacaagaaaaaaaaaaattacagccaatattcctgatgaacacagatgcaaaatcatccacaaagtagttgcaaatgaaattcaaaagcactataaaaggatcatttattatgatc

SEQ ID NO: 2177 - DNA, 452 bp, Homo sapiens
  CDS 59..346
aaatggcggcggcggcggcggcggctgcagctacgaacgggaccggagaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtgaagagaagattatcattgacaaggaatattattacaccaaggaggagcagtgtgagagtggaatagatgtggggaagaggagtgggagttaaaaaaaaaatgtacagggtggggaagatggagagggttggaaagaaacaggagaggagaccaagaacaggggaaaaaa

SEQ ID NO: 2178 - DNA, 456 bp, Homo sapiens
  CDS 27..338
accttaggccttcattcgcagcaggcatgtgtgcctggggtttgttaccagcagccattttctcacccttaaatgagggatgggtctcsscttttctttttctcattttcctagaggttacaagattcctgtttttctcaccaggaggagaggtcagcctcagtgagctcatagcagtcatacattgccagtgtttttcctcaagtggaaggagaaaggccttcagaaaaaaaatcgtatgcaaacctagtgctaccaccagcagtagctctgaatcgagatttttgggagaattaggcttactaaagataaactacaataagtctcaaggaagcaaataattctgattctaatgaggaatccaagaataaaggcagctcttaaggtacggaagtgaactgtctgtgggtgacttgcctggatgccggctatagctgcagccccaaagtcgargct

SEQ ID NO: 2179 - DNA, 482 bp, Homo sapiens
  CDS 287..457
gagcccggtttcctaggagacggcccgcgggttgctctcggactgagagcgcgaggcttcgggactgagccctagctgctgcgctggccgaagttttctcgtcggtaaaataggataacagtgcaccatagggtcgttttgataaagaagaaaggtagggcacttaacacagttcctggtaaagagagttcaaatgaaagtgaaagaggccgggcgtggtggctctcacctgcagtcccaagcactctgggaggcctgtaagtgcctgtaatcccagctcctcgggatgctgaggcaggagaatcgcttgaacccgagaagtgaaggttgcagtgatccgagatcgcaccactgcactccatcctgggcgacagagcgagaccctgtctcgaaaaaaaagttaaggtttttttgggggaaagaggtgaaaacgtatttaaatgttctttcgagcctttaaaaatgtgtatagttgaaatact

SEQ ID NO: 2180 - DNA, 323 bp, Homo sapiens
  CDS 49..243
taacccaggtgaggagacttgagtctagaggcagccaagtggggacctatggaggagttcacgtgctgcaggtgtgcgccgccgaggbavcaggsctctggagctgccaggggctcagaagcctccctctcagatctctccccttttggccacagatgggaaggagagaggcactcacccgacccagcgtggcagtacagtagtgtccaacctgtcactgttgggcgtggtggcgtgtacctgtagtcccagctactgaggaggctgagatggcagcagcacttgagcccaggagttggaggctgcagtgagccgacagcgcc

SEQ ID NO: 2181 - DNA, 467 bp, Homo sapiens
  CDS 172..450
ctgttttgtgtgttgtgcgcacattttgggaaagtgtcttcccaggaccacttctaccaattttctaatctctcttcccttctagatgctgtttaagaagaacctatttgagatggcgattaacctcccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtcccactttgatgtggagacagcca

SEQ ID NO: 2182 - DNA, 474 bp, Homo sapiens
  CDS 135..428
cttctggaagcctgcactccagcttcgagtggamgttgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaaacggagaccctagcaaggcagagacagaagcggctggacatcgagaggagtacattggcactggcagaacgacacggagtttggccggggcagttggaagagagccggggctgccgagtggcccaactccaggggaaaaccatctccctgctggctcccccatctgctgaaastacccccactcaataaaacctcacactcattctccaaaaa

SEQ ID NO: 2183 - DNA, 469 bp, Homo sapiens
  CDS 206..385
attctgccaccgcatcttacctacttggcaggcaagctagagttggcctaaattctgcttttatcatttatgtgtttgttcttatgcttttaggaaaaaaaaatcctgaaataatggtgaaggacagcaagtatttgcctagagtgcatgctaagaagtctccatagatgtttttctttaagtatcctgaccgcttaacatattgatgaagacctcttatttccaggctaatgtcagattccacacccacatacctaaaagaggagccagcctgtcaaggtggcccagttacaaaagagagcttccaatcagcctttccattcaggagaccgttctactggagaatgatacctgcttacccaaaacagcctttccttttccttcatgaattactaatcaaggatgatcagaaataggaacaaaatccacagcctgaaagagaaagaccaagctaaacaccaagagtgaa

SEQ ID NO: 2184 - DNA, 379 bp, Homo sapiens
  CDS 85..243
tgccactatatttgaatgctgaccaatgctgtatggccgtctgctttattttgattgtagtaactgcaacttaagaaagtaaaaatgggccggcgcggtggctcgcgcttagtcssagcwctttgggaggccgaggcgggcggatcacctgaggtgaggagttcgagaccgggctggccaatatggcgaaaccccgtctctactagaaatacgatcattagccaggcgtggtggcgggcgctgtagtctcacctacttgggaggctgaggcagggagaatcgcttgaacccgggaggtggaggttgcagtgagccgagatcgcgccactgcactccagcctggtcggctggtcggcagagtgagacccactcccaaaaa

SEQ ID NO: 2185 - DNA, 413 bp, Homo sapiens
  CDS 55..390
  misc_feature 35,37,39: n=a, g, c or t
gagaaggcgcggggcggcctgtccggcccgcasgngntncgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtccaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaattacaaggacaagaggaggaagaagaagaagaagaggaagaagctgaagaagaagggcaaggagaag

SEQ ID NO: 2186 - DNA, 483 bp, Homo sapiens
  CDS 224..454
aaatccsaaaatatgtggaagattaaacaacttctaaataatacatagttcaaagaaggaatctcaaaaacacttaaaaatattttgaaataaatcaaaatgaaaatacagtttatcaaaatttgtgagatgtagtgaamcagagcttagaggggaatttattggattgaatgcatttattagaaaagatgaaagatcsaaaattggccgagcgcggtggctcatgcctgtagtcccagcactttgggaggccgaggggggtggatcacgaggtcaggagattgagaccatcctggctaacatggtgaaacctctctctactaaaaatacaaaaaattatccgggcgtggtggtgggtgcctgtagtcccagctacttgggggtgccgaggcaggagaattttgtgaacctaggaggcggacttgcagtgagccgagatcgcgccactgcactctagcctgggcgacagagtgagactccatc

SEQ ID NO: 2187 - DNA, 451 bp, Homo sapiens
  CDS 64..213
actttctcagaaaaccaaatatggcatcttccatgaggagcttgttttctgaccacgggaaatatgttgaatctttccggagtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggagsctgaggcggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgaga

SEQ ID NO: 2188 - DNA, 476 bp, Homo sapiens
  CDS 136..306
atgatccctagattctatgggcagctgccaccactaccagagtcttccttgcaatgcgagcttcttgcatcatgacttctagattccaagtatgcaaagcaaacgctcgtaccctgactccatctgggatttggaatgcactcagggaagtggctgtgcatggagactagaaatggaagaggcttccaaggtcatgcctttcaggctcccttcaaattctacagctactgtgaagagagttgcattcccacagagaacatgtcagactggaggaaaattgtgacaaaaggtctccccaaaggtctctgaaacttcgatcttatctcattccacaaggcaaaggccagtttcctaaatcaaagaatgaaacaaagtacatctttttcaagcattgttttgacatcactcccttttatacaactggacaggcactcccattctctttaaataatttttaaacactcctgaaaaaaaaa

SEQ ID NO: 2189 - DNA, 503 bp, Homo sapiens
  CDS 44..478
acgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgagggctggtcatgactgaagtccagatccagaaggt

SEQ ID NO: 2190 - DNA, 453 bp, Homo sapiens
  CDS 59..448
gtaggactgcggacgtatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctatcacaagggttctgaaaataaaactgatttagat

SEQ ID NO: 2191 - DNA, 569 bp, Homo sapiens
  CDS 150..314
agacttgaagccaaaagatcttcatggctacaaagcccatattctttctaggcatgctacactgcttcccatggcacttattaccacttgatttattatctgtatgttacctcagaacccttgtgacataagattagagtacaattaaaatgattttcaacttggaataccaagtatcatatgatctccactctggctttctccaggtagtctctgttggatggaatataaccagaaaaataaatgttgggttagaaaaattgtcacaaggggctggccaggctctgtggctcacgcctgtaatcctggcactttgagaggccgaggcatgtggctcacctgaggtcaagagttcgagaccagcctggccaacatggtgaatccctgtctctactaaaaatacaaaaattagctgggcatggtcgtgtgtgcctgtaattctaactactcaggagtctgagacagtagaattgcttgaacctgagaggcggasttgcagtkagccgagtagatcgcccaactgcactccagsctgggagcaagactctgtctcggaaagwaaaaraaaa

SEQ ID NO: 2192 - DNA, 482 bp, Homo sapiens
  CDS 213..467
agcatggtcatggcggatggcccgaggcacttgcagcgcgggccggtccgggtggggttctacgacatcgagggcacgctgggcaagggcaacttcgctgtggtgaagctggggcgcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgcatgcaagcagaagattcaaaatacatcattgaagaataagactatttatgcatcacaaggaatatactgcactaggttagaagcccagaragttcttctttttaaagatgtatgtcatacccataccagcagtttgagattgattgactgattgattttttat

SEQ ID NO: 2193 - DNA, 462 bp, Homo sapiens
  CDS 64..321
aaacttgcaccgaagcatcactcgagaccccaaacctccaggcctgaggccagccagcgcccaatggatgacaaaaagaagaaacggagtcccaagccctgcstggyccagssagcccaggccccaggcacactacggagggtccctgtgacctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgmaggcttcgctggaagacctcagtaattctatccagaagctgcacctggccgagaacgccgagcctgaggagcagtc

SEQ ID NO: 2194 - DNA, 487 bp, Homo sapiens
  CDS 88..315
actcagtctctgagcgttttaatacgatggtgtccccgcgggatcaaacttcagcgtcacagctgaggactggcttcgtggtccctgatgggagagcatgaacagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagaaatcaagattcagcagcttgaagaggtgctgagccccacaggccgccagggagagaaggaggagcacaagtggggcatggagcagggccggcaggagctgtatggggccctgacccaaggccttcagggctggagaagaccctgcgtgacagtgaggagatgcagcgggcccgcaccactcgctgcctgcaggctgctggc

SEQ ID NO: 2195 - DNA, 568 bp, Homo sapiens
  CDS 88..315
actcagtctctgagcgttttaatacgatggtgtccccgcgggatcaaacttcagcgtcacagctgaggactggcttcgtggtccctgatgggagagcatgaacagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagaaatcaagattcagcagcttgaagaggtgctgagccccacaggccgccagggagagaaggaggagcacaagtggggcatggagcagggccggcaggagctgtatggggccctgacccaaggccttcagggctggagaagaccctgcgtgacagtgaggagatgcagcgggcccgcaccactcgctgcctgcastgctggcccaggagatccgggacagcaagaagttcctgtgggaggagctggaactggtgcgggagaggtgaccttcatctatcagaagct

SEQ ID NO: 2196 - DNA, 306 bp, Homo sapiens
  CDS 21..209
  misc_feature 93,223: n=a, g, c or t
ttgcagaacaattctaactcatgcttacagaaggctgtgtcattccttcctctttttttttgagccaggttagtaacctcaacattagctggngccggacgcggtggctcacgcctgtaatcccaccactttgggaggccgaggcgggtggatcacgaggtcaggagatcgagaccatcctggctggcacagtgaaaccccgtctctactaaaaatacaaaanattagccgggcgaggtggcggtcgctgtagtcccagctacgcgggaggctgaggcaggagaatggcgtgaaccccgcgtccgg

SEQ ID NO: 2197 - DNA, 462 bp, Homo sapiens
  CDS 158..424
attttgtgcagcgccagatccttcggacacatccctaggtgtctccatcctcattcggtccatccaactcccagacctcacgtcaaccggctgcaccccactttvcagcctgcgccccagatctgcagccttcgcccctagatacacccgcctggtgatgaggcgctcctcgcgttccttccgggctccaggtgtccgtgagcctcccttccgccctggcctccggtctctgccttgctcgtgcttctaccaccacccttcccctcccaacccggtggatcctctcgtctcccccagtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttt

SEQ ID NO: 2198 - DNA, 439 bp, Homo sapiens
  CDS 132..422
tttccaattagtatcaccctctaatttgtacattgttcttagtatacacagttttggaaatttacaattccaaatattgagtgatagttgtgcctttctattttattaaactggaaatctttgtatcagaaatgtatttggggccatgtgctgtgactcactcctgtaawtcccagcactttgggaggttgaggcgggtggattgcttaaggccaggagttcaagagcagcctggccaacatggcaaaaccctgtctctaatgaaaataccaaaattagccaggtgtggcagcccacacctgtggtcccagctactcagaagactgaagcatgagaattgcttgaacccaggaggcagaggttgcagtgagctgggatcgcgcactacactccagcctgggaaacagagagagacctatctctaaaaaaaaaaaaaaaa

SEQ ID NO: 2199 - DNA, 489 bp, Homo sapiens
  CDS 4..192
aacatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagagtcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttcsggttcaggaat

SEQ ID NO: 2200 - DNA, 544 bp, Homo sapiens
  CDS 88..480
agagggagccgtggcttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatataaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgagggacttaatacatgtatataatgtatttcttttgtacagtga

SEQ ID NO: 2201 - DNA, 485 bp, Homo sapiens
  CDS 110..268
ttctcctttctactccctctgggacccattagctgaaggaacagggtcattttctcttttggatctctcctgggggtaatagctgtgggcacagtggctgttatttgatatgcttatcatagagtcgagaaagtgggaaggaggtaccttggtaaagagtgtctgtccctcctctctcttgcatttttctcctaattcctttatcctcatcagtgaaagagatgaaggcattactgcatttggtatgtttggttgtaaaaatgtatgttagtgaataagtcattagtatacattttctgacatctgtcattttttttcctgctgcacaaatctcttcattttcttaaagcttcaaagataatcttgaaatgggaatgaatgatggaatgaattttgcagtattacagtactgtgtactgttactttcggattactgaatatctggcctactcaaggtcaatactttgataaatacacaacattag

SEQ ID NO: 2202 - DNA, 492 bp, Homo sapiens
  CDS 308..463
tttgcgaaaagcaggctcatcgaatacaggtgagtttcaacgcgtcttgaatatggcagcatttaaaagtcttcagaccaggcatggtggctcatgcctgtcatcccagcactttgggaggccaaggtgggaggattgcttgaggccaggagttcgagaccagcctgttcagcatagcaggacccccatctctacaaaaactaaacagattagctaggtgtggtggtgtgtgcctgtagtcctagctgcttgggaggctgaggcaggcggatagcctgagcacaggagttggaggctgcagtaagccatgattacaccactgcacttgagcctgggcagcagagtgagacctgtctttaaaaaaaaaaaggagctgggcacggtggctcatgcctgtaatcccagcactttgggaggccgaggcaggcagatcacgaggtcaggagwtcgagaccatcctggctaacagtgaaaccctgtctctactgaaaa

SEQ ID NO: 2203 - DNA, 474 bp, Homo sapiens
  CDS 93..272
  misc_feature 48: n=a, g, c or t
taaatcatgctgctataaagacacatgcacacgtatgtttattgcggnmttgttcaatagcaaagacttggaaccaacccaaatgtccaacaatgatagtctggattaagaaaatgtggcacatatacaccatggaatactatgcagccataaataatgatgagttcatgtcctttgtagggacatggatgagattggagaccatcattctcagtaaactatcgcaggaacgagaagccaaacaccgcatattctcactcataggtgggagttgaacaatgagatcacatggacacaggaaggggaatatcacactctggggactgttgtggggtcgggggaggggggagggatagcgttgggagatgtacctgatggtggatgacgcgttggtgggtgcagcgcacagcgtggcacatgtgtacatgtgtgactagcctgcacaatgtsacatgtaccctgaaacttaagtat

SEQ ID NO: 2204 - DNA, 361 bp, Homo sapiens
  CDS 129..356
agagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaagggtaggt

SEQ ID NO: 2205 - DNA, 513 bp, Homo sapiens
  CDS 181..345
catttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactga

SEQ ID NO: 2206 - DNA, 481 bp, Homo sapiens
  CDS 208..366
acagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaaatgccgtgtactgattcagcatcatgggggctgcacagctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacgaggctcacgcctgtaatcccagcactttgggaggccgaggtgggcggasacaaggtcaggagat

SEQ ID NO: 2207 - DNA, 488 bp, Homo sapiens
  CDS 257..463
cagaattattgttctgttaaccaagatggcattttcagagaactaggagagcttcaaaatgagtgcttgtagaagaaagtgtagcccatcaaactcaagacagttgtggctaatgttagtgataaaaggagctttctccataaggctctaggtggggtttggcagttcgatatttgcttgccagtgacaatacagtctcaaagttcataggagtgttggtcctggaagctttctcagctggcatgaggtgtgtggaatgaccccccacccctgcggcctctgctgcaagtgctgctcattttaccacttgagttactggcagccaccatctcagtcttccgggattcctggcctcctctctagtgcctaccactttacatccacgccggactttccagcctctcaacaccccatcttttcccagtgtcgacttctcttgtgccatttgcttggagttccctgttagattttagcatcccttaaaccta

SEQ ID NO: 2208 - DNA, 463 bp, Homo sapiens
  CDS 113..364
agagccggagtaacgggactcccagctgcgcgtcgcagtcccgacgcgagawgggctggagtcggcgtccagctagagcccccggtgggagccaggccgggacgcgtgcaccatgccctacctgctcatcagcacccagatccgcatggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcaccctgtggaggggctgctgtgggccctgacctccaagctcctgcctcaccgtctgccttgctcctct

SEQ ID NO: 2209 - DNA, 892 bp, Homo sapiens
  CDS 36..569
ctttggcgaacggtcttcggaagcggcggcccgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcgtcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtg

SEQ ID NO: 2210 - DNA, 499 bp, Homo sapiens
  CDS 39..188
atactggtaactgacattctgtatctcagtcttggttcatgtctacccgtcttaccaataggtgttcccactccgtaacctttggagtcaatgaggcccccgatctgagtgaggttgcagtttctctgcgtcacatactcaatgctggtggactccatcagcagcgcgtagtctgtggtggagatttttgatttctggagggaaagaaaacacactcaccagcagaagagggctggaaaaatacgacctaaagccaacatcccacgcaccatcgtggagactggctggatgccctgtgctctatcagggcatgtcagaccaacagaggggcaaatcagagtgaagaggaagccagaagatgggagagacatttttgaagtgagtaacctgcatgtataatgtgtactctcaaaactgcaaacaaattattttcctcagatatttcacactggtggtcaccttctaatacattcagcctaaatgaaacaaaaaaaaaaaa

SEQ ID NO: 2211 - DNA, 455 bp, Homo sapiens
  CDS 32..337
cacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgatccccagtacttcctggacacgccccagcaggcggcagcatcttacagaaggtaggaagacccaacctccaattacaaatggacatattccactggcagatcatggatgggaacctgacaggaaacatccgggagttcctgcccattgttgggcatgtgcaggtggcaca

SEQ ID NO: 2212 - DNA, 474 bp, Homo sapiens
  CDS 122..286
  misc_feature 448: n=a, g, c or t
agaggcccccgagtgtcagggacaaaagccctccgcctgctcccgcagccggggctcatctgccgccgccgccgcgctgaggagagttcgccgccgtcgccgcccgtgagatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagatttcccttaacttacccagttactacagtccctccattggcttctcctattctttgggtgaagctgcttggtctacggggggtgacacagccatgccctacttaasttcttatggacagctgagcaacggagagccccacttcctaccagatgcatgtttgggcaccangagccctaggtagcactccatttctt

SEQ ID NO: 2213 - DNA, 499 bp, Homo sapiens
  CDS 6..386
ttcacatgaaaaaccaagctgaagaaaaagctgcagaacagtttcgaatgcgacttaaaaataagcaagatgaaatgaagctagaaggagatctcagaagaagccagcgagcctgtcaacaactggatgtccagaaaaatattcaggttcccagggaagcatggtactggttgaggcttgaagaggagactgaagaagatgaagaagaaaaagaacaggatgaagatgaatataagagtgaagatttaagcgtactggaaaaattacaaatattgactagttatttaagagaagaacatctatattgtatttggtgtggaacagcctatgaagataaagaagacctatcttcaaattgtccaggaccaacttctgcagatcatgactaagattattcccaataaagtggaaacttgaaaaatgttattacttcctagggatagacaatttagcagttggaatctcaaattttttatgccagtaaagaaagggggacttt

SEQ ID NO: 2214 - DNA, 457 bp, Homo sapiens
  CDS 137..439
aagaaagggatgagctcgcaagtmatgggaagactcacaggaagctgaaatgcatattgctagatagaagaaccaatccgaaaaggctactttctctatgattccaactacgtgactttctggaaaaggcaaaactatggagatggtaaaaagagaaaaggatttctgctttcaaatcctctgtttcctgaggctgggtgctgagttcagctgcccctggaggagcagcagctctgggccgctggcagggccgcatcctcttcagtctggacaaattccctgcagccaggggaagtggcccatgcctgctgtcctggtatgcaacatcggacctgcatgctggaatttgacccttttcctgcctgacacccagcaaaataaaccccagggaagggatcaatgcctgcaaccggaatccagaagaaagaggagtgacagataagccctgggtcagagg

SEQ ID NO: 2215 - DNA, 479 bp, Homo sapiens
  CDS 85..252
  misc_feature 304: n=a, g, c or t
actgacagtctcctcgctgctccctacatcttcctctccgccggagctgtccagaagggggattttggacccaaaggaatcgggatgaaaggggatcagagtgagaggcgctggcaatggactaggaagctcggctgccgctgctactgctcccccctgggctccggcgagagctttccctgtcaagcaagaggggtgaggatcatatttttattttggaaactaaaaagtgctcccagggtcggtgattattaaggggaaatccctgaatatactctccagccaagaaggcagggctgccggnggctgtacaagaagaggcagcagcctcctacagcaccactacaggcactgcgaggacataacaccagagagctgctcctctgccctccgaaacgacaactttcctaccatcttggakgcagagcaaaggggggccagggggaaaagtgcacccgctcccgataaagtacaaattt

SEQ ID NO: 2216 - DNA, 481 bp, Homo sapiens
  CDS 112..363
caaaataattaaatttccttttacagtttttgaataaaatgagccacatacttaattacagatgaatttcgtgaccaaagaccaaacacctaccattacccagggagagaaatgtccttgggaaatacgtaccaagagaacttatttggagtatataaatggtttaacttcaaagttttctgctttttaaaaatcagtggtgcttggctgggtgcggtggctcacgcctgtaatcccagcactttgggaggccgaggtgggcggatcatgaggtcaagagatcaagaccatcctggccaacatggtgaaaccccctctctactgaaaatgcaaaaattatctgggcatggtggcaggcgcctatagtcccagctacttgggaggctgaggcaggagaattgcttgaacctgggaggcagaagttgcaatgagccaagatcgtgccattgcactccagcctggtgaaagagcaagactccgt

SEQ ID NO: 2217 - DNA, 493 bp, Homo sapiens
  CDS 58..306
ttcagggatccgaatttatcttcacattgaaccagcttttgctttcttttttttgagatggagtcttgctctgccgcccaggctggagtgcagtggcatgatctcggctcactgcaacctctgtctccaggtgaaccatctttttctattgtgatgaacacattaaaaccgcatatggaagaagttctcaagtgggggtacttttctcccaaggagcatttgtcaaggtcccgaaacagttttggctgtcgtgactggagggaagtggtgctcctacatctaatgcgaggaggacagaggtgctgctaaacatcattcccacacaggacagcctcccgcaacaaagaattgcctggtccaaaatgggtgggaaagcctgacttagaggcttagggagttttcccctcctgctaaatgacttgaagcgattgccacatgggttacacataaaatgtgtccatggcatacagttctgactgtaaaatgagcgtca

SEQ ID NO: 2218 - DNA, 510 bp, Homo sapiens
  CDS 67..381
aaaaaagcaaaggmgtctaaaaagcatgaaaagcttgagaaaccagagaaggagaagaaaaaaaagatgaagaatgagaacgcagacaagttacttaagagtgaaaagcaaatgaagaactctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcagatggctaccaggraaatctctgtgatcaccatcttcggccctgtcaacaacagcaccatgraaatcgaccactttcagctagataatgagaagcccatgcgagtggtggatgatgaagacttggtagaccagcgtctcatcagcgagctga

SEQ ID NO: 2219 - DNA, 471 bp, Homo sapiens
  CDS 98..442
ctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttgttatgcaaaagcagcttcttaacagatggcattttctgtgactctagg

SEQ ID NO: 2220 - DNA, 473 bp, Homo sapiens
  CDS 217..393
agttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagcaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaacaaaatggaaaggtggaacattacaaattcaactag

SEQ ID NO: 2221 - DNA, 286 bp, Homo sapiens
  CDS 55..237
atttttacaaaaggccgattctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaakagccacccargccacagttcctgtgcctg

SEQ ID NO: 2222 - DNA, 294 bp, Homo sapiens
  CDS 57..212
actactttgttgatttgttggtattggggacattttaaaggctgagttatttttgaatgtcatgtttatgtcatagacgtagttttcgcatccttgaattaaactgccttaactccttttgtggtataagcaaaactacatggactctgtccttgtatccttttcctgtgtggttgccccgtgtcctctggcctagggttaagtgtgcaagataactactcgtgagtattcagaatgttgttcctaataaatgcacttgttgtctgtcttctttaatcaaaaaaaaaaaaaaaa

SEQ ID NO: 2223 - DNA, 459 bp, Homo sapiens
  CDS 29..181
aaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagttactgatgtaaaacggttttcttgtggggaggttacagaggctgacttcagagtggacttgtgtttttwctttttaaagaggcaaggttgggctggtgctcacagctgtaatcccagcactttgaggttggctgggagttcaagaccagcctggccaacatgtcagaactactaaaaataaagaaatcagccaaaaaaaaaaaaaaaa

SEQ ID NO: 2224 - DNA, 383 bp, Homo sapiens
  CDS 5..214
agtcatgatcaccgaaaccgcggcggagctacggtccctgcagtgcctgctgctgargaggccaccgaagctcggggacgcgaggagccggcgtggccctggaaagacgccccgatccggacgctggtgcagcgcatccaccagctgcaggctgagcgcgcgcagggcttccgccgactggaggaaggccaccgccagtacctgcrcasggccctgactacgacttcrcrcgctamcggagcacagtgcacggrgtgacccargccttcrccgccgcctcgcggadgtgctggcggtggaagcagarctggrcgggcctcgcaggcagccgctgctcgcmggccacgtdcrcasctgcaggaactggagcagacrcagctggr

SEQ ID NO: 2225 - DNA, 422 bp, Homo sapiens
  CDS 44..283
tttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctrcctgarcgcgggagcctgaggaccggrtggaggcggtggggacccagccgcgcgccgggagcgmtccccggaatgarvcgcmccacccacsccaaggctggar

SEQ ID NO: 2226 - DNA, 526 bp, Homo sapiens
  CDS 189..386
ccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtccagaggggcagaatctccaatagaggactgagcactgaaaaaaaaaaaaaaaa

SEQ ID NO: 2227 - DNA, 464 bp, Homo sapiens
  CDS 56..298
caataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaa

SEQ ID NO: 2228 - DNA, 489 bp, Homo sapiens
  CDS 201..353
aaataaggatgccttgaaatcttctgtgtttgcatatgtatgggaagaagaaaaagacatgtcaaaggctttgttctgagaaatatgggacctgagccaggtgggtgtgaataggaagagagacagtcgaaatccccaaagattggatggagacttaaaggcataaagccccctgccatgtgcagacaaatgtggctgttatggtgtctcctatcggattttggcgaagacccagccctgtcaatttgggtctcttgagcaggcggggagacctaccatcattctggtggcttgggaatacaaaaatacatttaaaagtattgactgtgtcctgtgtcaagtggactaaattttagagaaatctggccattagaaacacctttgtctagaatttaggacttggggattagattttatggagtaggatgttagaaatcgttcactacagtccaaatagattttaatgacttggtgtcaggccttactcta

SEQ ID NO: 2229 - DNA, 296 bp, Homo sapiens
  CDS 48..230
ccttttccaagttagccttatagtctagggcttaaaatactggtttaatggtgaagataaaagactgtcgtagtaaaagagattcagggcacagggaaactccaccacaaagcgtggtaccatttcccacakaagctaaatggacgggaagcctgccaccaggaaaggtccagatttctgttcattacgctatgggctggctcttatcatgcacttctcaaacttcaccatgataacgcagcgtgtgagtctgagcattgsgatcatcgscatggtgaacaccactcagcagcaag

SEQ ID NO: 2230 - DNA, 440 bp, Homo sapiens
  CDS 32..253
cctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcttttgctctctagccaataaaccgtccttgtgtgcgagtcacctgggctcctgtcagggcctssccctgagggtggtaaagggaaaggtagactcaccctctgccccactcttycacagagtgagcassggccctgtggctgccccggcccccagctytctagttgggaagaagtgcagccctycctgtcttctgcg

SEQ ID NO: 2231 - DNA, 457 bp, Homo sapiens
  CDS 3..239
cgatggtgaacgttctaatttcagaaccaattgcgagtcatgtagtgttagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtatwatgtatgcactactgttttaaaagaattagtgtgagtgtgtttttgtatgaatgagc

SEQ ID NO: 2232 - DNA, 423 bp, Homo sapiens
  CDS 24..242
cacgcgtaatatgagaatggctgatggctgagagcccaccaaccttccccaccccgtatcagtttsaccacgggcsttttgctamattctatccagagagsaggsstgccagccsctctscactgagaagttgggctgagagtatggggaaaagaatcaagagasctgactgccgccaamtcactagtgacttagatacatcccctccccctgctggggcctcagtttccccatctgtaacttgagaaaatagaactagatctgtaaagtctggaactagatctgtaacgtccttataggtgtcactagggggttccatgagaggtgtgtgacaggcagtctgattcctctsattctccatagtctgtttcctggwaagtcgatgtaattaactgatggccaagaactacstcaagagacctg

SEQ ID NO: 2233 - DNA, 475 bp, Homo sapiens
  CDS 90..431
gtattatgatgtcgtataatgtaacattctgaaaatacaacatgtccacctaaatttcaaagggctgaaaaaaatttcttgaaagatgaatggacattgtggcccattgtgagaaagccatggcagagtcagttaagaaacatcagtttagcacttctgaatcttatcttccagcaactttaatactgaacagcatatcctttaatactgatggctccatacagtataaagaaaagctgtatttctctgcctccgaagccctagacgcttacattgatgattttcacttaaactatgagcctcctgatattgatacaaaggttaacctggatcagagtcctcttgaatttcttgctaagtcaaatagtggggtccatggaatcgcaccaggccaaagtggcatggagaagatcatacagtggtatgctgcataacaaggtttctgtcagcaacaaattgcttatatgatggtggc

SEQ ID NO: 2234 - DNA, 459 bp, Homo sapiens
  CDS 27..212
agcctcagaggagtagggcggagattatgcgaggcgcgccagtggggctctcaggacagcaggcggtgtgcggggaggctgagcctgttgcccctggagagcagaagatccatgttctggagatcgatgcggcctcctgccgactcctgacccctcactctttagtccttggacattgctttcagaaccctgggctctggacgccacttgagtagagttctgtgaacacatttttttttgcttcttcgtatatgtctcagtcagattatttgctccctgctttgcaacattaatgggaaaatcccaaatattagcaaatataatccagagcagcatattcaaagtgtaatgtgccataagcagttaatgaaaggtgggttaaattctaagaaatctcttaatttgctatattaagacaccaaaaggaggacaatcagttgattatcacaagagaagttg

SEQ ID NO: 2235 - DNA, 481 bp, Homo sapiens
  CDS 20..181
tgataatacagcatctctaatgggacagctccagaacattgccaagaaggagaactgtgtctgcagtgttattgtgtcttttcctgctcacagatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactgaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaact

SEQ ID NO: 2236 - DNA, 452 bp, Homo sapiens
  CDS 107..409
  misc_feature 393: n=a, g, c or t
aggatttggagagcggaggaatgaaggagagcagagaggagaggcttggaggcccccaaaggctctgcgcagaccagcactgtctcctccttcatccacagagaggatgaaagaacatggcaagaggaagactcacagaaccccacagagaagctttgagaattgggctgtctggctctcccatcacccatttggccaccagctttggtcccagctgctgtgccctcgggggatgcattattgccctgaaagggcccttgtccctttttggggtgtcatcctggctgggtggtatggatttactgctgtaaacatggcccatctgggagaagcccaggtgccacgttttgaacagctctggaaacttaaagctcagaaggctttgaaatgcdnatattttgaaggaacataaggttccttgaatttctacgtgaattttaggatcagcttgt

SEQ ID NO: 2237 - DNA, 415 bp, Homo sapiens
  CDS 60..209
  misc_feature 182: n=a, g, c or t
ctataaggtttattggaaaatacaaagaatactaaaaatatgcttcagagcagctaggaatgaagaaagagagcatggaaaagagggagagaaagaggagaaagcaaggaagagaagaaaaggagaggataatagagagtcagggagaggaagcagagaggagacagaaggagagacttagnatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactct

SEQ ID NO: 2238 - DNA, 456 bp, Homo sapiens
  CDS 187..357
  misc_feature 141..142: n=a, g, c or t
cttcttactgagccccgccccactctacagggagaggggcacccagtgctgtgctcccgtccttcctctcctagcctaaggcgtgcaaacagagcgccactgggaggctgaaacctttaggccgatgcttgcttgcaaggnnsggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaagaaaaaaaaaaaaaaaaaa

SEQ ID NO: 2239 - DNA, 508 bp, Homo sapiens
  CDS 130..306
agagctcggcggggtgcggctagtggcggacggcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggtttcaccaggtactgccttctaacttgagctggccatttccacatgtcagataggaccaacttgccttttaactacccgtgtgatacttaaacactgttgccggtatcacagcttttcttcaaaacaggtaatattagggacacttg

SEQ ID NO: 2240 - DNA, 471 bp, Homo sapiens
  CDS 69..323
tttttttaaaagatcgcccagggcccttgtcctgagagctgggagctggtcggagtgacagagaagccatggaagcagcagtgaaagaggaaataagtgttgaagatgaagctgtagataaaaacattttcagagactgtaacaagatcgcattttacaggcgtcagaaacagtggctttcsaagawgtccacctatcgggcattattggattcagtcacaacagatgaagacagcaccaggttccaaatcatcaatgaagcaagtaaggtgagatggaagtattttctacagagaataatttgtttctgtatttattgggcctgaatgaagtaaattaaagctatgtatgcttcaaaaataaacctcgttagaaaaggaatatcagccttttagtgattagtggctcacgcctgtaatcccagcactctgggaggcagaagtgggcagattgctcgagcccaggagttcg

SEQ ID NO: 2241 - DNA, 467 bp, Homo sapiens
  CDS 104..421
aggaagcaggcgtgcgctccccggccacaggctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttggtcattagaacatgaggaaaccaatatgcctactatgcacgaccttgttcatactatt

SEQ ID NO: 2242 - DNA, 473 bp, Homo sapiens
  CDS 63..440
  misc_feature 406: n=a, g, c or t
attctcaccctgcctttgttactgggaaaccgaacgcggcgctgtggctttcagcttggatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagcttctctacagcaacttgcagcatctgaagtggaacgntgactctctctttctgtgtctctccctaccctgctaggagccagctggaagaatagagattctgcag

SEQ ID NO: 2243 - DNA, 333 bp, Homo sapiens
  CDS 66..227
tatcgtcgggcacggtgactcacgcctgtggtcccggcatcttgggaggctgaggcgggtggatcatgaggtcggatcgggaccatcctggccagcatggtgaaaccctgtctctgataaaggtgcaagggttatccgggtgtggtggtgtgtgcctgtggtcccggctgctcggggggctgaggcgggagagtcgcttgggcccggaaatcggaggttgcagtgagtgagctgggatcgcgccactgcactccagcctggcgacggagtgagactctgtctcaatraaaaaaacaaaaaacaaaaacaacaacaacaaaaaaaaaaaaaaaa

SEQ ID NO: 2244 - DNA, 511 bp, Homo sapiens
  CDS 120..290
acctttcctgggaagatcatcaaggatatgctccataagaacaaggtggtaatccaaaaaaggggaaacatgggatcaagaaaaaaagaacacaagacagcagtaaagggaattcccaaatgagatccgtctcagagcagtgccaaatcaaagaaacattcacaatcaaaatgctacctgctccccagtgccactccactgaatccttgcagaggcagcacagtcccgagtatggtactaatatcgagatggataaggctcatcacagctcaagattaactataaattcctaatgtgttcaggtaagatgcatctctacctcccggcagacaaagaggcaaacacaatgatccatgaaagawagaaacagagatgctgcccaagtgaaatgagccttgatatgtcaccttcstcaccttgtgtttttgtagccatacctccagacttccagatctctgcctgaggtttactgatggtttctttcagggatcattaaaagtgattcgtgggc

SEQ ID NO: 2245 - DNA, 472 bp, Homo sapiens
  CDS 28..234
atcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaacaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagagsacctggaaccctggacttcactgggagg

SEQ ID NO: 2246 - DNA, 463 bp, Homo sapiens
  CDS 123..383
attctgctaattcagaacgaaacacccaactatttacccaaagaaaaatccatcatgcagatgggaaagtctatgggaggagaacaagaacagaaattcagtttggacatgtgaagtttctgatggacattggcatacaaacagagatgtcaagaaaggcagctagatggagtatcacatctgttgcccaggttggagtgcagtggtgtgatctgggctcactgcaagctctgcctcccaggttcacgccattctcctgcctcagcctcccaagtagctggaactgcaggcacccaccaccaagcccggctaatttttttgtgttttcagtagagacagggtttcaccgtgttaaccaagatggtcttggtctcctgacctcgtgatcggscctcctcagcctcccaaagtgctgggattacaggcatgagccaccacgcctggscgactcaacattcttatc

SEQ ID NO: 2247 - DNA, 494 bp, Homo sapiens
  CDS 125..337
tattttttatttttttgagatggagtttcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatactttctgtgtatataggcagcatattttttttgtagaacattaacccagattgctaatagcttcatgttacggcattcttccacacagtccagattgatttaaggaaaagsagaaatggaagtcaaagtgtgttataaattgagactgaaaaacatgctttaaaaaatagatttaatttcttacactgtg

SEQ ID NO: 2248 - DNA, 467 bp, Homo sapiens
  CDS 129..446
ctttccatcttgtttgagcctgctgtcctgccagctcacccctgggctcatttcgcagtcttctggactgtaatstctctttmsmsccggcgttctrctgccagatctgcctgaaatgctgcttttgcatgaaaataccagcctgcgttgctgctgacatkrcctctaaggaacctwccctgcacgcctgtgsaagctcctccagcgtcctctccctcctgcctgctaaaagcagctggatctatttctcagatggagtctcgctctgtcgcccaggctggagtgcggtasatgatcttggctcactgcaacctctgcctcccaggttcaagcgattctcctgsctcagcctcctgagtagctgggattacagccatctcaacaagaagatgtctttctgcaaccaggaaaagagccctcaccagccatcagatctgctggcaccttgaacttggacttcccagcct

SEQ ID NO: 2249 - DNA, 419 bp, Homo sapiens
  CDS 90..242
ttgtggctcctggactctactttgggtcccagatgtagagagagcagcctgattacccagggctgccagggacagctggggcccgagagatggtggsccctcctctgtgtcttgactgtgggcaagttacttcacctctctgggcctcagtttcctcactagaaaataggggtaatartacaggcgtggtggctcacacctgtaatcccagcactttgggaggccaaggcaggtggatcacctgaggtcaggattcaagaccagcctgacgaacatggagaaaccccgtccctactaaaaatacaaaattagccgggcttagtggcgtgtgcctgtaatcccagctactcaggaggctggggcaggagaatcgcttgaacccgggaggcagaggttgtggtgaaccgagatcgtgccat

SEQ ID NO: 2250 - DNA, 474 bp, Homo sapiens
  CDS 290..469
gcaaatcatttgggtcccgtcagtattgtggaagctttgttcttttactttttgcagtaaatgttggtgctggtcactctttgggtctgtgctgcctttatgagctgtaacactcaccacaaaggtctgcagcttcactcctgaagtcagcgagasatgaagccaccgggaggaaagaacaactctggacgcgccaactttatgaactgtaacactcaacgcaaaggtctgcagcttcactcctgacgtctgtaagmcatgaacccaccagaaggaagcaagtctggagatgtccgaacatcagaaggaacaaactccagataaaccgtctctaagaactgtaacactcactgccagggtccgcggcttcattcttgaaagtgagcaagaccaagagctcaccaattctggacacagcaccattattcacaacagccaaaaagtggaaacaattcaaatgtccatcaactgatg

SEQ ID NO: 2251 - DNA, 499 bp, Homo sapiens
  CDS 182..496
aatcaaaagttgagcagaagctgtgagttgctggcgctggagcgattcggtggcacgtggagccacggcgtggagtagggggctgaaggcaggcagcagcggccagggccgcctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagagggggccgaagaaggccgtgaacgacgtgaatggcctgaagcaatgtttggcagaattcaagcggatctggaatgggttgaaaggctcgatgtgacactgggtccggtaccggagatcggtggatctgaggcgccasacctcagaacaaggaccagaaagctgttgatccagaagacgacttccagcgagagatga

SEQ ID NO: 2252 - DNA, 529 bp, Homo sapiens
  CDS 101..406
tgtgaaataagcaggtgtctatcagtaatgatatttaaaatatgtcacagctggattccctgttttgtaggagcatctgaaatcagccatagcggaacagatggaaatgccccatttgttggggtcaagaaggaaaagttcttacatagttttacacatttggctggtgattgattttgtgaaaagatatgttaaaatttgtttgttttttgagacggaggctcactgtgttgccctggctkgagtgcagtggcgtgatatcggctcactgcaacctctgcctctcggactcaagcaatcctcctgtctcagcctactgagtagctgggattacaggctcctgccaccacacccagctaatttttgtatttttagtagagacggggtttcaccatgttggccaggctgatctcaaactcctgacgtcaaatgatgcacctgcttcagcttctgaaagtgctgggattacaggcttgagccacagcgcccgggtctgaaaagatacgtttaaaaaattttattttaaaaa

SEQ ID NO: 2253 - DNA, 488 bp, Homo sapiens
  CDS 296..478
atatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactg

SEQ ID NO: 2254 - DNA, 468 bp, Homo sapiens
  CDS 126..383
aaaatgggaatgaaaaacctacttcatagggtctctccaggggtcagtgaggttagacggtagagagatccacgccacaattcctgagaccggcttaatgcatcggatccaagccctgtttgaaaatgccatgcgcagacagtggcagccagtgccccttgctgtggaggatgtatttgaactttctggtttccttaggaaataaagaaagaagcaaaggtgtattctacaaagcacttcagagttgcccttgggcaaaggtgttgtacctggacgccgtggagtatttccccgatgagatgcaggagatcctggacctgatgactgagaaggagctccgggtgcgcctgccgctggaggagctggagctgctgctggatgattagagagcagtgggaaaacgggctgtgctgcgaggccaatttgcccaccctgcggastaggaggcgcgasagagaacgtgtgtgt

SEQ ID NO: 2255 - DNA, 535 bp, Homo sapiens
  CDS 113..385
tgctattttcatttgtagagcttggttaggtttttatcagctcttgtgcccactgtacaaccagattcccctcatctaatttaaatgtcttccctttttcaaactctcctttatgttttcctttttttttcctcccatttttctacccttcacaaattccttcttttgcttctgtccaggtaacccattctgcttgcagtatcattttagcacgtacaaacacaaaataatgggaaaaataaaagcaccttgttccatgcaattcgtatgggaaagttttgggtgtcaaaggtcgctggggatagatggggaggcagaaatagcttgggaaaaggaagcaggaaaaaaggaaatctttatgggaaatcaattacccaaagcaaggtgagtcacctagaggtgaatatgatgttgttattgtcctcccttagtgtacagcacagtttttgctctcacagggtttttctctttaggatgcgtvrccctatgcattaaatacatagcatcctaaagacaccctactcaccatgagtct

SEQ ID NO: 2256 - DNA, 553 bp, Homo sapiens
  CDS 58..270
acgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttc

SEQ ID NO: 2257 - DNA, 469 bp, Homo sapiens
  CDS 6..155
tattaatgtcccataaagtagtgattttagaacattctttgggaaatgctattgtagacataagactttacctttttaatttttttagaaacagagtcttgtgctgtcgccgaggctggagtttagtgataacattcatagctcgttgcagcctctaactgctgggcagaagcgattctccaacctcagcttcctgagtagcttgggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttattctttttaaaaagtctttaagttcaaga

SEQ ID NO: 2258 - DNA, 508 bp, Homo sapiens
  CDS 58..270
acgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaasattygtagtc

SEQ ID NO: 2259 - DNA, 485 bp, Homo sapiens
  CDS 58..450
aaaaacaaggcccacactggacagggcagctgctgggttgctactctcgcctccgccatgattccgcccgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctagcaccaggatggacgtggtgcacctccaggagcagttagacttaaagctgcagcagcggcaggccagggaaacaggcatctgcctgtccgcaggaactctactcacagtgttttgatgagttgatccgggagtcaccatcaactgtgc

SEQ ID NO: 2260 - DNA, 472 bp, Homo sapiens
  CDS 131..298
actattaaaggcactaacacaggaaatctctggtgtacactgatacaaatcaaatagttcagtttcattgggttaatgtatgaaacagagttgttacaaggaaatttgaaatgtttgatttggatcttggatgccaggtcaaagagttcagttgacatttacaattttggggattgagagtcagaacaacactttcaggccaggcgtggtggctcacgctgtaatcccagcactttcgaaggccaaggcgagtggatcatctgaggtcaggagatcgagaccagcctggccaacatggtgaaacccgactctactaaaaatacaaaaatcagccaggcgtagtggtgtgtgcctgtaattccagctgctggggggctgaggcaggaggatcgcttgagcctggaagscgaggttgcagtgagccaagactgtgccactgcactccagcctgggcagcagagcgatgactcca

SEQ ID NO: 2261 - DNA, 460 bp, Homo sapiens
  CDS 207..380
cttgcataaaattatcgtcttgagagctggctctagaaaaaatgcaaaatcagtggggagaaaaacttcttcccactttataatgatacttcaacacccttgacmaaattcttatctccttcatctgaactctgtcatgccaccgtgtttgcctgtcatcactaaaggaaagcaaaccataaaattaaatcacaaataacgctagaatgatttgccttttaaagattccccaaatagtccaggtacagtgctcactcctgtcatcccagcactttgggaggtcgaggcggatggatcacgaagtcaggcattcgagaccagcctggccaacatggcgaaaccctgtctctactaagaatacaaaaattagccaggcgtgttgacaggcgcttgtaatcccagctactcgggaggctgaggcaggcgaatcgcttgaacccgggaggcggaggttgcagta

SEQ ID NO: 2262 - DNA, 599 bp, Homo sapiens
  CDS 216..368
atacacgatcttgccccccccacctccacacactcaatatgacctccccacgcccaaagctgcacacatcttgacctcacttctctcacacacacaccaatctgacccgcacgcggtttctttcactcaactacccagacacccctcatcccaccagcacaagcaggcccaccgcggtctcacacacactcgagccttcctttgcccagtctcacatgcatgactgggatcgcggatttgtccccttccgactccccatgctggttcggtcccagacgctcaggtgccacattggggtgcgctctcccggctcctccacacgctacgcagctgcccgcggggtgaaagaaagcttgccccagaggacttaaacagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagca

SEQ ID NO: 2263 - DNA, 489 bp, Homo sapiens
  CDS 195..356
  misc_feature 458: n=a, g, c or t
ttatttgctgggttgtttaacgactgttctaaggctttacaaaggacaagaccaggaggaaaaaaacaaacaaacaaaaacaaaaaaacgcgacctggacaaggcacgtagtttagtgagccccttggggccccagggatgtaagtattctggctgcggaatcccagcgcatagaggcggggacagggactggcatggttactgagcagcactgcccagtagaaatagaaagcaaggagctgggggaggtggctcacgcctgtaatcccagcattttgggaggtcgaggcgggtggatcacctcaggccaggagttcgagaccagcctggccaacatagcgaaactccgtctctactaaaaatacaaaaattagccgggcgtggtggcgggcgcctgtaatcccagctacccggaaggctgaggcaggagaatcgctggaacccgggaggcggggttncagtgagcagagattgcaccactgcactcca

SEQ ID NO: 2264 - DNA, 460 bp, Homo sapiens
  CDS 11..169
tattaatcctatgtgtaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctc

SEQ ID NO: 2265 - DNA, 460 bp, Homo sapiens
  CDS 133..423
acgggacacctgcatctgccaacaagactggaagcagaaagggacagagacggcgaagtttgacggtctggaaagcagagaccagcagggctgactgcttgggagcacgagggacagctctccaccgaccgaatgaggagaatgctatttatttcagcaccaaatatccggacagmgcctctcgggaggtccgagaagagaaccgcgatctgtttcagcaccggggctcaggacagttcccagcggrctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaa

SEQ ID NO: 2266 - DNA, 386 bp, Homo sapiens
  CDS 226..375
actcctcgcagttggactggtgggaactgggaacactggagacctgatttctaactgacgctaccgtcgcggccgccggcaagttcctttactgtgttttcttggttcagccttgaagtgagtcgtggacgaacctctctcagcgtccagcctagacggcggtgttgctccggcagcgttcctgggagccgagggccagagactaagttgtgggacgacttcatcatgtctcaggccaccaagaggaagcatgtggtgaaggaggtgctaggggagcacatagtscctccgaccagcagcagattgtcagggtactcaggaccccagggaacaatctgcatgaggtggagacagcccaagggcagcgcttcctggtgagcatgccc

SEQ ID NO: 2267 - DNA, 472 bp, Homo sapiens
  CDS 187..453
atatttgattccctcttgcaatatgtgcttttgatcatgaaactgctgagaaaaggctccttctaaaccacaaaacaaggttgctgctggtgctggggcccgaggaggtccgcgccggagagggccacagggactgagcgagtgacagacgcaccacccgtcaatgctgcaaccctgtaagcctccatggactctctacgtgagtgtagaatgaatcaagccgactcaaacacagcagctattccacatgcagtggaagatattcaaggagacgacagatggatatctcagcacaacagatttgtcctggatggtaaagacaaaaagcctaacgttgtgtttgtgggagaccccatggtgcagttaatgcagcaacacgagatatggcgagagcttttttccccgtttcacgcactgaattttagaactgaggaagatacaagacatgttttatagaaaataaagagtagag

SEQ ID NO: 2268 - DNA, 484 bp, Homo sapiens
  CDS 245..457
  misc_feature 384: n=a, g, c or t
acctggagaccatgtctggggatgcgaccaggaccctggggaaagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagattctbgagtatcagaacaccaccttctttggtggaacctgtatatccatgattgattacctcctctggcvctggtttgagcggctggatgtgtatgggatactggactgtgtgangccacactccagccctgcggctctggatatcagccatgaagtgggaccccacagtctgtgctcttctcatggataagagcattttccagggctttctttg

SEQ ID NO: 2269 - DNA, 502 bp, Homo sapiens
  CDS 257..421
tgagcaggaagacacagtgagtgggagacaagcctggatgctcacatggcctcatgccctggtctgcgaaatgggatggcatcttgcatcatggcggttctgtctagtgggagaatgataaagtgtgcctggcacagtctgtaccttcagtaagtgtggttgtcaaaagcaataattggrttggcactgacattcatcatagatgtacaaaagtaacatgtagatggtgaattgatgaggaggggcccatggagagatgggtttgtgccgtgtactttattcttctaattttcttattctctttgggactgtccctgtggcttccatgtggcttcagacacgtgaggagctgctgcgtgttcagaccggaaacctgagctcatcagcacgcgagcccgggctcttctggggtatcatgttttgagaatatttgtctttgaaattttaaactctcttccatttgtatttgttgaaatttctagagcttttgataactcatgct

SEQ ID NO: 2270 - DNA, 503 bp, Homo sapiens
  CDS 192..422
attttctgctaggtttctattaattataaaccttattttactgtaattagtagtttttattaatgaattaagcaatttcattttcctgttgcgtgacagaaactttttgcataaagggataataaatagagaccaagaaaataaatggtgaataaccattacagactcaagttaatggtctgcatcatgaaatgaagattctcagacttttgggtttcaggattcctgtagcacttctaattattcagaaccccagagtttttgtttatttgggttatattggtatttactatattagaattaggctgggcacggtggctcatgcctgtggtcccagcactttgggaggccaaggcgggtggatcgcctggggtcaggagtttgagaccagcctggccaacgtggtgaaaccgtgtctctactaaaaatacaaaaattggccagaaggtggcagctgcctgtcccagctactcgggtggctgaggcagggaaaactgcttgac

SEQ ID NO: 2271 - DNA, 563 bp, Homo sapiens
  CDS 106..369
aycwattttgtataatttcttttactttcatcatctttttatattgtatatcatatatgataatcctagagcaaaacgagaaaagtcacaggaagagtgttagcaatggaaacagtgcaaacaggagaatctgagatttatttcaaaggcagaagtcatggaataatgagattggtcatttatatgagatttgcaacaaaaagagtcaaagagagctccaagtttcctaggattcttaactgtttagaatcactaggactgtatgggaatgagaaagtgagtggggagatgaatttatctgwwttgaaatttggatattttcttgtatataagtttaggtacttggatgtaaccattcaaaataatacttaaacatttctttgttttttgtttccgtgtaagcagagcttagccatgcgtggtggcatgtgcctatgcctgtggtcccagctactcaggaggctgaggcaggagaatcacttgaaccaagaggtggaggttgcagtgagccaagattgcaccactgcactccagcctgggtgacagagcaatactccatctca

SEQ ID NO: 2272 - DNA, 486 bp, Homo sapiens
  CDS 266..469
tttatccaattaaaggcatatcaccctacatcatcctgacacccttcccgtcaataggtgattgattccattcacacatcaattatttttccttaaacacaaggcatgcttaagtctttttgttcaaaactcagtgaagctggaacatagtgtagtattaggctttgaaattctagtttgaggaagatgaatcacttttttttttaagtggtcccattatccaggaaagastgagaggtacagcaaaaatagttgtaaagtatcaatgtataagagcgcaggagactgggggaaagggctgggttttctaagcaagtgttaccttattcaccctcaaagttattggctttacaacggttggggtcagaggtcacattcacaatgtcaagtgttttctactgtacttttgattaccactactgtcctcaaattaatatccacaaggagcctgagtcagttccatgaattttaaatggtataatatct

SEQ ID NO: 2273 - DNA, 459 bp, Homo sapiens
  CDS 43..213
  misc_feature 58: n=a, g, c or t
ggtgagacatgctgaaggaatactgctctttacggcacccagatgtttggatgtttcntgtacgtgcacatcaaggcacagcaccttttctttaacttatttatgacacagagacctttgttcacatgtcttcctgctgaccctctccccactattaccctattgtsctgccacatccccctctcsgagatggtagagataatgaccaacaaataatgagggaactcagagaccattgccggctcgggtcctccacatgstgagcgcsggtaccctgggscaatttgtctttctctatactttgtgcctgtgtctctttcttttctcagtctctcatcccacctgacaagaaacacccacaggtgtggaaggggcatgagccaccggtgcctggctgtaaatgtgattttttttttaaagaaataataacaktccaattcttatcgtaaacttgtccct

SEQ ID NO: 2274 - DNA, 330 bp, Homo sapiens
  CDS 36..197
aaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctg

SEQ ID NO: 2275 - DNA, 514 bp, Homo sapiens
  CDS 215..424
aataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgtttttttatatgtaaacagatctacta

SEQ ID NO: 2276 - DNA, 467 bp, Homo sapiens
  CDS 219..407
accggtaaccacttcctgcagaaatcctccagccctgttagaaatgcctcagccagggggactcatctcctcaaacctgggggaccgagacctatgagaggtcacagcatgagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagwttgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaggaccta

SEQ ID NO: 2277 - DNA, 451 bp, Homo sapiens
  CDS 188..409
agagggagaggccatgtctgatttacatcagggctgtcacggatttacacagagggaatccgtggcaagtcccatcactcccactcctggaacttgagtaggtcatctcacctctctgagccgctctttctgataagatttggctctgtttccccacccaaatctcatcttgaattgtaattcccacatgtcaggggagggacacgtaggactggacaggcgggaggtgattggatcacggggtcggattccctcacgttcttgtcgtgatagtgagttctcgcgagaggtgatggttttaaagcacggcacttcctcattctcgcacacacgccctcctgctgcccatgaagaaggtgtctgctttcccttcgccttccgccatgattgtaagtttcctgaggcctcctagccatgcttcctgttaaatctgcagaactgtgagtcaatt

SEQ ID NO: 2278 - DNA, 462 bp, Homo sapiens
  CDS 99..254
agcactggcccctggcaggcaggcggcasaggtggggttccagccagagcacgcacgcacggagccgggagcatgcagcctgcactgcgggggatgtgatgctcggctctaactcgcctggctggcccgscacggacgcctcagcttgcaaccatggtaacgtttctggcgggggacaccccggggagcccaccgcgatgggcagcctcctggtgactgatggacgagtgtccacctcccagaccgagagcgcttagtaggtcggaggaagtggagaggatgtaacacgcccccagccgggagtgaagccctgaggaggtaggagccgcatatgtccatccgtgcattcccaccgtcagcgcgcaggggtgctgtagatcaccggtagaactttatttggctggtgcttcattatgctgattaaactgcagtgggatttgatgggcatgattgcgctgggga

SEQ ID NO: 2279 - DNA, 372 bp, Homo sapiens
  CDS 129..293
aaaaattgatcacggtgcaacgtccgcgttctttactggaaaacatcactgcgcttccgtcgcacagagcctgacgaaggtttgggctccccgcgcggtgaccgtcgaggtgacctgcacctggctccatggcggaaccggccggcacgattattcccctctcgggagaggtctgcagccgrgcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaagattagatgggtgttactgattcttacctcagaga

SEQ ID NO: 2280 - DNA, 457 bp, Homo sapiens
  CDS 202..432
attgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttgcctcagcctcccgagtagctgggattacaggtgtgcaccaccacgcccggctaacttttttatttttaacagggacggggtttcaccatgttggccaggctggtctcgaactcctgaccaacatggaggaaccccgtctctactaaaaatacaaaattagctgggcgt

SEQ ID NO: 2281 - DNA, 484 bp, Homo sapiens
  CDS 33..212
aaaaaagatggagcaatgagcttcccagccttatgcaaaacaaaacacccacaaaaacttccaagcttctccaaagagaatctgcatttccctgcaactcacagggaattgaacctgcactgagcttcacggagtttatgagaccttcccattactgcagttgtgttgagcgtcccgtgaggtccttcttaggcaaatttaacttcattgagtgaatgtctgtttctgtttggtgcctacttgatcaggttccatattcgactttcattgtctttccccacactctgctccctaaagagcctcgattttggccaggtgcggtggctcacacctgtaatcccagcactttgggaggccgaggcaggcggatcacaaggccaggagattgagaccagcctggccaatatggtgaaacccatctctactaaaaatacaaaaattagctgggtgtggtggtggacactgtagtcccagctactcggga

SEQ ID NO: 2282 - DNA, 537 bp, Homo sapiens
  CDS 82..234
cttcttcaaggcctccaggdctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttccwagtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactcttttgaagcagtatttcttwgcgaggccatcccccaaccgccctggagtcagtcatgctgggggtgggctctcgstctgttgcaggggtctktatgtcacctatcactgtaatcaagacgcgctat

SEQ ID NO: 2283 - DNA, 454 bp, Homo sapiens
  CDS 199..405
acaaccaagatggctgaggagagggcggaagtgtccgcacgtcgggcctccgaggcttctctttctcccctggcggtccggctctcgatggtggcgtgacgggagcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcgttcggacgcgaggagctggactggacgaccaatgagctgcggaatggcctgcgcvrtcgtagtgggacctcgaggacctggaagagaccatcggtatagtggaagccaacccaggcaagttcaagctcccagccggggacctgca

SEQ ID NO: 2284 - DNA, 559 bp, Homo sapiens
  CDS 222..533
aaaattcagtccagaggatcgaagcggctgctttaacagaagttggggctgcgtaacaacagctccaagcaaagcttcaggctgatcggaaagatgaggaagcagaaaagagactaaagacagacggacaggatggctggggacaacgacagggacccagtgaaaatacgggcaataccgagggctgtaaccctaacacgggcaaatttggaggggctaacatgggcggaaaccatccgtaccagtcaccaccactgtctccagctgtcccagaaccggactcttcctgccatcaaaatggcggcggcgacggcagcggtggtagcacctacgctggcggtgagcaggcaaaggaagttgcttccgagcgcgtcgaaacgatgatgcgcacgcgcaaagtaggcctacgtggagccgacctgccattggatacttctcccctggaccttgttcccaggctccgtgtgaagctgaacactccgcatgatctccctgccaccatagcaagctatgaagttcattacacatgcaggtagcagacaatacaagctctgcttcc

SEQ ID NO: 2285 - DNA, 464 bp, Homo sapiens
  CDS 206..367
  misc_feature 87: n=a, g, c or t
cttccaggttcagagacccccatcctgggaggcacagacgagccttcccctgcctctttccccgtctccatcatgctgygaggggtntggaggggagaggagtgcaggacccagccctgaggtcagacagacagacttggtctgctgacatggcctccagaaacatctttgggagcctttrgtcttctgtgggatctcattgtggatggaatcttccttcagcctgatgaagacaagcacctgtggtgccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgttcccaggcccagccg

SEQ ID NO: 2286 - DNA, 460 bp, Homo sapiens
  CDS 131..349
ccccattttctcttgctgctgccatgtaagaagtgtctttcgcctcccgccatgattctgaggcctccccaaccatgtggaactgtgacgaaacttcagctttaagaggttaaaagacttgtccagagtcatgttaacaggatctccctctgttacccaggctggagtgcagcagcgcaatctcagctcactgcaccctccacctcccaggctcaggagattctcctgcttcagcctcccaactagctgggattacaagcgtgcaccaccaagcccagctgattttctgtattttagtagagatggggtttcacctaatattaaagtccatcatcttgtactaaagatataaaatgttgacctttcctttgtctgtactgcctggtaaaatcttgtcaaaatttccaaattatttcactatgaagcattactacagtaaactatggtatttgttggtagt

SEQ ID NO: 2287 - DNA, 511 bp, Homo sapiens
  CDS 83..394
  misc_feature 319,461: n=a, g, c or t
aacaatggggattccaatttgacactgcatctgggtggagatacaaatctaaaccatatcaacttgtagacataccaacttgatgtttttggacaaaatctggaacaattctacggattaccagacagagactcttgttctcttctcttacacaaatggaatatctgtctctgttctgggtcacctggaggccttctttaaccagtcactgtctaggatctatgtttgcttaaagccatggggctctacaatcagcaggagacaaaaccagccaggagaaaaaaaatctcatcccatagccaacacagctgcgaatgtnctgagtctacgttcaagccaacaagtctcagtcccactcaaggccctcaacatagtaccagggtgttgccactggtaaggcagggcccatgggctcttcagttagcagatattgagaagcaacactgcsaggccaggggcgngaggactacagcctggaggtgaagttaagacaggtgtaagcatcatttga

SEQ ID NO: 2288 - DNA, 439 bp, Homo sapiens
  CDS 218..370
  misc_feature 67,272..273: n=a, g, c or t
attatagctgcccgacccccggcggaactcagagcccggcgacgtctccggcagcacgccctccacncccctggccggcggtggccacagccgcaagaccaggaatggattttcttctgtgtattgctgacacgaacaggagacggaaatactgagtagaagagggcggttccctggctaaggccccaccctcaagcctggatacccgcggccctaaatgagaagaggcttttctgtttggggcccaaaaagttgctttttgwsccaccasnnccctatcctgcccccatataaaccccaaaccccaacctccagagcataccagcaggtwgaggagatacgaggcaagccgactgacggcaaaacgacgtagcagagaaagagagaagaggagggacgtctggacacctagagatgtttggctcggggcagtcagagc

SEQ ID NO: 2289 - DNA, 478 bp, Homo sapiens
  CDS 110..295
tgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctaaaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattag

SEQ ID NO: 2290 - DNA, 505 bp, Homo sapiens
  CDS 62..223
  misc_feature 301: n=a, g, c or t
catttacggggcgcaacatttgctgcgattgtttgtcaaacttccagaaattcttggaaaaatgtcctttactgagaagaatctgaaggctttattgaagcactttgatctctttgtgaggtttttagcagaataccacgatgacttcttcccagagtcagcttacgtcgctgcctctgaggtgcattacagcaccaggaacccccaggcagtcaataagtgttgatggttctgtaagaacaactgctccatctagcatggtgttctgagttccaggtaaaaaattaacaaggtggtgggnttttatccagagcacaaaacaaagtgcccaccagggggstttgacagaggtgtgcctgttgtttgagttccccatgtactgtagactctgtttagaattatttcctaggtgctgaaagtgttctgacatgacacttgctactttgtaggccatctgtgatgsaggtaaaagcaactgttcacagtgaaatgttcatggaagtgt

SEQ ID NO: 2291 - DNA, 502 bp, Homo sapiens
  CDS 188..457
ttcgaactcatccttcatttcaggatataatgcaaaatattgatctggtgatctccttctttagctcaaggttgctgcaagctggagctgagctgtcagtggaacggggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccgcccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgta

SEQ ID NO: 2292 - DNA, 478 bp, Homo sapiens
  CDS 130..309
agttcggttgggactgagtctgcaggtttcaaacctaaacagcgctcttcatcctggacgtgcgatgggggaggagtcggcctgctcagtccccacgacatagcaggactaggttgacaaacaaccgagatgggacacatcttgagaccctcacagtccttggaggaaggcagacgagaaaaagacaagaaaagtgttgattggctgcccttcttattaaacatcgacgcgttcactgacgaggacgtaaacaccgatctggcgtaccacgagcgtgtgtattttcgtttcacaaatactgcttcattttgagcatcaattctgaggtgggacgttatcaccactttttccactgagaggtgacaggttcagaggttgtttgtccacgtttgcacagcgtgtgaaggggaactgaaattgggatctactttccatacctttattctaagcaattatcaaatgcaaaawagggaggaga

SEQ ID NO: 2293 - DNA, 477 bp, Homo sapiens
  CDS 46..324
caaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagamcaaaatagaagggtcctaaatcac

SEQ ID NO: 2294 - DNA, 461 bp, Homo sapiens
  CDS 202..357
agaggaaccgggggaggcagggggaaaaggccggcccagcaattcccctaccccccggtcccacgtgtaccctcctggcctgggtcgccccagcccacggggagcgggcggagtcctggcccacgaagccttgtcacctggcgggcgaatccgcaagcggagacttgtctttaaagggctttgggccgggcgcggtggctcatgcctgggatcccagcactttgggaggccgaggcggtggatcgcgaggtcaggagttcaagaccagcctggccaaggagacccaggaacgaaagcgcagggagcagaggctggaccgtcctctgtcagttccctcgttcccctggagtggagctctgagccctgggaccacagagttggctgttacactggaaacactgatcagacctttggactcagctgagatattcactgagtgcatagtgtgtgcgccagggcct

SEQ ID NO: 2295 - DNA, 311 bp, Homo sapiens
  CDS 47..271
catttcttgttttttgcttgtttgcttgtttgtttgcacctggttgatgtataagtcttggactttgggagacccaaaagagaaggaaggtgttggcaatatccttgaagagactaaaagaactcagaacaacactgaacaagccagcagagccatcaactcacccctacagtctccatacacagactccatgaaagcattggccatcagctctcactggtgtggatatgtcaccagtggggtagagttgttcctctctctgacactgtattagtccattctcacactgctattaaaaaacaaacaaacaa

SEQ ID NO: 2296 - DNA, 378 bp, Homo sapiens
  CDS 182..355
aagtggaagagtgagtagatcagctggataggagtgaggagttggaggaagggttggggtatggccagtgcagttaagtgacttgccttagtgcacacccccagaaagtgacagcaccagcatttgaaccctgacacaagcatctccaaaactgcattcttcccactgtgccacagttaagatgagtccaccagccctgtttagactttggtgtttgaactgcgttttgaaggcaaagaagtcagatagacaaatgaaagagagggaaaaggcactccaggtagcaggaacagcatgtgcagaatcaaagaggcatgaagaaaacttaaaatgtagtcttccaagtcatgtaccctagaacttaaagtataataaaaa

SEQ ID NO: 2297 - DNA, 476 bp, Homo sapiens
  CDS 54..401
ttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcccgcatgctgcccgtggacgagttcctgcccatcatgttcgaccagcaccccaacgagcagtacaaggcacacttctggccacgggacctggtggccttctcccccagcccctgctcgctgcccctacccactatgccggggacgccgagtggctcagtgacacggagacatcctctccatgggatgatgacagcggccgcctcatcagctggagcggctcccaaaagaccct

SEQ ID NO: 2298 - DNA, 386 bp, Homo sapiens
  CDS 99..269
ctacgaaaggacggtcgacttcggcggggcccaggtgagaaaggcccacctgtgtcccggttgagggtctccagggttctttggggcccgaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcaaaaaaaaaaaaaaaa

SEQ ID NO: 2299 - DNA, 335 bp, Homo sapiens
  CDS 36..242
  misc_feature 128..129: n=a, g, c or t
ctgggccccccagcgtgcagcccacactgctggacatggacatggaggggcagaaccaagacagcacagtgcccctgtgcgggggcccacggctcccactaaggcctgcccaccaccgcscgcctggnngccatgaatgtagcgccccaggccctgccccagcccgccatgccacaaggtggggaggccctgggcaggatgttcactctatttattggggaaggagggaggggggggacacttaacttattcctttgtaccccaggggtggagcctgtgcccaccctgcactggggggagggtgggcagggatactcagggacaggggcatcatg

SEQ ID NO: 2300 - DNA, 433 bp, Homo sapiens
  CDS 53..274
ctgtctcaaaaaaaaaataaagacattgctcagaggatttagtatccaaataatggggaaatggggactggagagccatcatacactcctggcagataggggcttggtactgggatacctaatactaagtggtgtcgggaggaggcaggaaatgaacaggatgaatattgttacagtacctcagcataacgaagaaggaaatacattcctacctcataaaaacagtgtttggaggggtggggacctaaaatacaattttcctggatttcatgcatagagtccatcatctgaagatgacatattccattgtatgcagaataatgtaaatcagagctaaggggagagcaaaagggccggggtccactgtgtaatccttcccttgttctgacccaagcccccagtgatgttactaagcttggggtaagagaagaaa

SEQ ID NO: 2301 - DNA, 369 bp, Homo sapiens
  CDS 33..188
tttagcccaggagttcgaggctgcagtgaactatgatcttgctactgtactccaacctgggcgacagagtgagcctgtcccttaaaaaaaaaagaaaaaagaaaaaagaaagcctgctttgtagcagtagagacagcatatatcaaagtgttcagcttaccttataccaagtattaaatcctggacattaaaaaaatgttagattgtgctgggcacagtggctcacgcctgtaatcccagaactttcggaggccgaggtgggcagatcacgaggtcaggagtttgagaccagcctgaccaacacggcgaaaccccatctctactaaaaatacaaaaattagcctggcgtggtggtgcatgcctgtaatc

SEQ ID NO: 2302 - DNA, 487 bp, Homo sapiens
  CDS 25..204
gttaaaatcctcaccatcaatgtgatgttacttggaaatgaggcatttgggaggcaattaggattagatgaggtcatgagggtggagcctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaacccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacag

SEQ ID NO: 2303 - DNA, 507 bp, Homo sapiens
  CDS 226..450
cacaatgcttatgacagtagtctttatgctgtaaattctcaggtaatgttattgaaagtctttatgcagtgcacctctaatgctcaatccttcatccactggcctttagttacttttgcatgtgtgtataagcttcctgattgtatttcagcagcccttataaaatgactgtaattgtcatatgccactgtaaaagtgaggcacttttaaaacattaaactagacatgtatctctacagtctttatgtgcaatctttttttgtaaatattgcaagtttttgctgctgttttgaaataatcaaagacaaaacaggtaatataaagttacaatctaaggctaaggcaaatttgtttatactattagtcatttggttcattcgaatgcctgataatagagttgagtgcaagattattggtagtaaaaagcaggacttttcactggagactctttaaatgtccaggtacccctggcagtctttccatgctgtttttagggggcaacttata

SEQ ID NO: 2304 - DNA, 471 bp, Homo sapiens
  CDS 165..344
attcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattaattattctagtcctgctttagtcctttgtaatttgtggtaattatgcttttctttttaatacaaaaaaatgtata

SEQ ID NO: 2305 - DNA, 374 bp, Homo sapiens
  CDS 87..263
agatctttcttcagaagaaacctgagtggtctcacagacttcctcggttgtgctgttttactgaggttgggtggagtcaacacatcatggataaagaagtccctaaaggcagtcccagggagcccgcactgaacatcaagaagtcagacaaatccttcaaacgcaagaagcccaccgaaaatgtgctgatctttttaatcaacagacaactgggcaggcacagaagtgacatcgacctgtcaagatgggtgtggatgctgtcataaagcaactctagggtggacatggccttggacaaaaagtcatgtggcttacgtgctgaagcctgcccatatttttgagaaattaaatataattagaacaataaaaaaaaa

SEQ ID NO: 2306 - DNA, 457 bp, Homo sapiens
  CDS 13..186
ccggatgttgcgatggctgatcgggggaggycgagaaccgcaggactggccgagaaatctcctttacagacaataggtgaagaacaaacccagaatccctacactgaactgctagtactgaaggctcatcatgatattgtacgatttctggtacagttagatgactacagacaggggaaaaacttttagaactgaatggacacactcaaaagataacagctattattacatttccttccttggaatctgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactag

SEQ ID NO: 2307 - DNA, 469 bp, Homo sapiens
  CDS 301..462
ccatagtgaaaagtttcttatattcactgaccaaagttgattcgtcattataattactgtttagcgcttttgtttgtttgtttttgagacggggtctcgctctgtcacccagcctggagtgcagtggcccgacctcggctcgctgcaacctccacgttctgggttcaggtgattcttgtgcctcggcctcccacatagctgcgattacaggcatgcacctccccgcccagctaattttgtatttttgatagagaccagtttttgccatgttggccaggctattttggtttgttttttgagatggagtctgttgcccaggttggagtacagtggtaccatctcggcttgctgcaacctccgcctcccaggttcaagcgactctcctgsctcagcctccggagtagcttggattacaggcacctascaccacacccagctgattttgtatttttagtagagatgtgatttc

SEQ ID NO: 2308 - DNA, 499 bp, Homo sapiens
  CDS 189..455
actagaacctgctgattcctggtcgccagcttctctttcccacacccacaccacaaccccccgccggcacgtcccggtgtcccttccactctccaccctctccttcccttcggcgccaagtccatccgcccctccgaatctccgattgccgccgtccagttttggcaggtgccggccgacagttgagaatgggactgaggcgcctgatgagatgctgctgctgctgcattgcaaagcacgcggacgacggcgacaagatcgatttcggaggtggcaatgttcacgttgtcacaagcaaagaggactgggaccaaagaattgcggaggcaaacaaggatgggaaaaccgtggttgcaaacttcagcgcttcctggtgtgggccgtgcgtgtcatcgcacctgtctacgccgaaatgtcgcagagtaccctcagctcatgttcctgacgatcgatgttgatgacttgatggagttcarctcgtcgtgggacatccgcgcga

SEQ ID NO: 2309 - DNA, 507 bp, Homo sapiens
  CDS 5..154
aacaatggcaagcaaaattctcccggagacagagtctgtggcagtctttctgggtgaccagccttcacgtggtccaagaacctgctgctcccgggtcctctcatttgaagacacccaccgcctaaggatgaagagaagctccttcttgcagatctgaggctgatttcccaactcccaggaacaccctacccacagcctgttccccagacccagatggggtttgcaggagcaatggctgtagggacactaagatttcaccctccagaagacagcatcttcctgtgccatggctagatcaccagctacccacagacagcctgaactccaattgtcttcctgcacatgtgcctttaaaggaacttttcaaatgtagaggagcctttagaaggaagccttgagcatgaggacagacccccctcatccaaccaccacctgactctgtgtgaacctggaactgttagaatgtctgtgctgtgataaaaggtcatcttcctacaatgttatgat

SEQ ID NO: 2310 - DNA, 472 bp, Homo sapiens
  CDS 163..345
aatgataatgatggggattaatggtgatcctgattttttctctagcgcattacatctaagtgttagtctatgaatgtaatataacagtggtttaaaatcaacagattataacaaaagtccctcacaggagacaaagctggtgccgtgatctctattgcattaatgagacaaatgaggataggaaacatcatgtggcttcccagggctccatggcaggggcgtggcaggggggatttgagtccaggctcctactccagtgctgacctttcccgtcactttcctgctgcccagtgtgagctctatcctgtccagagtcatgaagtattagagcacatggatgtcttatagatgatcttgtccaagtcattcattttagaagagctgatggaacttcagagaggttaaattcacctgttgcaggtcacctatctccttagtgacaagtttgagattacagcccaacttcaagtca

SEQ ID NO: 2311 - DNA, 478 bp, Homo sapiens
  CDS 165..473
ttgtctgscgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcagaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatccaggagatataagt

SEQ ID NO: 2312 - DNA, 468 bp, Homo sapiens
  CDS 283..450
atcaactcccggcctcctctgctctcgcgcctctaggggctcaagcactgctccgggagcgctgaattttgaggaagagggcagaacttcagtaaggagacctgtctgggcaacggtttcaggacacgcggtggggaaagcgactagcctccggcgggcagggcgggctgtccttacctgcagaaccaccggccacgatctgccgagaagcctcgcgcactaagctgacttcaggcttggcggacatcttcgccaggcgggaggacaagggagtgggctgagatgcgtcaacgagctcgcagcctgcacagcctactgatccagagagccccggctgggctggtcctcaagcgcgttggctccctgtggagagcaatcsggcgactgctggaaagaagacccgcggatgggtttgggttggctcaccgcagcggctcaggctttgtctcctagattggcgcccacgac

SEQ ID NO: 2313 - DNA, 329 bp, Homo sapiens
  CDS 132..281
gaaatacaggtttgctgggtgtggtggctcacgcctgtaatcccagcactttgggaggcctaggtgggcgggtcaccagccggccgacatagtgaaaccccgtctctactaaaaatacaaaaatcagccagatgtggtggctcatgcctgtagtcccagctacttgggaggctgaggcgggaggatcgcgtgasctgggaggcagaggttgcagtgagctgagaccacaccactgtactccagcctgggcaacagagtcagactcagtttcaaaaaataaataaacaaacaaaaataaaaaatacaggtttgcagggaggccctgttgg

SEQ ID NO: 2314 - DNA, 391 bp, Homo sapiens
  CDS 96..281
gaggtcawgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcasacgggattccccggccgctgtccagcgctggccgcctgarccaaggctgccgcggaccagtacagtcggggccgctggctggaagggcgagcttcctaaggcggggggaagcccggcgccggggccggagacacccgccatttcac

SEQ ID NO: 2315 - DNA, 372 bp, Homo sapiens
  CDS 14..232
  misc_feature 122,124: n=a, g, c or t
acattgtagcaaaatggcgactgtcattcacaaccccctgaaagcgctcggggaccagttctacaaggaagccattgagcactgccggagttacaactcacggctgtgtgcagagcgcabgngncgtcttcccttcctggactcacagactggggtggcccagaacaactgctacatctggatggagaagaggcaccgaggcccaggccttgccccgggccagctgtatacataaccctgcccgctgcttggcgcaagaagagacgattgcacccacctgaagatccaaaactgcggctgctggagataaaacctgaagtggagcttcccctgaagaaggatgtttcacctcagagagcaccacgctggaag

SEQ ID NO: 2316 - DNA, 423 bp, Homo sapiens
  CDS 3..254
ttatgaacagtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaacctatgatttactatgcagatgaagagggtaggaactaaataaaggactttgtaag

SEQ ID NO: 2317 - DNA, 476 bp, Homo sapiens
  CDS 65..304
cccattacagggtatattttcaaaggattataaatcatgctgctctaaagacacatgcacatgtatgtttattgtggcattattcacaatagcaaagacttggaaccaagccaaatgtccatcaatgatagactggattaagaaaatgtggcacatatacaccatggaatactatgcagccataaaawaggatgagttcatgtcctttgtagggacatggatgaagctggaaaccatcattctcagcaaactatcgcaaggacaaaaaaccaaacaccgcatgttctcactcataggtaggaattgaacaatgagaacactcggacacaggaagggaaacatcacacactggggcctattgtggggtcgggggagtggggagggatagcattgggacatatsccaaatgtaaatgacgggttaatggatgcagcataccaacgtggcacatgtatacatatgtgacaaacctgcac

SEQ ID NO: 2318 - DNA, 238 bp, Homo sapiens
  CDS 34..201
ctcagcatctggagtagctgggattacaggcacatgccaccacgtctggataatttttgtatttttagtagagacggggtttcaccatgctggtcaagctggtctccaastcctgacctcaagtcatctgcccgtgtcggtctccggaagtgctgggattacaggcctgagccaccacactccacccctaatcaccccttctaataaagacacagctcatgtaggatgagagctaaaa

SEQ ID NO: 2319 - DNA, 499 bp, Homo sapiens
  CDS 62..370
gtgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatctgttttcttcattggcagtaaaaatgggggaaagactactattattctaaggtgtcttgacagagatggaaccaccaaaaccaaccttagctttggaatatacatatggaagaagagcaaaagggcacaacacaccaaaagatatcgctcacttttgggaamtcggtggaggaacctctttattggacttaatcagcatacccatcacaggtgacaccttacggacgttttctctgtgttctcgttctggatctttcaaaacctaatgatctctggcccaccatggaaaatctcttgcaagccacaaaaagccatgtagacaaagtgataatgaaactgg

SEQ ID NO: 2320 - DNA, 473 bp, Homo sapiens
  CDS 135..335
gggcatgtctgccatatggctccaggtttgtttttctccccggcactctgacggggagggctcccggcatctcctggcgtccgggtagaggacgcggaggacccccacaggctgggagctttgtgcccattcagatgtgggggcagaagagggcaaggccgaagagcagacagcaccgcttcttggggagttgtgaaggcatcatgcggagggaagagcttagcagccaagtggaggacagcaccctccatgcctggattcgttactcgctcgttctagatgctgagctgctggcgcactgcagcacaactagagatgtacggatgcccccatcttgatcttacagaatcagaggtacagccgcgagaaagagtcaagaacagacagagtcgcttgaggactcaggagggtgtttgctgcgttgaacaacagactacaccctcacagtttgctctgctcttccaaacaccagt

SEQ ID NO: 2321 - DNA, 466 bp, Homo sapiens
  CDS 270..422
taattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaacacctgccatcatgaggatgtgtgctagagtgtgggaccctggccaagtgcaggaatgggccataccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaa

SEQ ID NO: 2322 - DNA, 505 bp, Homo sapiens
  CDS 87..326
acttaggtccccaaccctccctcgggctgtttatcgttgtgccagatgcacagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgacggcgtgctgggttttgaaggcagcgcaataagattggcgtgggcgtggtgcgggatggcaaggtgctggcgaacccgcggcggacttacgtcacgcctcctggcaca

SEQ ID NO: 2323 - DNA, 489 bp, Homo sapiens
  CDS 46..207
aatttactttcacaacaatcccgtgagatcaacttctcaggtaatatgatcctgaccagagggagatgggttggggcatctattctagtccccacctgccagaataggtgtcaggtggctcctcaccactctacatcattagtgtgtacaatggacacagcattatctgaacttccatggctctatgtaaagcattccattgtattttaataattacgcaagacaaggcctctttcacataaggcaaataagtgtgattgattcagacttctggcattactgggccatgctgccgcaagaaacaggtgcatgtggaatcaagcctgacggagttattggtgtgcagaaaaaaaaaaaggattactacttatccggtttttaaagatgagagtgttttatctgatgccctgaccaaatgaaacaacaacctagactgaagcagggaacattcgctggacatttcaggcactgtgctaggctctacagtga

SEQ ID NO: 2324 - DNA, 182 bp, Homo sapiens
  CDS 2..166
catgagattatgtaatcaaaaggtgctgccatttttaatttttaattttttagagacagagtcttgctttgtcacccaggctggtgtgcaatggtacgatcatagcttgttgcaattyttcagccctgggttcaaagtgatcctcctgctacagcctcccagtagctaggacaataggtgtg

SEQ ID NO: 2325 - DNA, 460 bp, Homo sapiens
  CDS 95..265
ttaatttctactttttgtcttaaaattgtctacctaaatataaagttattatctaaatacagatacctaatgtagccaagatgatcaatctaaaatgatactaaataacactaaaaattcaataaactctttgattactgtaaagacacctgactattattatgcatggatgwwwgaggttgatagtttactaactgaacaaatcttatatgacattgtaagagtagacttcattttggttgcaaaggtttctcattggataatttaaaagaaaatttgcatattattttctaattttatatttsttgatttcttaatctattccagtaccttctcattatcctctaccttgctgttaagcctttatttctctgtcctaaaatgacagctgtacaaactctttgacccttaaggattggctcaaggtttctgactgatccaacttcatgtgcggtatcta

SEQ ID NO: 2326 - DNA, 453 bp, Homo sapiens
  CDS 115..294
  misc_feature 237: n=a, g, c or t
cattgtctgtgtttagcttttcctagtattgtgaggtttcaaataggggttccatgtaaatactctttctgctactgaaatgccggcccccttgagtatgcatcacccccacagatggttttgcctttctctatgctaacactttttgagccactgacgtgcagatgggtggttagtttcttgggcttttattttgcaattttatatatatacacatattatatatatatatatatntdtgggttggttttgtatagttttctgtttgaatctctgagcaccaaagctgccctttgattttcacgagaactttccaaagccacttcctgagccctcctgctgctttggtgtctgacggtgatgctgcggtggcatctctgcccgtgaatttctgtatgtgtgtgctgttacctcacctgcagacatgaccctagtaaatctaacgtgcttggc

SEQ ID NO: 2327 - DNA, 493 bp, Homo sapiens
  CDS 140..349
attattagatcacacaggccaaatatcatgcagtgggagggaacttttaatttttagtttattctttatttactttaaaaaagaattagaagaacagattatctataaatgtatatgtatattacacatatacatatatatgaacaatttaaagtttactcaagaatgtgtattttttctacattataaaatgtggtattgggttctaggaaattatttcaaactacacgatcatttgaagaagatagctcttaggaaaaaagagatgatctcctctaacttcttagaaccactgcactgccaaatggggatttatttctattgcctcatccaagtcagttccaaagcttaactcttccatgaagttttccatgatcaatcctgcctaaggttcacaggtgctgtgatgtctttcacaggcaatggataaagcatcctgcattgtcctaggcacactctgtagggaagatatgggaatctgaagtcaactttg

SEQ ID NO: 2328 - DNA, 496 bp, Homo sapiens
  CDS 238..399
ccggattgttgatttactgaggctttgacaattatcctcttgtatatcactggatccttaaatccttagtaagaatggttttgggttaaataaataatggaaaatatttaatttgaatctattaaattacactgaagttatccttccagttaattcagctagttgctgatcagatcattctttatattagacttaagtattgttgcttattatttaawagcagaaaagaaaaaccaaatggcaggtctgagtaatagttactttttgattcttttgatacatatttttaaactgaagaaatcactttatattcagtcttcttctgtggactttttgctatttgcagataaagaaggaattctacttaatatatttttwctgtggtctattaaatgtcattaaacctatatctaagaggaaagtaataactgaaataaaatcaggaatgtgcaaaattgtttcttcatacctcactttctgragacacttctttgca

SEQ ID NO: 2329 - DNA, 493 bp, Homo sapiens
  CDS 210..413
cacgaatggtgtcctgctctacctagataaagaggataaggtttacctaaaactggagaaaggtaatttggttggaggctggcagtattccacgttttctggctttctggtgttccccctataggattcaatttctccatgatgttcatccaggtgagggatgacccactccttagttattggaagatcattttttcatcattggattgatgtcttttattggtttctcatgggtggatatggattctaaggattctagcctgtctgaaccaatacaaaatttcacagattatttgtgtgtgtctgtttcagtatatttggattgtgactctaagcagataatacctatgcttaaatgtaacagtcaaaagctgtctgcaagacttattctgaatttcatttcctgggattactgaattagttacagatgtggaattttatttgtttagttttaaaaagactggcaaccaggtctaaggattagaaaactcta

SEQ ID NO: 2330 - DNA, 413 bp, Homo sapiens
  CDS 33..230
aggtccccgccggcagtgcgtgtggtgaggacatggcggaggcaggaaaagtgcccttgagcctcgggcttaccggagagaagcggcagagtggcctctgcagcggtasccgctgcataccctcaaacaccagagacccacctgggccatgcctggaagctgggacascccctgccccacatggaaggtttttgattccaatgaagaatctggatatcttgttctcaccatagttatatcaggtcatttcttcattttccaaggacagacactactggaagggttttcactcattggtagcaaggactggttgaagattgtaagacgcgtggattgtctgttgtttggaacaacgataaaggacaagagtcgcctgtttcgagtacagttcagtggagagtcaaaggagcagg

SEQ ID NO: 2331 - DNA, 492 bp, Homo sapiens
  CDS 123..350
tatcagattttcggaaatgtacttaagagagatgggatgcatgttctttgctcactttttaaccctgtttcatgcattttgctgtttggatcatgaatatgatgataagagatccttaatagatgatgaagaccaggattaaattattcctaaaaagctgcatgaagattgggtccctggatttgagtctccatccttgccctgatcacttagctctagaatctgttcatgaaagagagagaaaacgtattgcatcttatttcaaacacgttttcccctttggattaaatattattctaactgaagcagaattgagcacctggaaatggtgtatttttttttatagcttttagcaaagtcccaaaaagagagaaaaactcaggttattaccagttcatctgaaaacacaggtggaagggattatagctttgccaaggaagagtttttcttctctgctgcctgcaatctaagctgagagagtctaaacaaatt

SEQ ID NO: 2332 - DNA, 452 bp, Homo sapiens
  CDS 80..313
aattccacccatcgccgccgaaatcccgttgcgtctctcgcgcgttaccaagctctcaagttttctcgcgccgacggcaatggatgaggtcaccgaggccgtgaacaacctcaacatctcgggcgtaggggccgcgggcgttgccggggcggaagggcacaagaagaatcgcatccaggtctccaacactaagaagcccctcttcttctatgtcaacctcgccaagagtacatgcagctgcacaacgaakagagctgtcggccctcggcatggccattgcgacggtggtgacagtagcagaaattctgaaaaataacgggcttgctgtcgcgaagagtatcatgacatctactgttgatatcaaggacgagactaggacccggcctatccagaaggccaagattgaaatattgcttggcaagacggagaagtttgatgagctgatggcagcg

SEQ ID NO: 2333 - DNA, 456 bp, Homo sapiens
  CDS 50..310
agtactaaaatccttatggaccttgtgacatcaccactgtcctcttgcaatgtcaaccactctgccaagtttggcaaatactcctttatggactgtagaaaccctctgcttacaaattcctccctgctactccaccaacagtgctctttccaaagtcaacaatgactgtcttgtcactaagtcacatttttaccatggccaccttctcccattctgttcctttgatttctgtattgttataatttcctgtttctctcccccccgccatcttttgggctgcttttctttttttaacaggttcatatccttttaattactgggtttcttgagtctcagcccttgttatctgcagttctcagtcaacattttccttctgggtgatctcatcccctcctgtatgagtttgctagggctgctgtaacaaagttccacaaacatggtggctgaaacaccaga

SEQ ID NO: 2334 - DNA, 443 bp, Homo sapiens
  CDS 251..400
aggggatccgtagtgtctaaagagggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggaacagctaccggacctgcatagccatttttctgatctgaacctggaagctcatatgtatgcatcccagtggtttctcac

SEQ ID NO: 2335 - DNA, 413 bp, Homo sapiens
  CDS 95..331
taacattgtggaatccttcgaggaggtggaggacagcctgtgtgtcccccagtataacaagtacagggaggagagggtgatcctcttcctgaagatggcctccgggcacgccttccagcctgacttggttaagaggatccgtgactccatccgcatgggcttgtctgmarcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtsagactggctggcgtgtcactcagccgcacscgtgtgvactgtaacttttgtgtgctcaag

SEQ ID NO: 2336 - DNA, 479 bp, Homo sapiens
  CDS 133..462
aagtacccttttaatgaatatttagattttgtgcttttaatacaatattgctgtgaagattcttatatgtatattttggcatacttttgcctaagataaattctagcagtgtaattgctgactcagagggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagactgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcc

SEQ ID NO: 2337 - DNA, 311 bp, Homo sapiens
  CDS 62..217
accatgagccacagcagtaagccatgctttagcctctgacctgtgctccaattttggtacaatgatttctgccatgttctccaacagggtgaggaaacagacagcactaagagaaaaagctggaactcaaaaccaaattaactccaaacttaagttttcccacttcgacaagaaaaggaactgcatgtgtttttctgcctcttgcagatgtatgtcataaaagttggatgccttcctttcaagacatttgaatggatcaccaaataattacctacttttctctcacaactcagataaataattaaaaggag

SEQ ID NO: 2338 - DNA, 450 bp, Homo sapiens
  CDS 23..268
attatacaaaaaagatacttgcatgtgcatgtttatagcagcacgattcacaattgcaaaatcatggaaccaacccaaatgcccatcaatcaatgagtgggtaaagaaactgtggtatatacacacaatggaatactatgcagccataaaaaggaatgaattaacagcatttgcagtgacctggatgagattggagactattattctaagtgaagtaactcaggaatggaaaaccaaacatcgcatgttctcactgatatgtgggagctaagctatgaggacgcaaaggcataagaatgataaaatgggccgggcacagcggctcacgcctgtaatcccagcactttgggaggccaaggtgggcggatcatgaggtcaggagtttgagaccagcctgacctacatggtgaaaccccatttctactaaaaatacaaaaattagctgggcgt

SEQ ID NO: 2339 - DNA, 378 bp, Homo sapiens
  CDS 132..281
  misc_feature 301,347,365: n=a, g, c or t
gaaatacaggtttgctgggtgtggtggctcacgcctgtaatcccagcactttgggaggcctaggtgggcgggtcaccagccggccgacatagtgaaaccccgtctctactaaaaatacaaaaatcagccagatgtggtggctcatgcctgtagtcccagctacttgggaggctgaggcgggaggatcgcgtgasctgggaggcagaggttgcagtgagctgagaccacaccactgtactccagcctgggcaacagagtcagactcagtttcaaaaaataaataaacaaacaaaaataaaanatacaggtttgcagggaggccctgtgggtggggaagcatggkcaangcattctctcctaatgtngcatgtdggtaga

SEQ ID NO: 2340 - DNA, 492 bp, Homo sapiens
  CDS 239..388
tgcaattatttatctctttattttttctgaaatcaagagcagaatgtatccaagtgaaactaaaagagcgaggtcaaggggaaacaacacagggcttgtggagtcataaatatgtattaaagcagcagagttaattttgtcccaagttccatattggccaggaaaaaagaaacaagatcagcagagttaacagctctcaacctgaatatgcctcagaatttctaggaggacttaagtaatgagattcctgggtttctacatggaccaactcaatcaaactcttcaggagacagctgctgttgttagactgtgtctcccaaaattcttgtgttggaaacttagttcccaatgtaatgatactggcaggtgtggcctagtggggggtgtttagatcatgagggcttcagctcatgaatggattaatgttgatatctcaggagtgagtttcctcttgctctctgtagccctctctcttgccacatgatgacttcc

SEQ ID NO: 2341 - DNA, 339 bp, Homo sapiens
  CDS 27..194
ctctcttgcctgcctccacataagaaatgcctttcggccgagcgtggtggctcacgcctataatcccagcactttgggaggctgaggcgggtggatcactaagtcaggaaatcgagaccatcctggctaacatggtgaaacccgtctctactaaaaaatataaaaaatcagccaggtgtggtggcgggcgcctgtagtcccagctgctcaggaggctgaggcaggagaatggcgtgaacccgggaggcggasttgcagtgatccgagatcgcggcactgcactccagcctgggcgacagagcgagactccgtctcaaaaaataaaaaaaaaaaaaaaaa

SEQ ID NO: 2342 - DNA, 295 bp, Homo sapiens
  CDS 8..193
atatattatggtaacaagatggctctatgagctggccatactcagtagtcagagtgaaaccggccatgtaaaaacgacaaagcataggattcagtgtaggagcttgggccccgtggtatcagttgacttacagactgagttcaaccacatgggcaacatattaatcaatcatacctatgcaataaagtcttcataaaaactatggacaacaaagttctgcagactttgcaaaaaagaaagaagaaagtaaataaatgaaaatagaaaggaagctagagaaagagagaaagaaaga

SEQ ID NO: 2343 - DNA, 478 bp, Homo sapiens
  CDS 301..462
ccatagtgaaaagtttcttatattcactgaccaaagttgattcgtcattataattactgtttagcgcttttgtttgtttgtttttgagacggggtctcgctctgtcacccagcctggagtgcagtggcccgacctcggctcgctgcaacctccacgttctgggttcaggtgattcttgtgcctcggcctcccacatagctgcgattacaggcatgcacctccccgcccagctaattttgtatttttgatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttg

SEQ ID NO: 2344 - DNA, 516 bp, Homo sapiens
  CDS 296..478
atctatagattcaatacaatccctatcaaaatgccaagatcatttttcacagaattagaaaaaaagtcctagaatttatatggaataaaaaaattagcccaaatagccaagacagttctgaggaaaaagaacaaagctggaggcatcacattgcctgacttcagattatattacaaggctctagtaacccaaacataatgatactgatataaaaataaacacatagaaaaatggaacaaaacagagaatccagaaatggagccacatatttccagttaagtgacctttgacaaagatgataagaacatactttgggaaacggacctcgtttttaggaaatggtactgggaaaattggttatgaaactgaacccctatttcacactatatataaattctgcacattttctttaaactatctgaaccatgaatactgccttatttattgtctgtatgaccaaaatatccaaatctatatctgatcttcaaacattgaattgcacattttatccatttc

SEQ ID NO: 2345 - DNA, 498 bp, Homo sapiens
  CDS 106..288
agaaaatatcctgaaagtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggcaaatttgagtttcatcatggtgactatgaaaaacagtttctgcatgtactgagccgcaagacaagactggaatcgttgtcaacaatcctaaccagtcagtgtttctcttcattgacagacagcacttgcagactccaaaaaacaaagctacaatcttcaagttatgcagcatctgcctctacctgccacaggacagctcacccactgggcagttggcacatagaggatcacctccgtmcttatatgcagagtagagtac

SEQ ID NO: 2346 - DNA, 466 bp, Homo sapiens
  CDS 141..308
  misc_feature 448: n=a, g, c or t
atgtgatgttaaagtatcaattttagatctttcccactttctcttgtgggcatttagtgctataaatttccctctaaacactgcttttgctgtgtcccagagaccctggtacgttgtgtctttgttctcattgcagggacatggatgaagctggaagccatcattctcggcaaactgacacaggaacagaaaaccaaacaccgcatgttctcactcgtaagtgggagttgaacaatgagaacacatggacacagggagggaaagatcacacactggggcctttcagagggtggggggctgggggaagatagcattagagggaatacctaatgtagatgatgggttgatgggtgcggcaaaccaccatggcacatgtatacctatgtaacaaacctgcccattctgcacaagtatgccagaacttaaagtataaaamaaaatgaaatgnatggaagcagagtacctg

SEQ ID NO: 2347 - DNA, 480 bp, Homo sapiens
  CDS 42..218
tcgcagtggcaaagacttggagtcggcccaggtgtccatcaatgatagactggattaagaaagggtggcgcatatacaccatggagtactttgcagccataaaaaaggatgagttaatgtccattgcagggacatggatgaagctggaggccatcgttctcggcaaactatcacaggatcagagaaccatctgcatgttctcactcataggtgggaggtgaacaatgagagcacatggacacgggaagggaaacatcacacaccagaacgtgtcgcgggggtaggggggtgggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaaaacaaacaacaaaaaaagtgttgattaacaggccgggagcggc

SEQ ID NO: 2348 - DNA, 415 bp, Homo sapiens
  CDS 54..260
ctttcttccttttggtacgagcttgctgtggtttttgctctgggtcctctgggatggcgcctggctgtgcgcgtggtctctcacgcaggggcgccgggcgggggaacgcggccaccctgagtctggtgagtcgactgcggcggcctgtgtccgaagtgtccggggccgtgaacaagggcagcggcctggcctcaggctgcgttcccacgtttggaaacggggagcttcgtcgattttgtttacatcatcgactatgccagtagttctccagataagcctggttttattttcgtcagtgaaaaggccttaccgtataactgactttatgcttgccctgcccccgtataaaaataacttaaaagcagcgtgcctggttacagctgtttccacgtgcggtgctcgtcgggagtgatca

SEQ ID NO: 2349 - DNA, 317 bp, Homo sapiens
  CDS 27..194
ctctcttgcctgcctccacataagaaatgcctttcggccgagcgtggtggctcacgcctataatcccagcactttgggaggctgaggcgggtggatcactaagtcaggaaatcgagaccatcctggctaacatggtgaaacccgtctctactaaaaaatataaaaaatcagccaggtgtggtggcgggcgcctgtagtcccagctgctcaggaggctgaggcaggagaatggcgtgaacccgggaggcggagcttgcagtgatccgagatcgcggcactgcactccagcctgggcgacagagcgagactccgtctca

SEQ ID NO: 2350 - DNA, 503 bp, Homo sapiens
  CDS 11..202
ggtttggtctatgcacgtaacacatattatctcattcaatccccgacaacaaccctctgaaggagtgtccttattgtccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatctaattttaagaaatagcacaaagagtccgggcatggtggctcacagcccatctagcataatgttttgcatagttgtcagcagataaatattgaatgacaaaactcagatggaggaaaaagaacaaaataacctagttctcagaaagatttaatgagcaaatgggaaaatgtcaaaaagatttgcaatgccattcctaaataacaatttccccttttagtcattagaaaacgtctaaacactttcaacattaaatctttcacttgcatttt

SEQ ID NO: 2351 - DNA, 616 bp, Homo sapiens
  CDS 34..381
agctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggagcagcacctcaggaaagggaaagccaccagggtggtggcgagcctgggatcaccagagctgtgatgtcaaaattcaggtctctgagcgg

SEQ ID NO: 2352 - DNA, 487 bp, Homo sapiens
  CDS 48..197
ttatttccttttcttgtctgattatatgggctagaatctccaatacaatgttgaatagaagtggtgagagtagacagacctgtcttgttcatgatcttaggggaaaaacattaatgaaccctaatgttcattatagggttttgtttggtagatgccttttattaggtaagaagattcccttctattcctggcttgcttaattttttttttaacaatcaggaacgaatcttggattttgccaaatgttttttctgcctttaatgaaatgattctgatcattttaattgtttagtctgttaatacagtgaattacactgattgattttccagtgttaaagccactttgcagtcctaggagaaatcccactggttgtgatgtacagttgtcttcccttatccatgggggatgtgttccaagacccctagtgaatgcctgaaacctcagatagtaccaaaccctatatacactattttttttcctgtacag

SEQ ID NO: 2353 - DNA, 469 bp, Homo sapiens
  CDS 301..459
agccctgggagagcttgttttagtcgattggacagtgagctaaatgttataataaatcctgcttccttcttcccagggcagagggagctctgcatcttcagagattttgatcctgccctgggtcctagcccacattgctccaccctacccccactctccgccccacaagaggatgattcatcagcccagaactactggagttggtttggacagtttccaatcgttatagagaggaagaggggtcagggactccagggacttcgacttttttgcctattgggtctccttccaaggaggcgaatgttccggataaactctggggcaagaggcaatggcaaactgaagaagtccttcctttccagagccaagttgttcaccttccaacgggcaaactccctgggggaaaagccaagggataaggaaaagctgacctcgtttcagagcaagaggcataaaatctgaagagaag

SEQ ID NO: 2354 - DNA, 494 bp, Homo sapiens
  CDS 209..478
  misc_feature 19: n=a, g, c or t
atctcgcgtccccaacggnyccccgggtcggtttccgcggtggccatgactgcggccgtgttcttcggctgcgcckwtcattgccttcggrmctgcgctcgccctttatgtcttcaccatcgcsaccgagccgttgcgtatcatcttcctcatcgccggagctttcttctggttggtgtctctactgatttcgtcccttgtttggttcatggcaagagtcattattgmcaacaaagatggaccamcacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgaccttcataagttcttattatggaataaacctggcgtcasatttataatcctggtgctcatgggcactgggcattcttagctgcgggaggcas

SEQ ID NO: 2355 - DNA, 479 bp, Homo sapiens
  CDS 168..350
tacaaccaaattaatccagcaagctaaggctcagatcactgtggatatgtccaaatcctccatgagatacatcttagagaaggctttccacctgtgcacagtggaacacttacagtatcctcctaacttcttttcctgactctgggctctctttctccagttagccaatgggtaataggttaaccctttccaacatgactaacctctttaatgaaatgaaggtgatgaagatgaggaggaagatcattgtgataacgataaaaatatcaaggcacagagaacgtaagaaatgtaccctaggtaacatgggtaataatggaggaagaaaggaagaggaagaaaacagcaattaatgaacatagacaatgtgccaggaacagtgacatcaacccttaaatatattagctggtttaatctcctggactctgaccccaagtatagagccagttccctgttctttaccatcacactgtactggt

SEQ ID NO: 2356 - DNA, 488 bp, Homo sapiens
  CDS 154..315
atgggcacaaggctcctctgctgggcagccatatgtctcctgggggcaggtgattcctcagatgccaagcagtctcctatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagccacagcactactgctccagtgtcagcttggttccctaggaaatggggtttctagaacctgaatgctgacaaataagagttgtatatgtgtataccatgaaaaaaaaaaaaaa

SEQ ID NO: 2357 - DNA, 456 bp, Homo sapiens
  CDS 144..353
attgatgtctactgtaaagtagagttggatggcaccatttctgctctcaaacagtttaaaagatccctgtgcagaaaaagacgtatttagaacattttggttgtttttcagataaaagatgcctattttattctggctgaaasatgaacagaataaacaatgagctctgtgaagaatgttctatgaacccgaatcaaactcaaactcctgtgtcactccggaacctccctctctgttactactccctttggatttatccagtagtcttagacgtcaccagggccaatccatgcatatatagattgawatgttgttttcaaaacctactcaagctatctcttgatgaacaagattagtaccatctgattacaaccctgaagacctgctattctgcaaggcaaaaacataactgcgtggctgatagcatccttatacctcaggagcttttccaacaat

SEQ ID NO: 2358 - DNA, 473 bp, Homo sapiens
  CDS 148..432
aacggaccactaaggaataaagaaatgggggcttgccggtcccactggaacaggcactgtgggctgcagatgattctcacttgtcctgaggataaaaaggaaaaaaattcttctcctcagaaaattatgaacaaggcctaatatcccatggatgaacctcttcaccttttctgcccagggaatatggtgctactacagtcctgcaaaaaccaacagccagaccagcagctagccaaagagtggacgggacttcataaggtgctgctgaccactcatttctctgagaaacaggctggaatcaagccatggttaccacatattcagataaagacagctcctcctcaacccaatacctcatacaaccagcccacttcgtcaagtgagccaagagaagatctaaagttcctaacaaaggaaaatcagatagataagtagtacccttctgttaccatgaagttcttaattaaaaaaaa

SEQ ID NO: 2359 - DNA, 473 bp, Homo sapiens
  CDS 141..293
atgttcaaggttatccacaccaggcagaggacaaactccactcctggccttcctgcccagctagatttaaggattgtaaccaggacagtgagtcccttctgggaaaggggcctcgtggaggttatgaaatccagcaggtcatggaaggagaaacgattgacaatccagacgggatggaggcaggagttggctcagtaaccccatctttcctatccaccagcactcccctgcgcttcccaagtgatttaattatccattctttaactgcaactcggttagccctgaaatttgggtgaagagaaatcagacacaggcatcagcactcctggtttgggggacttaggattcagactgggacctatgccattggtttccctggttctcaggcctctgggcttcattggactggaactatactaccagttttcctgggtcttcagcttgcagatggcagattgtggavttctcagtct

SEQ ID NO: 2360 - DNA, 540 bp, Homo sapiens
  CDS 209..400
  misc_feature 489,491..496: n=a, g, c or t
atagtttttattatttcttcttttccttttgttttcataatataatgcagtttrttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcmcgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtccagtgagtggtggctttttttctttccacattggcacattcacttccnmnnnnnnttggcatgtaagaaataagcatttacataattggaaaaatctgg

SEQ ID NO: 2361 - DNA, 470 bp, Homo sapiens
  CDS 70..351
  misc_feature 368: n=a, g, c or t
aactgcctaactgtcaarasskgscacakgaacatctaagcttctctactcaccagacggcctcaaatcatggggagcaccaaaggcttgggacttatgtatcctcaattgtcagcattttgtctcatttctcaatattcctggttcatacatcagttgtggggactgagggggatggcactgagtttattttctaaaattgtaaggctccttgctgtgttgaaatgcagagtagaaaatgtgctttctgaggtcaacttgccaccaagagagaagaaagaggaatgtctttttttttttycctgccaaattcaccatcatataaratgctatacctggaaggtgtggaagtaggaggacagaawtangccagaragtttatattawttgatgtcctttcacatttagggaaacatctggagtgggaaagagatgttcccttcttaatagttgatgcttcgcactcacct

SEQ ID NO: 2362 - DNA, 485 bp, Homo sapiens
  CDS 257..412
aacttaatttccttactcatgaaattaatataataaggctaagttggtcagtagttaaactaactaaatttggctgaagattgctatgttcactatgcaaagattagaccgttagttccctgagtgaagagatgctatcttggtatctccagcttccaaccgggggcttggcacagaataggggcttggtaaatgttttccaaatgaatgggatgtttgatggaaagaagacaaggtgaaggaattcctgggtaatatggagatgagaatctgtgagaaggatacatgtactgatgcctgtcgcggtggacacacagacgcacacattgcggaacaccaccataagaatattgagaatatcgagaacacttcaatattccaaacttcaatggaaatatacgtaggtttcacttaactatggtcctgatggcttttttgaaaaagaaagaaagaaaaaatgttttcatcatattaagaaaatgtct

SEQ ID NO: 2363 - DNA, 495 bp, Homo sapiens
  CDS 36..368
  misc_feature 31: n=a, g, c or t
cttggcgaacggtcttcggaagcggcggcgncgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagatatgaggaaagcactttccagggatactgagaagaaatccatcataccattacctcatcctgtgaggcctgaagacattgaataaccctgggcagtggttcttaggcagatactctagatgctttatggacaatattattttcattggatgatt

SEQ ID NO: 2364 - DNA, 358 bp, Homo sapiens
  CDS 24..182
attcttggtgctttcaagacctgatgctttgttttgaacaggttgatacatctagtaagaagactttcaccaggtgctggtggcakgttcttggacttctcagtctcccaaaccataagccaagagtgaaatacatcaccgctttccctgctcccgccgccattaaaattgtgtttggcatctgaccaccaagatacagatatttcctagactgttttgcagctaggtacttagaagtttttctaagttatttaaacttctcaccacacaaaatctggatttgtatctgtcacgtagtaattgcttgataaatcatttctctttcctctggagaaaaatatctgctttctttaaaata

SEQ ID NO: 2365 - DNA, 482 bp, Homo sapiens
  CDS 3..329
  misc_feature 466: n=a, g, c or t
ggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgtgcccttctttcccttcagagaaccagtgtccctgtgactccacccactcatctggccaccgttgccctgacctgccaggagcctggagaagatgaaggcatccgtggttctctccctccttggctacctggtggttccaagtggtgcttasatcttggggcgttgcacagtggctaagaaactccacgatggaggcctggattattttgagggctatagcttgagaactggggtgtgcytggcctacttcgagagcaagttcaaccccatggscatctasgrgaacacacgtgagggctacactggctttngcctctttcagatgcg

SEQ ID NO: 2366 - DNA, 531 bp, Homo sapiens
  CDS 166..402
gtaccgtgggagctgcggggactagcagagagctaaactatgcatttcaaacagcagtgcttgtgcagaaagaggggtgagagagaggcagccggcgaggaaagagcacagctggactttctccttgtttttatccatttctgcaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcgcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgc

SEQ ID NO: 2367 - DNA, 565 bp, Homo sapiens
  CDS 118..285
gaaaaagaccagaccaacagtaacaccawktggcaggtgggcaggcctccgccctcctcccctactccagggcccactgcagcctcaagcccaggagccaccagatctcccaacaccatggtccgataccgcgtgaggagcctgagcgaaacgctcgcaacgagggtgtacaggcsgacagttgcatgggcaagagcaagtgacaccacggscsaagaggagcaagtggctgagcccggaagcacgtcgaaggtctacgagaggacccatggscaagtctcactataggcgcagacactggctctcgaaggaaggctgcaccgggatccacaggcggcagcatcgctcctgcagaarggcgcaaaagacgctccctgcaggcaccggaggagggcatcgcagagaactttctttcccaaaaggctgcagaaccaggaagagaacatgcagaaggcactaagcttcctggggcccctcacccccagctggaaattaagaaaaagtcgcccgaaacaccaagtgaggccatagcaattcccctacatcaaatgctcaagccccccca

SEQ ID NO: 2368 - DNA, 472 bp, Homo sapiens
  CDS 266..454
actttcttcagagagtggtgcagcgccagacattttgcacataaggcaccaaacagcccaggactgccgagactctggccgcccgaagagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggvggggccgcaggcarcccttgtttctctaacaaacaaacaaacaaacagccttgtttctctagtcacatcatgtgtatacaaggaagccaggaatacaggttttcttgatgattkgggttttaattttgtttttatkgcacctgacaaaatacakttatctgatggtccctcaattatgttattttaataaaataaattaaat

SEQ ID NO: 2369 - DNA, 489 bp, Homo sapiens
  CDS 13..330
agcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggcctgtgatacttgggctgtgatcctctagagccagcttggactcacatcattctatggggttgaagacaactcattccctctgaggagccttgtacatacaagccttttatttataacttattttgtattgaaacttaaaaacaatactgaagaaaaaaaaac

SEQ ID NO: 2370 - DNA, 454 bp, Homo sapiens
  CDS 34..216
agtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacggggaagaaaggggctgcgacaaagatggcggccgtgacggcacctgaggcggagagcgggccagcgcacccggccccagcgaccagcccagccaggagctccctcagcacgagctgccgccggagagccagtgagcgaggggacccagcacgaccccctgagtcaggagagcgagctggaggaaccactgagtcaggagagcgaggtggaagaaccactgagtcaggagagccaggtggaggamcactgagtcaggagagcgaggtggagga

SEQ ID NO: 2371 - DNA, 388 bp, Homo sapiens
  CDS 18..191
tgattttattcttggaaatgaggttgttcttaagatatattaggtgcttctgtagatttaattttccttacctgtatcaaaaaagccgtcttggcccggtgaggtggttcacgcccattatcccaacactttgggaggccgaggtgggtggatcacttgaggccaggagtttgagaccagcctggccaacatgatgaagccctgtttcaactaaaaatgcaaaaatcagtcggacgtagtgttgcacgcctgtaatctcagctactctggaggctgaggcacgagaatcacttgaacccaggaggcggaggttgcggtgagccgagatcacgtcctacactccagcctcagctacagagcaagagtctgtccaaaaaaaaaaaaaaaa

SEQ ID NO: 2372 - DNA, 556 bp, Homo sapiens
  CDS 141..515
aagacggcgctattccgctgtaacagcttccggcgggtcctggatgttgatgtcctgcatctaacgcggtgtaaccccgaagccgagcgagctccggagaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaraataaatgttttctacattttcatttggctaaatccacgaatg

SEQ ID NO: 2373 - DNA, 523 bp, Homo sapiens
  CDS 219..464
acactaaatgcaagcacgatgcagcagtcagtcaagggattcttagtggtgacaactggggaaaaataatgaaaaataagtttatggcctatccactacatgaggaagtagcctactcaaggtgaagatgacaaggatgaagaattttatgatgatccacttccatttaatgaataccatccatgtaagatgtgacttgctcctccttgccttccaccatgattgtgaggcttccccagccacgtggaactaaacaagggacttttttaaaaaaaaacaagaatttgctctatcacccaggctggaatgcagtggtgcaatcatacatacgtcactgcagccttgagatcctggactcaagtgatcctcccacctcagcctccagagtagctgggactacacgtgcgcaccaccattgctggctaagaacaggacatcttaatatacattcatcaaaaatgagctgactcaatttctgaaaagaaagtaaggtagcgaaattgacatacactaagaaacatta

SEQ ID NO: 2374 - DNA, 446 bp, Homo sapiens
  CDS 74..265
gaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttacc

SEQ ID NO: 2375 - DNA, 585 bp, Homo sapiens
  CDS 219..464
  misc_feature 562: n=a, g, c or t
acactaaatgcaagcacgatgcagcagtcagtcaagggattcttagtggtgacaactggggaaaaataatgaaaaataagtttatggcctatccactacatgaggaagtagcctactcaaggtgaagatgacaaggatgaagaattttatgatgatccacttccatttaatgaataccatccatgtaagatgtgacttgctcctccttgccttccaccatgattgtgaggcttccccagccacgtggaactaaacaagggacttttttaaaaaaaaacaagaatttgctctatcacccaggctggaatgcagtggtgcaatcatacatacgtcactgcagccttgagatcctggactcaagtgatcctcccacctcagcctccagagtagctgggactacacgtgcgcaccaccattgctggctaagaacaggacatcttaatatacattcatcaaaaatgagctgactcaatttctgaaaagaaagtaaggtagcgaaattgacatacactaagaaacatttttcttctgacccttttgaataaactttgaggatagcctnaaaaaaaaaaaaaaaaaaaaaaa

SEQ ID NO: 2376 - DNA, 520 bp, Homo sapiens
  CDS 261..503
agaatactgagctctgacattgggtgagataaaacactgccctggaggagagcttctttcwagatgaggcgtttatagataaagacgtattcacaggcttacaaagataatgtatagacttcacgtttctttcttttaggggctcaaagcactttatgagcatttcttaactcaccttcaagtgcgcgcaggaattcggagagcagtgggcccactgttattgtgctccatgtccagattggaagctgaggcacgaaccaatgaggcaaagtgtctgtgaacacaagcagagtcagccagagctaggctcccttcatacaccaggggattccgggcagtttggtggttatgccaaggaagcagactacgtagcacaagccacccgtctgcgtgctgccctggagggcacagccacctaccggggggacatctacttctgcacgggttatgaccctcccatgwagccctacggacggcgcaatgagatctggctgttgaagacatgagtgacccactgaac

SEQ ID NO: 2377 - DNA, 487 bp, Homo sapiens
  CDS 231..440
aactgctgttgtgagctgtaacactcattgcgaaggtccgcagcttcacttctgaagcctaccagaccacgaactcaccaggaggaacgaacaactccagacatgccgccttaagagctgtaacactcaccgcaaaggtttgcagcttcacttctgagccagcaagaccacgaacccaccagaaggaacaaactctgagcacatgggaacatcagaaggtaggacacaagatggtgccatctatgaggaacaggccctcaccagacaccagatctgtgggtgccttgatcttggatttcctagcttccaaaactcttcagggactggatctggatatggaccagatatctctagccaccatgatggcactggctccttcaccagatgaaacaatacttcaaaacaagccagtggagcaggtcacgccacccgacaactcctagttccgctgcctcttctgcactccaaactctctcttcaaaagctc

SEQ ID NO: 2378 - DNA, 459 bp, Homo sapiens
  CDS 169..378
  misc_feature 260: n=a, g, c or t
acttgcctggacgctgcgccacatcccaccggcccttacactgtggtgtccagcagcatccggcttcatggggggacttgaaccctgcagcaggctcctgctcctgcctctcctgmtggctattgcagttgctctacggtgagcccgggcgtgctggcagggatcgtgatgggagacctggtgctgacagtgctcattgccctggccgtgtacttcctgggccggctggtccctcgggggcgaggggctgcggaggcasnacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagccaccctgcacctcattccactcctaccgcgatacaga

SEQ ID NO: 2379 - DNA, 535 bp, Homo sapiens
  CDS 12..398
atgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaaaaaaaaaaaaaaatgcgaaa

SEQ ID NO: 2380 - DNA, 485 bp, Homo sapiens
  CDS 12..368
  misc_feature 277..278: n=a, g, c or t
atgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttgtaaaaccaaaggatcctttgaaaatctctcttcaggatttaatcaacagtaatcaaggagacacagtaaccaccannctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaa

SEQ ID NO: 2381 - DNA, 498 bp, Homo sapiens
  CDS 129..395
gctcctggaaaggaccgtccacccctccgcgctggcgtgtggacgcggaactcagccgagaaacgcgattgagaaatggaaaagaaaatgaaataaatcagcagttatgaggcagagctaagagaactatggcaacatcaggtgactgtcccataagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcggggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaact

SEQ ID NO: 2382 - DNA, 437 bp, Homo sapiens
  CDS 169..414
  misc_feature 83..84,91..93: n=a, g, c or t
acattcgcgagcggascgagcgcgggagaccggacccgagagcagagctgctgtttcggcgcgggtcggctggcggccgactnnmccagannncccacccggcaccacacagamcccacccccgccctgcgccascttcgtccccgcagaggaccccccgacaccagcatggactgctgcaccgagaacgcctgctccaagccggacgacgacattctagacatcccgctggacgatcccggcgccaacgcggcmgccgccaaaatccaggcgagttttcggggccacatggcgcggaagaagataaagarcggagagcrcggccggaagggcccgggccctggggggcctggcggastggggtggcccggggargcgcgggcrgcggcccagcggagactaggccagaagaactgagcattttcaaagttcccgag

SEQ ID NO: 2383 - DNA, 489 bp, Homo sapiens
  CDS 76..261
aacaatgatgatgatgaaatgagttggtttgtgaaatattaccatacttataacagtcagaggtattgaaaaggtatgcctggaaaacattgttcctcatcatcccttctaccaaatatttattctattctcatcatttcctgtaggtgtggatcttcaggaggttgcctctccctggctgcagaattatcatttttagagaagcagtgtgataatcgtggaaccatcccctacattccttcacccaggaaggaagcaatatgagctgtgtgcactgtacactatagcaatggagaatctgatttgacaagccaaagatcctacattggttgcacacatcatggatagcctasgaacttccctttaaagaaagctacgtagaagcaggatgagtaaaaatttacaaaactgaaacaggaacattttcaagatggcaagacatgaacactggcaagatgctaagtgttaagagggaacacatttggaaaa

SEQ ID NO: 2384 - DNA, 660 bp, Homo sapiens
  CDS 339..569
agaatctgacattccaggactccactaggcctgttttcctctgtgggaactagagccaaggcgagagacccgtgccagccccgaggctcccggggcccatgggccagggcggggctggtacagggccccggggctctctcagcccatctgtcacccctcccccccaacacccagatgtcccgtcttggcagtgctgtcccggactgccacattaatgctccagaacccgccagctgggccctggggcggtggggctcctgcagagccctggacaaaggcgagggagggagggaaggggatcctaagcacccctccctccctggccctaggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaawggttctgtaacaataaaaaaaaa

SEQ ID NO: 2385 - DNA, 491 bp, Homo sapiens
  CDS 190..369
aatccttaaagcatttacctaggtaaagctgtttcagcagttaataaatcagatattcagttttttaaaaagttatgatctttctcactgccagcctgatttcctttagatttaggcttatgttgtacttgtgcctgtgaacaagttcattcaatctagtggaaggaatcactgttttagacacaatggatgttcaaaaatggaattggacacagatacggaatttacagtttagcagggaagagaagatgcgtacctaaagaactagcacaagatcggccaggcgcggtggctcacgcctgtaattccagcactttgggaggccaaggtgggcggatcacgaggtcaggagatccagaccatcctggctaacacggtgaagccccgtctctgctaaaaatgcaaaagattggccaggcgtgctggcgggcgcctgtggtcccggctacttgggaggctgaggggggagagtggcttgagcctgggaggcg

SEQ ID NO: 2386 - DNA, 459 bp, Homo sapiens
  CDS 49..210
gagagcaccagctgcgttagtggaagggggatataagcttgccccaagatggccaggataagcattcgggtttctcagacgatgggcgaggtcagaaaattcccaagagtttatgtcttctgtgttcagaaaaactcaactaagtattatcagggcttaggacaaccctatgacaatggtcgacttgctcaccagcagtcacaaggcatctaaataagccttcctctttgggagaagacaagtattcatcaaggatccttatcaacactgaggggtgcagagacttcacatcattatcataacaatacaacctgaaaagtgtgatggatctagcggagtgactgtgggcacattgattcctggatatggaaacagtttaactttaatcttgagtaaatgaatgaggagaaatggagaaaagacttttggttttccagtaagattttggtgacttatttt

SEQ ID NO: 2387 - DNA, 517 bp, Homo sapiens
  CDS 64..336
aaggccgaggcggcacggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcacatggcccacagtgtgccctccccagctttccacagtcctcaccctccttccgaggtcactgcatccattgtgaaaactaactcacatgaacycggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgcatcagg

SEQ ID NO: 2388 - DNA, 516 bp, Homo sapiens
  CDS 78..308
gagaccctttggtgttctacctagaggcatggctggcagacgagctctttggcccagaccgagccataattccagaaatggagtggacgagccaggccctgctgacagtggacatagtggactcagggaacctagccgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatcttaactttctaacttttgctgctaaagttgaagaaaagcaagtatagcattcttaaatccccgtattcctttttcctgtgtcttgatggattgtggtttattttgttgcaagagtgagtttgaactattctaataaagaaggctattttgccaaaagcatttaaagatcttcacacac

SEQ ID NO: 2389 - DNA, 499 bp, Homo sapiens
  CDS 211..369
aatggactagtattttctgctgccagaacacttggaagaatggtccaatgacctaggaaactatttggagtttgaggattttgtgtcatttcccaaatgttgttacgtatgaatctgtttcttttgcgtgccctggatttttaagagggaagaatatatgttgtacacaatatactggcaggatacagacatgctggtggcttcttactgatgagacagttcgtcagagcatctgcaggagagtgtamtaaccaggaagctctgcttctggactccttctactggactcagcttcacaaaagcctaaaaggtcaaatcaacctttacaggggatggaaggacgagttcttgcccgacactctgagaccctgaatggatccttctgtggctgattcaactcaaatctgagtgatgttggatcaagcgcmgcctccttgtcaccatgaagtaataagcttgataaggcactcactgaggatgactaagaagaaattcaaga

SEQ ID NO: 2390 - DNA, 523 bp, Homo sapiens
  CDS 33..368
aaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagccccaaactggataccacccacatgtccatcatcagtagaatggataaataaattgtttgtgtatgcatgcaatggggactacactgcaacgaaaatgaatgaactgctgctacaggcaacctggatgaatctcacaaacatgatgttgagcgaaaggagccagacataaaaagaatgcagactctcttcacagaggtcctccaggatcaaggggaccactggattccaccactgctgagtctccccacctcctccttgggggtagaggcccaattcggagagggcttggcccaggtctagcccatatggtcgtggttggtg

SEQ ID NO: 2391 - DNA, 458 bp, Homo sapiens
  CDS 78..329
atcgatggcgtcaccttctggcgccgccggttggtttccctggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagaaaatataactgagtatgcttcctttctacctttcttttttcttttttaaagatatatcaccaatagctttaatgtttaactcaaagacatatagaagtatagatataaacaaatgacactaacaatagaatcagtcaacatttacttattgtatataataagaaggtgttagatc

SEQ ID NO: 2392 - DNA, 856 bp, Homo sapiens
  CDS 159..533
  misc_feature 347: n=a, g, c or t
attttgtgtatgagtaaaccaaggcatggcaagcacaagtgaattggcccagtaacttggatccacttacagaaacttatgggattcctttctacctacaatacctcgcccactggccagagtatttcattgttgcagaggcacctggtggagaattaatgggttatattatgggtaaagcagaaggctcrgtagctagggavgaatggcacbggcacgtcacagctctgtctgttgccccagaatttcgacgccttggtttggctgctaaacttatggagttactagaggagatttcagaaagaaagggtggattttttgtggatctctttgtaagagtatctaancaagttgcagttaacatgtacaagcagttgggctacagtgtatataggacggtcatagagtactattcggycagcaacggggagcctgatgaggacgcttatgatatgaggaaagcactttccagggatactgagaagaaatccatcataccattacctcgtcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtg

SEQ ID NO: 2393 - DNA, 457 bp, Homo sapiens
  CDS 23..202
cttttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaacttggtggaggggtggtgaccatcgaaaggagcaagagcaagatcaccgtgacatccgaggtgcstttctccaaaaggtatttgaaatatctcaccaaaaaatatttgaagaagaataatctacgtgactggttgsgcgtagttgctaacagcaaagagagttyacgaattacgttacttccagattaaccaggacgaagaagaggaggaagacgaggattaaatttcatttatctggaaaattttgtatgagttcttgaataaacttggg

SEQ ID NO: 2394 - DNA, 468 bp, Homo sapiens
  CDS 170..328
  misc_feature 369,463: n=a, g, c or t
taaaaaaaacacaaggaaggctgagaaattaggtttcttcatgaatccaggaaaaaagaaatagaatcatcttctccacagggacccatcctgttgttcagcaggcaaattgacagagagcagtgttgcgtgctgggcaggggctggagatcaagacctacccattgtgatgaataaatccaggctctcagcaatgcagggagaaaaagttttgtctatcaacactgcagcaaccagtctcttagcacaggcaccagccctggagttcatgtcctcatcaaaggatggaaagaagcaaagctcaaatcagcttgggaaggaccttacctagtgctcctgaccactgtaaccatcatccagacagcagwnaaaggatggactcattatacccgagtcaaagtgttgccacctccacagtcatgggccattgttccaggggaaagccctaccaaattaaagctangaaaa

SEQ ID NO: 2395 - DNA, 475 bp, Homo sapiens
  CDS 160..453
ccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaamtcagtcattctcctttatatctaattctttaaagatattatcttcttttca

SEQ ID NO: 2396 - DNA, 497 bp, Homo sapiens
  CDS 101..274
agagagcctcggctaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgakagagttgacttcaattttgaaataagttccactggctgggtgtggtggctcacacctgcaatcccagtactttaggaggccgagactggtagatcatttgaggtcaggagttcaagaccagccttgccaacatggtgaaacccacctctaccaaattagccaggtgtggtgcacacctgtastcccagctacttgggaagctgaggcaggagaatctcttgaaccagggaggaggaggttgcagt

SEQ ID NO: 2397 - DNA, 584 bp, Homo sapiens
  CDS 267..482
cactcaggaagcgggcacctccccaatggagctccagagaagggattcgctcactccaccgcgggaggaggaaagggagctacctagcagcaagggttgtgtagaggacctgtggacttgacagcctcttaaacaaactaacacggaaggagtaccatagagaccataacaaacaaggcggggggaaagcaaccctcagaggaaaaagaaaccacacgattccaaaagatacacggggcacttgagctcagccttgagagcctctgatgactgtcctggagaggttctcaaccacaatcttcgcagccggtggaggcaggtggtggtcccaatctactaccaaccccaagtcttcaaagtccatcctattcaaaagtgaccttacgagctccagcaccatgttggttcgagtctcctgcttgagggtccaacggctcacagtcgtgttcatcgatataggacgccatggctgcccagccgtctgacatgtgatgttttgatacaggtatacaatgtgtaactatcaaatccgagtaactggggtattgatcatcttgagaatttatcatttctttgtgttagga

SEQ ID NO: 2398 - DNA, 479 bp, Homo sapiens
  CDS 80..274
  misc_feature 260,327,337,434: n=a, g, c or t
agtgtatagaactggaataaaagttagttgcccttgcaggctctgagtcaggctgtcaascgtagaccagctatgggccatgtcctgcccaggcattccaggcaggaggaacagtttgagcaaactccaaaagggaagaggtggccaggcccttttgaagaactgctggcagttcagtgagactggaatttattcatgtggacagaggatgtggaggttaagaagttccaagatctgcagatggcaagctggagacccangagatttgatggtgtaattccagtccaagtccaaaggcctgagaactaggagagctgttggtgcaanttccggtcanaaagccatcaggttcaggatcaaggaagagctgatgtttcagttcaaatccaaaaaacataaaacaatggatgtcccagctcacagcagtcatgcangaggagttctctctattcatgggacgatgtatcagtcatctagaa

SEQ ID NO: 2399 - DNA, 559 bp, Homo sapiens
  CDS 96..443
  misc_feature 490: n=a, g, c or t
aaggtgcgtccgagccatggccgctgcaacccgtgggacccggcgtccgcgcctaacggcgtgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctgggagttggctgtgactttcattgagagattagaaacccaccttgaaacaattagaaatattcctcaantttagctgcaaatctaaagaaatgaaccaggctttacaaagatggatatattggtgactgagacagaag

SEQ ID NO: 2400 - DNA, 459 bp, Homo sapiens
  CDS 224..418
atttgaatgtgtgttgctccttgtggcaggtatactgttccaatgccctgggatctctgtagtggtcggtactgttgattataaatggtgaagtcctagtatcttgctagagtgagctggccaggatggtggagctctaccaccatttcacaggttatagacagggggcaccaggtttcaggaaagcagcaatgacccctcagtaatagttggaaagtgtgatatgacactgagcttcactgtgttggtgaagaagagctgcagtttgcctccacctctgaagaagcacaatacacctttctgggttacaatgggatacttcccaacagctttgtcatcacatacaatattctcaaacaagatcttaatggcatctactttctccaggaacacagcccctgacctgtgcgtgtttgcgtagagaaggcatgctatgtaccccctaggatatgaatctgc

SEQ ID NO: 2401 - DNA, 487 bp, Homo sapiens
  CDS 296..466
tgggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaatactggtatctgttctgtggggaacacggtggagatcctagaaggcaaggatgccgggaagcagggcaaagtggttcaagttatccggcagcgaaactgggtggtcgtgggagggctgaacacacattaccgctacattggcaagaccatggattaccggggaacatgatccctagtgaagcccctt

SEQ ID NO: 2402 - DNA, 306 bp, Homo sapiens
  CDS 38..202
tccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttt

SEQ ID NO: 2403 - DNA, 468 bp, Homo sapiens
  CDS 263..415
aagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttata

SEQ ID NO: 2404 - DNA, 341 bp, Homo sapiens
  CDS 102..305
  misc_feature 243: n=a, g, c or t
taacctatgcatatgcaattttaaacacaacttgcagacttcgtgtactcgcttcctgaggctgccataacaaaggactacaaactgggtggcttaagacaatgggaatgttctctcacagtgccagagagagaccagagtctggaatcaaggtgtcctcagrgctgtgggggagaatccagcctctcccaggaattccttggcttgtggcacatcactccactgtgcttccatcttcacgtngccatctttccgttctgtgtccaaatctccctctttttgtaaggacacaagtcctgtttgattaggtcccaccctaatgatctcatgttaacttgatt

SEQ ID NO: 2405 - DNA, 467 bp, Homo sapiens
  CDS 65..337
atggacgctccagtcctcttctggggacttacgggccactttgttatgatgagtcctgggccctatggagccattgttgaggatttccagcagcacccagtctgcatcaacaacttctggaagcagagagtccctgaaccttggagcaaggagagatattctggcaggcaccaggcgattgttcagcaggcacccggggacaaggatcttaggtggtgctggggagcgggagaaggtgccggccaaccccgaggcgctcctgctcatggccagctcccagcgtkacatkgaggactgggtgcaggccatccgccgagtcatctgggccccgctggcgtaggtactgcccgtagatcgcatgcccaccctctagaacccttgcctccaggtaatcatgccccctgcctgtcctgagccccaaagatcctgctcactgakgacttgctggctgcatcctgtgctgctca

SEQ ID NO: 2406 - DNA, 358 bp, Homo sapiens
  CDS 112..339
  misc_feature 271: n=a, g, c or t
actttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcaganccccagacagcactgsctcttcctccccaccccactgcccccaccttaatgtgaatttgactgatgaatgaagagcgtttctaataa

SEQ ID NO: 2407 - DNA, 496 bp, Homo sapiens
  CDS 77..241
agaaagctacatctctgcctctatacccacttttcctggagcatagcccctcctttcccatgcgacacccccactaatgaattcccagagtaccctgtattttaacatctacaaggacaaggaaggcaggattgatggccctgcagtcacgtcctgggctgacactggcagtggaagagaaactgaagtcgagttaccaggaaagatacaaaagaggaagcgagtgggcaacgtctcagcatagaaaggagtaagcttgtgtttgatcttttgtccaaagaacattcctaattctcacaaacgggatggccgaacccaaaacattgcggcascagtccttccctccccgccccatccctggctgggccaaattcttctgagctgggtgtccatgaagttctttagaggaaactacaagtttgttatttttttccttcagttgtgattttgaggcgagtctcttttatttataaaattgagaagaaaagaataatgc

SEQ ID NO: 2408 - DNA, 374 bp, Homo sapiens
  CDS 59..268
ataggggcgggaacagccagcgggcgtcccatcggcttttgggtctgttacccaaagaatgataaagggttttatttcaagaagtcgatcaaaaagaaagccccagcgctctagagctcagctgacgggaaagggggtgcgcacctcgagtttgagagctacccggagctccaagacaggggccggaccatgggaaccccaaagccacggatcctgccctggctggtgtcgcagctggacctggggcaactggagggcgtggcctgggtgaacaagagccgcacgcgcttccgcatcccttggaagcacggsctacggcaggatgcacagcaggaggatttcggaatcttccaggcctgggccgaggccactgg

SEQ ID NO: 2409 - DNA, 516 bp, Homo sapiens
  CDS 81..269
agctggaagcgcgcatgctgtaggctaatgccgtagtccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaataagaataggaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgar

SEQ ID NO: 2410 - DNA, 468 bp, Homo sapiens
  CDS 199..399
acttagaagtgggtccgccagcaaatatgcaagattgatttttggaagcgatgctggaaactgtggctggcgaagggaagctccacgttatgacatcttcacagatgcagtcaactgttttctttaaatgtcattggccacctaggagaggtaggccctaagtcttgtggccccaacccaccctgctgagaggttggtatgtggctcctgttttgggaaagaggaggtaggcggttacgtgactcccccacttcctccagctctcttggcaaggctattggcagattggagcttgccccgctctggactcagaagttctcatttgctacattaggctgcttcatctggctccaatgggaggattcttggaaagttctaaactgggttacagccgcattttaggctgccattaattgattgttcagagctaaaattagaaaaaatacattataacgactttaaaaaaaa

SEQ ID NO: 2411 - DNA, 857 bp, Homo sapiens
  CDS 44..238
cctcttttccgtggcgcctcggaggcgttcagctgcgttcaagatgaagctgaacatctccttcccagccactggctgccagaaactcattgaagtggacgatgaacgcaaacttcgtactttctatgwcgaagcgtatggccacagwagbtrgctgrctgacgctctgggtgaagaatggraagggttatgtggtccgaatcaakggkkttggramcgvcaaamcaaggtttccccatgarrmcggggtgtcttgacccatggccgtgtccgcctgctactgagtaaggggcattcctgttacagaccaaggagaactggagaaagaaagagaaaatcagttcgtggttgcattgtggatgcaaaatctgagcgttctcaacttggttattgtmaaaaaaaggagagaaggatattcctggactgactgatactamcagtgccttcgccgcctgggcccccaaaagagctagcagaatccgcaaacttttcaatctctctaaagaagatgatgtccgccagtatgttgtaagaaagcccttaaataaagaaggtaargaasctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaaggagaagcccagggracaaattgcgaagagacgcagactttcctctctgcgagcttctacttctaagtctgaatccagtcagaaataagattttttgagtaacaaataaataagatcagactctaaaaaaaaaaaaa

SEQ ID NO: 2412 - DNA, 506 bp, Homo sapiens
  CDS 192..437
aatggatgtggaaaagacagttaacttcccaaagaaaaaaatctccgttacaaagctgcagtaacctctcaaaacatctcacaaatcagatccaggcatgagaataggtgaagaatcaccacatagccatcatttctggaaaactcattcaaagtggaacagaaacagtggttttgtgctcaaaccaaggcatgtttacatccagaaccaatgctaaggaaacagccacactgctgtctgagaggggtgcacacccagaaatgcattggtttacaggcaatcagtggtgtcaccacagaccaaccccttattgtgatgatctgctttccctgggacccgccggccccagacagaagaccccacccggccacattctcatgaaagcttctttcctaacacaggattgcacaagtgattcattgtgcctgattagctggtagtttgctcactgttcacctgcaactgctgctccatcttccctgttgcttgtccaaagacaccagcta

SEQ ID NO: 2413 - DNA, 512 bp, Homo sapiens
  CDS 123..302
  misc_feature 146: n=a, g, c or t
acatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaagncttgctcttctttctggaatgtccatgcacttgggttttaaacagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaat

SEQ ID NO: 2414 - DNA, 548 bp, Homo sapiens
  CDS 95..376
ctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcascaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctmccccaaccctcagcmgttcctccacctctcagccatatctttcagccccccccctcccctggatc

SEQ ID NO: 2415 - DNA, 268 bp, Homo sapiens
  CDS 34..201
ctcagcatctggagtagctgggattacaggcacatgccaccacgtctggataatttttgtatttttagtagagacggggtttcaccatgctggtcaagctggtctccaactcctgacctcaagtcatctgcccgtgtcggtctccggaagtgctgggattacaggcctgagccaccacactccacccctaatcaccccttctaataaagacacagctcatgtaggatgagagctaaaaaaaaaaaaaaaaaaaaaaaaaaaaaaaaaa

SEQ ID NO: 2416 - DNA, 490 bp, Homo sapiens
  CDS 182..487
atttcagcktttgggtgaagacggaggcggttctggacagacgtacgctgtcagggagtgtttacttcgcctccacttctgttcctccccgccctggtgctgctccgggtcacatactcgtcctgagccggcttcagcctctcygcgcagaagtstcccggagccatggccgagtaatcttatgygaagtctaccaagcttgtgctcaagggaaccaagacgaagaggtgggtcctgcacctccggcgggagctcctcagttcttttcggacgcactccacccccctcgaatccggtggaagccgtgrygcggagagcggcttygtggcctcccaggcttygcyykgmccctgtycygggctggaykgaggccggaccgcssttcctggcgcctgtgcagagaggggcagcctcccgcactgacgaccctggaaacaggatagacgggcgggtgaccgtggccccgtacccacgagtttcggtcctctga

SEQ ID NO: 2417 - DNA, 930 bp, Homo sapiens
  CDS 388..687
  misc_feature 609: n=a, g, c or t
attagcacctggcactaggcggagagaggcggtaagcgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggccmtttaagcagggattcggggtggacgtgggggtgggccgaagcgaaccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccagstcaagagttggcgttgcctcccctatttggtggccacatcctggagagcgagctggagacggaagtggagtttgtgtcaggtggtctgggcggctcagggctccgggagcgagatgatgaggaagaggcagcccggggtcggcggcggcgccancgggaattaaatcgcagaaagtaccaggcactaggtcggcgctgccggggagatcgagcaggtgaacgagcggggtcctgaacaggctccatcaggtgcagaggataactcggaaggctgcagcaggaacggaggttcctcatgggagtgctggactcctacggggatgactaccgggccagccagttcaccattgtgctggaggcaatgcggagaatgagcctccagagaaagagacactgtccccgcccagaaggactcctgcacccccagaacccggcagcccagcccccggtgagggcccagtgggcggaagaggcg

SEQ ID NO: 2418 - DNA, 489 bp, Homo sapiens
  CDS 105..296
aattgttcaaatctgctggaaggaaaattcctccccttgaacgttgtcctagatcatctctagtgcttgggttgagacctttctgaaccaggtgacagagggtaatggagaaaggttttcccaagagaaactctgggaagccattgacgagcagaaagcgcgcggagtggcaggggtcattaccgtcgttactggcagtaatgatgcggctggttccacgtgatgagagcttcctgctttccagtatgtgcagcaaaactcagattaagattttggtgctggtgtccactgaattttaaaagccatcaaaattcccaaggccgggtgcaacttttcaagtgtggctctaacctgcatctatctaagcaccagtcaagcccgttgcatccacagctcaacttcaggccttggggagcatttttctaatagattttgaggtcccactgtgccttcaccaggacatactgttccactcctgcgtgccacccc

SEQ ID NO: 2419 - DNA, 505 bp, Homo sapiens
  CDS 49..321
tttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcactacatgggccataccggagctgtgtggtgtgtggacgctgactgggacaccaagcatgtcctcactggctcagctgacaacagctgtcgtctctgggactgtgaaacrtcttgggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaaactcagctgccctctcccccaactatgaccatgtggt

SEQ ID NO: 2420 - DNA, 531 bp, Homo sapiens
  CDS 98..253
gttagtctccggcgagttgttgcctgggctggacgtggttttgtctgctgcgcccgctcttcgcgctctcgtttcattttctgcagcgcgccasaggatggcccacaagcagatctactactcggacaagtacttcgacgaacactacgagtaccgttgcttctatggtcctagattcctgctcwggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggcatgttatgttacccagagaactttccaaacaagtacctaaaactcatctgatgtctgaagaggagtggaggagacttggtgtccaacagagtctaggctgggttcattacatgattcatgagccaggtaagctatgctatgttatagtaa

SEQ ID NO: 2421 - DNA, 476 bp, Homo sapiens
  CDS 162..317
ccacgcaattaccctcccctaaacaggacaactgttgaactctgctggattgctaatcagtctattaccttctgcagagaaaggcaatatgaactccaggccacaagataagatatacaagcactcattctctctcaccctgtgaagagttatcttccaacatgatcttgagtttcctgaggcctccccagccatgcagaactgtaacaacgcctttactacagaacattccatgtgatcatgcaggtgacagtattcttaaagctatatgccccatcaacagaacctgggatcaagccctgaggaacttcaatatttagaatctggatgagagcaggtagtgcaagaaactgaaagtcgttcaaagagatacagtgaaaccaggagaatattgtttcacataatccaaaagaacttgattcattgaggaggagagagaagtcacctgaatccagttctgctgataaatcgragat

SEQ ID NO: 2422 - DNA, 360 bp, Homo sapiens
  CDS 93..293
  misc_feature 311: n=a, g, c or t
acataacctaggaaaaaccaggccatacagagataggagccgaggggacatagtgcgaagtggccagaagacaagagtgtgagccttctcttatgcccggacagggccaccagagggcttggtctagcagtaacaccagtgtctgggaagatgcctgttgcaaagtggaccatggtctaccagtagcatcagtgtcaaggaaaaacacccactacttagcagactgggaaaaggagcctssctttccccgggggagtttagagaagactactcctcsacctcttgtggaggcctgacatcagtcaggcgcnccgcagttatccagaggcctgtctccctgtgatgctgttcttcagtgct

SEQ ID NO: 2423 - DNA, 501 bp, Homo sapiens
  CDS 251..487
attctatgttctagtctccctgctagaaacaggatgtccttcatgccttatcccagagtctcctgggaccctggcatataagacccaggattgctgctttctagaatcctccagggtcagtgcaagtgggacacatgcagataaaattccgtctaacccaagcagcttttctgagcctcagggaaccagctcacagtgaatcccaagtttctgttactccttgccgcccatctataaactgacttcatggatgtttggatgtgtgtgcggatgttctgactcattrgactcggacaagaccctgttctgcaggtctgctggagtttgcaggaggtccactccagaccctgtttgcctggatatcaccagtggaggtagcataacagcaaagattgctgcctgcttcttcctctggaagcttcgtcccagaaggacacctgccagatgtcagctggagctctcctgtatgagactcttcaccaggcagtagatttcatgtcc

SEQ ID NO: 2424 - DNA, 347 bp, Homo sapiens
  CDS 19..321
  misc_feature 335: n=a, g, c or t
taacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaaaggggacggagaatgactcaggcagggcccagggtggggtgaggaggttcctgctctggcagtctaggcggaagggagtggagatggggctggttcctgctgcagtgaggggaacagatgggacaataaagactggagactcagttgaataatacaaaactgntttaatacaaaa

SEQ ID NO: 2425 - DNA, 488 bp, Homo sapiens
  CDS 96..251
atacaagatagtgggctaggcaccaggaatacaacaggaaacacactagacatggctctgcctcacggggcttttctaataccacagttcagtagatgatgatatccttactggaccagacacacaaccaacttcatttactccagaattgggctccacagttgcagctgtcctgggaagcacataggctcagattccataccctgagtggtaaggtcttgagcattttggctcttaatcactcactgaagtagaaagaatccacctccttgcccaagcactgagtccctggtgtcaagaccgagtgaccaactgagaatgcacttgcccttcagatctctgacacctgcttatcccaaagaaacatccctgaaaatcctgttaccaataccttccctggataacctccagaatctcttatacacccacagaaacttcctctgttttttttctccaagcctttctgggagtcctattggagcccttac

SEQ ID NO: 2426 - DNA, 506 bp, Homo sapiens
  CDS 300..485
atagcatgatttataatcctttgggtatatacccagtaatgggatggctgggtcaaatggtatttctagtcctagatccctgaggaatcgccacactgttttccacaatgtaaaacgactgtttatacaagaatggtctgtaagccatctgtatcagacatgtagtatgtgtcataaattacaggttgaggagccataccctaagtctacaaggacaaagacagactggataaagaaaatgttgtacatatacaccatgtagccattaaaaggaatgagatcatgccctttgcagggacatggatggagctggaagacattatcctcagcaaactaatgaaggaacagaaaaccaaacactacatattctcacttataagtgggagctgagtgacgagaacacatggacacatgggagggaacaacacacagtagaggctgtcagaggaaggtgtggcaggcgagagagcatcaggaagaatagctaatggatgccaggcttaata

SEQ ID NO: 2427 - DNA, 516 bp, Homo sapiens
  CDS 38..463
gatttggcacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtat

SEQ ID NO: 2428 - DNA, 484 bp, Homo sapiens
  CDS 17..442
gaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagca

SEQ ID NO: 2429 - DNA, 505 bp, Homo sapiens
  CDS 16..441
aagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtgaaaaaaaawmaammaaaaagct

SEQ ID NO: 2430 - DNA, 510 bp, Homo sapiens
  CDS 66..263
gtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagaggtaagcggtgttcacatttgacgccttgtaactacctggcttacttatgatgcatgtaactagctaacttaactagtagatgtgaagtacatttttaatttcagtttgataatatattgcattttaattctttggcagaacctcctcctttatttgtaaattagaaaaggattatatctgcttataacaaaaattcagataaaaacttagtccctgctccttgccatcaaatatttgtacacagagag

SEQ ID NO: 2431 - DNA, 542 bp, Homo sapiens
  CDS 143..373
gtagagcatatgatctttactgatgcacctgcatctggctcagacttagtcacccagccctgaaattatatcatatcacaggtcattctctgagtctcttaatgtgaggccttgagagaaaaatcaacatgccttctgttggatgaagaccaatcagcaagatggtggtgattgtgagtcgttgcaaggatcaagtgagttgaaatccgtaaggtgcttgggagaatgcctggcgcctggaagcactgtatattccaaaaaaggagatataaacatgaccataaaagacatgaaaagatgtttaaccccattagtcatcgtggaaatgcaaatgaaaaccaccatacagacactagagtggtttaaatttgaatgacttccaacaccaaatgccagacaggacatagagcaactggatgtctcatgctcacaggcagaagggaaaactactgtgtgtgacaggaagatggacttacccaaccttcagcattctcaatctcttgtctattaacatgtgtttgaaacattatgcattcaaagca

SEQ ID NO: 2432 - DNA, 490 bp, Homo sapiens
  CDS 66..446
gagacagctacagtgatccaactaaaccaacaggggattttcatcagcacttccctggtgtaatcatggtacagattattaaagacacgaatgaatttaaaacatttttgacagctgccggacacaaactcgcrgtggttcaattttcttcgaaacggtgtggtccctgcaaaaggatgtttcctgttttccatgctatgtctgtgaaataccaaaatgtattttttgctaatgtggatgtgaacaattctccggagctggctgaaacttgtcacatcaaaacaatacccacatttcagatgttcaagaaaagccagaaggtaaccctattctcaagaatcaaaagaataatttgctgttatagaagtggattcatgagcaacctgatttttgagttttgtggagccgatgctaaaaaattgraagccaagactcaagaattaatgtaagctgatctccaaggcaaaatacacttgtgacatttgaaaag

SEQ ID NO: 2433 - DNA, 537 bp, Homo sapiens
  CDS 190..465
  misc_feature 453..454,457..460: n=a, g, c or t
gccgactagattttaactttgcgaaaagggcgtgaacattgaatctgttcgcccaccgcattgtccactaggtgtaggggagcttgagcgcaggagccgggtcttgtttgcctcattctcccctagaggtcttgacttgtatctcagatgtgggccggcgctcagtaaaggaggccgctgctcgcggagatggaagacgccgcagaagtggcctcagcgttagttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaagagactgccccggccgtgcagcggtcgtgannrdnnnntcaagtaagtttcaaacgtcctccccaaaagtggcacatgcagaagatgcagcgtcasagcagcagcagcagcagca

SEQ ID NO: 2434 - DNA, 458 bp, Homo sapiens
  CDS 52..360
acacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatccaggcctggtggcggggcacctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggcccgc

SEQ ID NO: 2435 - DNA, 557 bp, Homo sapiens
  CDS 341..490
ataccgattctggggccccagcgggaggcgccattttgtagcgagggagggaggctggtccttgtgattacccgggagggagccggggtgacgagcgccattttccccacaggggcgaggaggcggctttggttctcccggtgggcttgccggagtgcgttctgcagaccagaagggctttgtctggcgattgctgaatgctcaatagcagcctgctgggagggaagtcgaagggagaaataggacagaaagagagacctgacctctccctggaggctctcagttgtcggccgaggcccttggtcttgctctagggctctgcattcccgagagctgctgtatgccggggattggcttccaagcctgcctgagcttctccagtctcccgggcatcgccatgcggtgggagggtgagccttcctctcctgctgaaattcccggcggcttggcaaccggccggggggtcttggattcctcggggagacaccactgatgctttgtrgtttcacgtaatttggatttaaaagttgaaggcgtcaraaatggttgtcgctacg

SEQ ID NO: 2436 - DNA, 493 bp, Homo sapiens
  CDS 35..454
acgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacagtgtgctgagtgagctgtgctgccagccatcgcagaggagcccgcgcac

SEQ ID NO: 2437 - DNA, 363 bp, Homo sapiens
  CDS 42..308
cattctagagacagccccatttccagctcacttcgtaggcgatgctcgagagaacaacatgttctcctgctgtatcccgacatgctgccgacctcctcgtcgcacaagaggccaaaatgagagtctttcccgagaatatagacattggttcaaccctcaccctcgacgcctctggscctttgccagaaggcacccacagagctccacacaacagaccaaacaagagctgttggatggattcaatttctccatattcttcaaagggcacgtgcaccacaccaccaaccacgtccagtgccggtctgcggtgagattgggcacagaagggtctccacagacaggacttgtgaaaaccaaggtggg

SEQ ID NO: 2438 - DNA, 433 bp, Homo sapiens
  CDS 174..377
aaaatgccctggagtgtgtgtcacctgtccaggacgacttgttgattcccaggagggccgcctttccggtctgggtccccgagaggactgccttgctcacctgtcccctcggcgcggccccggggagctcccgagaggcccccgggatcgctggccctccgaactccacagcaatgagcaagttgggcaagttctttaaagggggcggctcttctaagagcgagccgctcccagtccccaggaggccctggtccgacttcggtagactgaggagatgctgggcaagaaacaagagtacctggaaaatcgaatccagagagaaatcgccctggccaagaagcacggcacgcagaataagcgagctgcattacaggcactaaagagaaagaagaggttcgagaacagctcactcagattgatgggacactttcta

SEQ ID NO: 2439 - DNA, 581 bp, Homo sapiens
  CDS 146..310
atttttaaaaggaaatgaagtttatccagattaattttttaaagactgaagttgaaagaaagagcaaaatgatccgagacctccagaatgaggtgatacaaatttaattctattgctcttatgatgaaaatacaactgcagtgaaatgataactttttggagtctccatagatcatacaaagagagaacagagaaacaaggcaacaaattgggatacgctgcaacactctgcactgaacatctgacttcaattagccaaccctcaatttccaatacaaaaatcacaaaaggattactaagggagaatttataatggaaaagagattcagcctatatttatcctgatgtggctgtgaactggaccatctgctataggaaggagcacctgaagacttgttggctgaagttctctgtctggcctcgaaagacattcaaattagccaccactggagtagatgacctaaaagttcttacaactctcaattatacccagtgatgtctcgattagcacttattataaaaattaaaatttataattcaaaatttataccatccagaaaaagttaaaatatattaatagc

SEQ ID NO: 2440 - DNA, 522 bp, Homo sapiens
  CDS 168..428
actctagcttcgtgccaccccgtggcmwtgcgcttttcggtagccgcgctttccggcgttggagttgcagcttcaccctcgcagactcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcgatgcgtggcactaggctgggtgtggtgggtgctgccgaaaaaagggttcctcccatccatttgcacgtcacccttcccacctcctgcccagatggacagaagtgaggacattcatcggccgcattttactaatggcaaggagatagcgactgaagggcaagaacctagggtttcctgtctttgatatttctcatct

SEQ ID NO: 2441 - DNA, 473 bp, Homo sapiens
  CDS 99..272
  misc_feature 436: n=a, g, c or t
tttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggaaggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatngggaagttttgtttctcctcttagcatttgtttctat

SEQ ID NO: 2442 - DNA, 444 bp, Homo sapiens
  CDS 6..215
tacaaatggataaatcagcctcccgagtacctgggattacaggcatgggccaccaccccccagctgattttgtacttttggtagagacaggttttctcaattttggtcaggctggtctcgaactcccaaccttaggtgatctgccaccctcagcctaccaaagtgctgggattatagacgggagccaccttgcctggctgactgktcakgttttatagcaaagttcctgtccacgttcccaatcaggtctgtttatagaaagaatgaagcttgcttaattcagattagtcattgcagctgagttctgattgtttgatacaagttgggccttgattggccagggtaggtaagttctgattggttggtttccaagccccaaactagaagtcgctgtcagatgtttccaactgctggtggtgggggataaacctctcagtttatctt

SEQ ID NO: 2443 - DNA, 451 bp, Homo sapiens
  CDS 155..382
ttgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcgaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacasscagccatcctggagtacctcaccgcagaggtacttgaactggcaggaaatgcatcaaaagacttaaaggtaaagcgtattacccctcgtcacttgcgtggagatgaagaattggattctctcatcaaggcta

SEQ ID NO: 2444 - DNA, 451 bp, Homo sapiens
  CDS 180..401
gaaaaaggccgctcgctcgagattacgcgcgctggagtgcaatggcgcaatctcagttcgctgcaacctccacctcccagggattgtgctgcctcagcctcccaagttgttgggattgtagacacccaccaccacgcccggctaattttttgtatttttagtagagacggggtttccccatgttggccatgccgatctccaactctggacctcaggcgggcagatcacttgaggtcgggagtttgagaccagcctggccaatgtggcgaaaccccatctttattaaaaatacaaaaaatgagctaggtgtggaggtgcgcccctgtggttctcagctactcaggagactgaggcaggagaatcacttgaacctgggacgtggaggttgcagtgagcccaaatagcaccactgaactccagcctgggtgacagagtaagactccatctcaaa

SEQ ID NO: 2445 - DNA, 504 bp, Homo sapiens
  CDS 161..328
ctagctcagttttcactttttgcccttgcaatgcacaagggttagcaattcttgatggtacagtctctctgttcgaagagctggggtggtttctacttctagctggaccctgagtgatccttcaggcaggggtctctgcgactggagacatgctgtgtgcatgaggtcccatgtacactcagattgcatcccccatccctgcccagccctgagaggcaggcgagacagtccccctctcaccatctctggggtgggcctggattattggctgaagaattacaccctctttgatggtatgcagtttaattccgtagatcaaagctatgtctagattttaaataaatgatagggatttaaaattgtatataaaacacagtcattgtatcttgctttctttgggtatgtattctttctttaattgagcaggcaaagaattttaagagaaaaatataaaatgcagctatagtattattaatctgatcttgctatttggaaagaatctag

SEQ ID NO: 2446 - DNA, 430 bp, Homo sapiens
  CDS 63..254
ttgactgtgaactcctgtgactgccagtggtgtacctgaaggaccactggcctttttacacaatggctaacagcgattttcttgtacgcaaatttgggttaagatgtatgggtattttgcggggctgtgtcggcgtctccagaaattctggcgtgtcactgttaagggcttttttgttaagaagaaggaaaaaaaaatcccttcagctgagacttattttcatgaggaaaaaattgttgtacttggccaagtgttgatgaatgaatctctacccattgagaagagagctcaagctgcccagaaaattggactgctggccttcacaggaggaccacctgctgggaactttgcagctgagtacatggaagaagtggctcacttgttgcaagatgaggagttggcaccaaaaataaaaaaaaatgcgaaaagc

SEQ ID NO: 2447 - DNA, 485 bp, Homo sapiens
  CDS 115..321
  misc_feature 371,429: n=a, g, c or t
aagagtcggttccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcngaccccaaagagaaagcatgaaagaacctttagagtagagttcaacacttaaggcaangtagacaagccaaagacctcttaaggatcaggcttgaagagaagggagagtttggg

SEQ ID NO: 2448 - DNA, 546 bp, Homo sapiens
  CDS 116..298
  misc_feature 485: n=a, g, c or t
ccctctacgcgttttggtccctgtttggtgctttctgtttgcagctacggcagtgaatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactgggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcaatctgntactgtactgttgtgatctactgattggcattggcatagtagtaggggtcaagtgacagaa

SEQ ID NO: 2449 - DNA, 517 bp, Homo sapiens
  CDS 151..423
gatttgatttatagatgctacagatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcggactatcaaaaccatgctagaatatgctgacaaagtctttacctatatattcattctggaaatgcttctcaaatgggttgcttatggatttcaaacatatttcactaatgcctggtgctggctagatttcttgatcgttgatgccagatgtcatcttcagcctttctgcctttcacccctcacaaccaatcaatcagcaagttcttctccattttattgactaataaatgagtggacagtctcgcccctcctcttcagcacatsaacaccacttgcaaatyyaactggaccaagcaatagcttactaaatg

SEQ ID NO: 2450 - DNA, 463 bp, Homo sapiens
  CDS 95..289
  misc_feature 399,401: n=a, g, c or t
attcagaaggaattgtgcttctattacacccagtgactggcgggacccatggattgaataaaatgaccattgataatgggataaatggcactacatgaatgtccccacatgtcaggaacagactcttccccagccctgcagccacagaaatgagctggtgcaaaaggaacacaatgcgacctgggcttccctgaagttccccaaatctaaaatcagtcaggtagctggaacccgactcctcttggaagaccgcttttatcatccaaaacaacattcatatatttctatctgaccacagaattttgttctcagaaagccagtcaaacctacataatctgcctactatcagcactccctatttacaagagctcagacaaggaggaggccccaagccgcasngncagtgctggggtcattatgaaaccagagtctagaattgcacctggcacatcacgggctctca

SEQ ID NO: 2451 - DNA, 349 bp, Homo sapiens
  CDS 58..222
attttcccagaatgcagtgagggtagcgaccgggctacacagaaacagggtttcaccatgttggccatgctggtcctcgaactccagaactcaagtgatccgtccgcctcggtcttccaaactgctgggattacaggcgtgasaccgcgcccagcctttggggaagttctttttaccgtccatcatccattgccaccacaccttctgcttacgagttatttataataagtttaactaaaagagaacgagagaacatcccctgaaacccaaagtttgtcattctatacagctttcctgcctgcaaaagaggaggagcagactcatccagcaaatcacctaaaaagtttga

SEQ ID NO: 2452 - DNA, 467 bp, Homo sapiens
  CDS 238..387
atttcctttcatctcccccttcttccctcttctgtgctctcaagactttccccctcttgctgccacaggtaactggctgtgtaaagagctgctgagggcttgggctgatagatagggcccatctcccctgctagactcttgttcccccaatcctgttcttagcctctcctgccctcaccaccacacaaacacaatctcttgttctgctgaagagagggatggaatagagagctgaagatgagcaaaaggagggaggagtcaggaaaaggcagctcctatatgttgaatttatttttcattagtactgagtatttaaagaagagggcacccaggctggagccctgggaagtcccatatgtggtggtctggtggagtgggttgaggaggtaatagaaggtcagaaagtaaagatagtaaatatagaccattctttcaagaagtttggctgtggggctgggcatggtggt

SEQ ID NO: 2453 - DNA, 571 bp, Homo sapiens
  CDS 276..467
atctgcggtttggagccgttagcgggagaggcagagatattcagaggtcttttaggatgygctaaagggtcgtragggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaaaaaaaaaaaaaaatg

SEQ ID NO: 2454 - DNA, 551 bp, Homo sapiens
  CDS 260..448
aggagttacggaggcagggttgtggttgctggctgttaccaggacaaccggagcgattgaccgttatctgcggtttggagccgttagcgggagaggcagagatattcagaggtcttttaggatgtgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaatgtgctaaagaacatacagacacagagcagacaggccacctttgcaaccacatggaggtttgtctaatattgaagctaaagaagctaagctggaagacagagagaccaagtcctgatgacattgtttgaacccagagatccagacatgcctgaaaactagttttaccactggacttatccgttgaatgagccaataaactctcttttatacttaaaaaaaaaaaaaaaa

SEQ ID NO: 2455 - DNA, 461 bp, Homo sapiens
  CDS 228..398
  misc_feature 30: n=a, g, c or t
ggcgccactagagaagggcgagcggcgcgncagagtgcggcgcasgcagctcctgaggttttggttatgaacaggattcggattcacgtcttgccaaccaatcggggggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtagaatgccctggcacttcatgctcaaatgaagaagaccaacccagggcctktgggtgaaaactcctgtgccagctgagctcatatgctaagacagagctggggtctcagactccagaa

SEQ ID NO: 2456 - DNA, 481 bp, Homo sapiens
  CDS 130..282
tcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaacttaaagagaaagaactaaggcttaagttatctgtagtataatcaattagaagtaatgaatggatgcatgtaaaatggatgtgatttttttttcaagcttattttga

SEQ ID NO: 2457 - DNA, 468 bp, Homo sapiens
  CDS 259..450
gttagcgggagaggcagagatattcagaggtcttttaggatgtgctaaagggtcgtaagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagatccagaca

SEQ ID NO: 2458 - DNA, 492 bp, Homo sapiens
  CDS 259..450
gttagcgggagaggcagagatattcagaggtcttttaggatgtgctaaagggtcgtaagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagatccagacatgcctgaaaactagttttaccact

SEQ ID NO: 2459 - DNA, 492 bp, Homo sapiens
  CDS 259..450
gttagcgggagaggcagagatattcagaggtcttttaggatgtgctaaagggtcgtaagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagatccagacatgcctgawaactagtttttaccac

SEQ ID NO: 2460 - DNA, 511 bp, Homo sapiens
  CDS 276..467
atctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccact

SEQ ID NO: 2461 - DNA, 675 bp, Homo sapiens
  CDS 64..552
  misc_feature 33: n=a, g, c or t
tatattgctgcagattctgaaaaagtgcaagangcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttaaaaaaaaaaaaaaaaaaaaaaaaaaaaaaaaaaaaaaaaaaaaaaaaaaaaaaaaaaagaaaaaaaaaaaaaaatgcgaa

SEQ ID NO: 2462 - DNA, 498 bp, Homo sapiens
  CDS 53..217
taaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggccagctgaggcgggtggatctcctgaggtcaggagtttgagaccagcctggccaacatggtgaaacccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaa

SEQ ID NO: 2463 - DNA, 482 bp, Homo sapiens
  CDS 288..446
aatgagtagtcataatatgagaagcccaagccacatggggagaccacatggagaactaacttgcctctgtcaatcccatatgatctccctgccaagtgccagcatcaaatgcsaaccatccgstctacagtaaggtaaataagtcatttagtcaggaactctgcacatttacctctgcatttatcaaatatttgttgaaggaaataataaaagaagtgaggaagaagaggtttcctgggagaaagcactcgaggagcaataggtgtcctctttcatttccactaaatatgctgctcaatgccttgtggcataacagaatcaaaacttttcagatgccctgccgctttaacaagacccaggatatgtcaaaatggctcccacagaactttcatttgatcttatctttcgctgtcacacacatcgacctgcattttcttttttctttttgattctttatgtctgcaaatgaactgatgtaatta

SEQ ID NO: 2464 - DNA, 499 bp, Homo sapiens
  CDS 187..336
  misc_feature 430: n=a, g, c or t
agaaattctcaaagtgaaaagttgttcctgatttgccagatcagcccatgttttgacaatctgtaataagaaagctactaaaggatgtgttccaccaaaacgacaccataaaccaagcaagtcaaaaaagaaaaagagaagacatgggattcaggttgaggaccagggcatccaacatggagaaagatgaaagtcatgatgatggctgagggggatcctatgaagacagttatcctcaacacactgagggcagctagtcctaactggaacaggtcagagtattctagaagatacttctttaagaagatggaattgatagaaccctcaatgaatgcatgaagtgttctatctgaatgcatggagagatgtaactattgacagaatttggagctaaaccagtggatgaacatctggggtggaccagtcctgntgtaatgaagaacttcatgtactagctaatttgagatttaatgtaattgtccataattgttttgaagac

SEQ ID NO: 2465 - DNA, 498 bp, Homo sapiens
  CDS 52..390
agacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccagtagagcgttggttccgtcgccgccgcaaccaggaccggcccagtctcctcaagaagttccgagaagccagctgcagattcacattttacctgattgccttcattgccg

SEQ ID NO: 2466 - DNA, 489 bp, Homo sapiens
  CDS 37..372
tccgtttccgctagactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggcctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaa

SEQ ID NO: 2467 - DNA, 511 bp, Homo sapiens
  CDS 329..484
attccattcacagactcttgttgggcagcagccacccgctcacctccatccccaggacttagagggacgcagggcgttgggaacagaggacactccaggcgctgaccctgggaggccaggaccagggccaaagtcccgtgggcaagaggagtcctcagaggtccttcattcagcggttccgggaggtctgggaagcccacggcctggctggggcagggtcaacgccgccagscgccatggtcctgtgctggctgctgcttctggtgatggctctgccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctaacagcctcaccaccaactgctgcac

SEQ ID NO: 2468 - DNA, 493 bp, Homo sapiens
  CDS 72..317
agatcttttccagcagctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcacca

SEQ ID NO: 2469 - DNA, 452 bp, Homo sapiens
  CDS 214..375
aactagatgtctctatgaatctgactactctaggtacctcagatgagtggaattatgcagtatttgtccttttgtgtgtacaactaatttgacaggcagtatgataaggaacaatctgaatgacacgtaaacaggagggggtaaattccaagcacagcctgaatgagaagtacaactcatttcctgtaacctagatgcctttttaacacatctatgcagtctccatgtgaaaccaggtgctgttcccaaaggagaaaacactgccyyccagtggtcytcaatgaagaaatggaaatrgttycaggtggaaaccaggcttcttggaagacttcaaactatgccaaatggtctgatttcaccatagagattctttgctgaagaatgcagctgtattaaaggaagaaagaaaaccaagctacagctccttataattcaacaagcatttaaaagat

SEQ ID NO: 2470 - DNA, 556 bp, Homo sapiens
  CDS 125..418
aagatctgggcagaggaaccaaagggaaaagccaccttcccaggcacagccataacatccacctcactcaactgcttgtcaagttcaccaccaacacagagggggctcagataatcaagaaacaatgtcgagtgatgataaaagtaaatcaaatgaccccaagactgagcccaagaactgcgatcccaagtgtgaacaaaagtgtgagtccaaatgccagcccagctgtttaaagaagctgctgcaacgctgtttcgaaaagtgcccatgggaaaagtgtccagcaccacccaagtgcctgccctgcccctcgcagtctccttcatcctgccctccccagccctgcaccaagccctgtcctcctaaatgcccttcatcctgcccacatgcttgcccacctccctgccctcccccagagtgaggcactgtgggcactacccaaccccaccaccactgccacctccaccatgtacaacgctgtggggctggagactgaaaccatgaactgacaagtaaacgtgttcctctgctgtgcaaaaaaaaaaaaaaatgggaa

SEQ ID NO: 2471 - DNA, 457 bp, Homo sapiens
  CDS 202..357
acaatcctcttgtaagacagaaaagttctccaagtccccaaccgacccagaagaccagctggctttacctctcacttaaacctgtactgtgtcaatatccgtacatcagtaagtgttgtcgatcaagttagggaagtagtggatttctggtgacaaatgttaccctttccaactaaagtttaaagaaggtgattttcctgcatggattgggagatactgggcacggatgggcagaagcctttgcaggtatcagaagttcacatatcaaatatatctgcccgcatgcgtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgc

SEQ ID NO: 2472 - DNA, 295 bp, Homo sapiens
  CDS 51..215
tcaattttctaagagttttgtcttcccaattcttattgatttgccagtctatgagactgtggatgaaaagagctttgaatagttcattccatgaatctaaaagaagagcaataaagatcccatttccaattgatgaggaaggcattcagtatatgcttctgaaacaactatctagcaacctagagccaaagaaagttaaatctttacctcatacttgatactaaaagtaattactgatgaattaaatataaaatataaaagcataaaataataaaaatattagtgaaattttaaa

SEQ ID NO: 2473 - DNA, 465 bp, Homo sapiens
  CDS 206..364
aacagatgtttatgaagcatctactatgtgcttcatgttgaggttctgaaaacgaagaagactgatatgtaaccccaagaaactcagtctgtggaggaaatataaagatcaacagaagacggcaatagcatacgagatgtgtaggggtttgaggcataagagtgctcgaaatgatgaaactgaatgaatcctaattgaaagatgaatgttcatatccataaagtatgatcttgggtggtcaactctcccaatttgcccaggactgtccaggtccagagatttagcactgtatccagagaggagtattcacctacttccacagcaggatgcaaatgccacccccaaaataatcgtggcttcactctgaaaacaggatgatgcagagaggagccccaacagccaagtctagcatcaaccagccaccatgcaactatctgttaagtaatgatttcattaaaaaaaaga

SEQ ID NO: 2474 - DNA, 451 bp, Homo sapiens
  CDS 133..375
acagagactgaaaataagaaaggggtgaggcctaagggacaatcaggatgtttttcagagagaagtgtggatgctggacaggaagaaccacagataccagatacggaaaaggaagaatcaacactttcagagatggagcctgttgagccacagtaccaactagtcaatgctgaatcgacttctccctttctacattgcctgagagaagtcattggggaatactctagagtcaagggattggattgtggattgcatgggtggttttcctcagtttcctcatcttctccacaagtttctacatatcgaatgcagagcagcccttcttcaaaggacctcctacgaaagctgctaaggaactcmgtctgtagctctgcgtagagccatgtgtaaacactgaactgagacctgccacctyctactacctaagggcccattttcatctgatatcatc

SEQ ID NO: 2475 - DNA, 527 bp, Homo sapiens
  CDS 146..334
agagttcgtatatgactccagtcctggcgctggatgctgctgctgttccagcttcctaggtgtggaaactgaaggaccaagagattaaacaggtgtgctgagtaaactcacaggctgagattcgaattatcctcccccgacgaggatggagccttcgctgtcttccttgatcgccacgtttctttgcgagccgatgaaggaaagcgtgagaaatgataaggccctggagactggagaacgcgagcttatcgctgtctcacatgcgcacggcttagacgttgagagctcacaggcccacttgcataaccactttcttgatagcggggttacagcttgagagcatggggctttgtgcacggccagacctaaagactactcctgggtctgctactggccattgtgacaccttaagtcatttcccctattctgagactccgtttccccgtctgtaaggtggaaagaatagtatctgtttcataggatcacagtgagtattaaatgaaataatgcaattaaagaactcagca

SEQ ID NO: 2476 - DNA, 397 bp, Homo sapiens
  CDS 149..298
aaacacttcccctcctgcaggtagcagggcgccaagcagtgacttctgaccaacagagtgtggggagaagggatgtgtattagccccggagacgtgatgtgagacccgcttgtgagtcctccacactcgttccccattggcaagatacatggagagcaccctgaggacctttaaaaggcaaagcgcaasagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaa

SEQ ID NO: 2477 - DNA, 364 bp, Homo sapiens
  CDS 28..204
tcattaaagaagaaaataaatgtttgtatgtattttgtttataattttagaagtacagttctyttaagcctgcacaataagctttttaagaaaggtatatataagtttaacttggccggcacgtggtggcaggcagatcacttgaggtcaggagttcgagaccagcttgaccaacatgctgaagccctrtctctactgaaagtataaaaattagctaggtgtggtggcacgctgtggttccagctactctggaggctgaggcagaattgcttgagcctgggaggcggaggttgcagtgagctgagatcactccaccctactgcagcctgggtgacagagcgagactctgtcgtcaaaaaaaaaa

SEQ ID NO: 2478 - DNA, 467 bp, Homo sapiens
  CDS 105..332
  misc_feature 444: n=a, g, c or t
tcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccaagtagctgggactacaggcgcctgccaccatgcccagctaatttttttttttttttttgggtatttttagtagagacggggtttcaccgtgttagccaggatggtcttgatctcctgacctcgtgatctgcctgccttggcctctcagagtgctgggattacaggcgtgasacttgtgcttagcaagctcactgttttagaaggttttattttgaagtgtttacatttttcttgncgatycctaaraggacttaaggg

SEQ ID NO: 2479 - DNA, 360 bp, Homo sapiens
  CDS 38..211
aaaaagaaattctggagctatctccgaggcagcggtgatggaaacgggagcttgcagggcacggtggtgcacgactctaatcccagcattttgggaggccaaggcaggcggatcacctgaggtcaggaatttgagaccagcctggccaacatggyaaaaccccgtctctactaaaaatacaaaattagccagggatggtggtgcgtgcctgtagtcccagctactctgaggctgaggcaggagaatagcctgaacctaggaggcggaggttgcaatgagcctagatcgcgccattgctttccagcctgggtgacaagaacgaaactctgtctcaaaaataaaataataataataccaaaa

SEQ ID NO: 2480 - DNA, 502 bp, Homo sapiens
  CDS 124..489
agtcccacccgggagccggcagggagcggastgcggascgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaaggcaaaaaacagggggtgctgtagaccggctgac

SEQ ID NO: 2481 - DNA, 537 bp, Homo sapiens
  CDS 235..516
agctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagamaaaacgaacggagcaagaacaaactattgcttctttgcaaatggaagtctgtagattaaaaaaggaggaagaagatcgcattgtcactcaaaacagagtgtttgcctatctgtgcaaaagagttcctcataccgtcttggatagacagtaattttgctacataaattga

SEQ ID NO: 2482 - DNA, 479 bp, Homo sapiens
  CDS 103..390
agataggccgccggcagatgtggcgggggagagccggggctttgctccgggtgtgggggttttggccgacagggkttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgag

SEQ ID NO: 2483 - DNA, 397 bp, Homo sapiens; identical to SEQ ID NO: 2476
  CDS 149..298

SEQ ID NO: 2484 - DNA, 514 bp, Homo sapiens
  CDS 172..489
ctcagactaacaacaatgatcatgcagccatgtcgatgaggtgttgctgtgttgcccagactggtctcaaactcctggcctcaagtcatcctcctgccttggcatcccaaaatgctggaattagaggcgtgastactgtgcctggccatttttataagcttttaagctgaaatgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcag

SEQ ID NO: 2485 - DNA, 582 bp, Homo sapiens
  CDS 271..528
accaccatttccgacccgggcaagatggcagcggcgctgcgcgtgcgttgttgagtgttcgggacgccggcctgcaggcgccatggtcttcctcaccgcgcastctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgt

SEQ ID NO: 2486 - DNA, 420 bp, Homo sapiens
  CDS 231..410
aaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggca

SEQ ID NO: 2487 - DNA, 554 bp, Homo sapiens
  CDS 204..386
cttttcttttccagccccgggwaccggaccctgcagccgcagacgatsttaatgcctaagaagaaccggattcgccatttatgaaactccttttttaaggasggaagttcatggtggccaagaaaggattgtccacatgcctaagcacccgggagctkggcagacmaagraatgtgcccaamcyttcatgtacatgaagggccatgcagtctctcaagtcccgaggctacgtgaaggaacagtttgcctggagacattttctactgrgtaccttaccaatgagggttatccagtatctccgtgattaccttcatctggccccsgraaatttgtgcctgscaaaccctacgccsgtagccggtccagagactggcaggcckgcggcctaaaaggtctggaggggtgagcgaacctgcggagactcacaagatgggaagctgacacgagatcacctacagacgggagtgcctgtgccacctgggtgccgacaagaaagcccgaggctgggggctgggtcaagcaaccggaattcccagtttagaggcggatttggt

SEQ ID NO: 2488 - DNA, 465 bp, Homo sapiens
  CDS 177..401
  misc_feature 432: n=a, g, c or t
atttatttcaccctcttgcttcccataaggsagccgggggtctccactcatccccccgacaggctcctggcagccaagaccaccaaggtttctttctcagtgacaaccagtcagatgcagcccctcccctgagcatctcagatgcatctggcctctggctgaagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctsctccagaagcccatgccccagggccacgcagctacattctggaagcccctgcctccaatgacctggccttggttcctatagcctcggagacgacgagtccagggcccangctgccccagggctttctgctcctgcacagctg

SEQ ID NO: 2489 - DNA, 410 bp, Homo sapiens
  CDS 108..266
tttggcggctcttgctctcccaaggcagaggagatcgttgggtttcaaggccccgcggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgcgctgcctgctgccccgacttgcccagctcgccccaagggcargactgaggaaagcactgcctttctgttcttaaagcgacctttgaaggcctgggcttcgcgcccggcttctttctcagccgttgtttccgttttttggtgacaagagggctagtaatctcgtcagggagccaacgtaagagttcttca

SEQ ID NO: 2490 - DNA, 493 bp, Homo sapiens
  CDS 226..387
agataactggcaacccccacctgtttaacaatgccttctgtcttcacagcaaccctatagactgaatcctgacattgagcccatcagaggtaagttggctccgagaggtgaggtgacttctccagattgtctcagttagcaagactgagactcaatcacacatcttagcgaascaaagtctgtgattttacctgctaaaaaatactgctctacttcaccaaatccatggtcaataatagactgttaccttggaagcactccgtaacaaactttggaaactctgagtttcccccttcgctgaaactcacctccaatcccaggttgcaaacaagcaaacacacctgctccacgttcctgcctgtgcagctttcaccacaagtgtggagctgaatatgtggagcagtggagtttgaaggccagtacagtggtgaamattacatggttgaaacaaagttccaaaaggtgctcaccgtctgagctttgggaaatataa

SEQ ID NO: 2491 - DNA, 461 bp, Homo sapiens
  CDS 257..406
  misc_feature 277: n=a, g, c or t
tatatgtctgagtataaacactgtgtccaagaaaatttcagatcatttctatctattcattaagcatatacttggaaaaatcatctaggagtagttttgagtcttatttgtgttgctctatgtacttgcaaataataaagcctcttttcttaaaggattttgaataagtcagcctcttcactaatttctcatcatctttcagcagttgaagtgaattggtgaggctttactccatttcagtgctgggattacaggcatgagcccctgcccccggcanatgtctccaacttgtatctttcccaaagtcaaaattgacttagtggtgaaagatatgttttccccttgtcttctaccacttcagcctgattctgtatctgattttctaccccagccagttcgggagagctaaggaggggatgcctactctattggttcacatcccgctcttttcccaatggcag

SEQ ID NO: 2492 - DNA, 533 bp, Homo sapiens
  CDS 175..405
gaccctcggctgtatctctgcgccttatcccgctcgtcgaagtgctccagctccatgtctctgccgaagacatgatggacttcaattaggacctacgagccccagaaacaaaagcagacacacatattgatagaacatacttctggcttctactagaatcacagaaactcggtgatgtcagaccttggcagaagcctatcaatttttacccagtgcatgaattccctccacaacaagtkgtcttccagcctccattctgttgcgtctgtggcaaaagtgaagaggaataagattatccctttgagtgttaggatagatcatggaattctagacacagtaaatgagatctttaaaaataattgttttaactggctgtttacctttggtttggccctccaaacatgctgaggtccaaactacatgagattctggacctacacagaggaagaaaggctcctactactctcatagaacctctataaaactagcagagagcttctgaaagctcttttcttcgtttcctgcctaaatgt

SEQ ID NO: 2493 - DNA, 895 bp, Homo sapiens
  CDS 124..498
gtgctttcgccgcctgggagccgtccggcgcasagtttctaggtccccactgtccccgccgtcccgccccttcgcgtcccgggaaccgctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggac

SEQ ID NO: 2494 - DNA, 561 bp, Homo sapiens
  CDS 256..426
ttgaagatttttttggtatattctagatgttaatctcatcctgtcttctgtttatcaactttgtcaatggtaactttgagaaatttttagttttgatatagccccagtccattaatttttgccttaggttgcactttaagagtataagatatttttccttaccccaagattacaaagatattctgtattctgtcagctttccagttttacctttcacattgagggctttattctatttgaagttcatcttcatatatgggaaaacaaaggaatctcacattatttttttcctttccattctgtgagacagttttcctaaatcatctattaaacagtgtattctttccttcatatagttttgtggagccacttttatcatacctcagattcccacagacacatattagtttactttttcaactttattaagagttattaaggctgagcgtggtggctcaatgcctgtaatcccagcactttgggagactgaggtgggaggattgtttgagtccaggagttcaagaccagcctgggcaacatggagagaccctgtctctacaa

SEQ ID NO: 2495 - DNA, 451 bp, Homo sapiens
  CDS 56..250
  misc_feature 417: n=a, g, c or t
ccatttctctactgggtaggggttaagaggacaaaggctgcttttctgctcaccaatgctccttcctaaggcagagtcttctttgagatttaatatgataatcaaggctaaagagagttccacttcccctcacttcaagatgcactgtcacatcagcagcgccccagcactgggcagcaagatgcccaccctggctactcacgaggccaggtttcggtcctcctaccctgggcagcacctccaccgcttctgatctttctgcttctcttctcctaagcaatgaagtcttgctgtcgcctaggctggaatacagtggtgcaatctcggcttgctgcaacctccacctcctgggttcaagcgattctcctgcctcagcctcctgagtagctgggattacaggagaagatggacatctanaaaccaggaagtgggcsctcgacagacacaaagt

SEQ ID NO: 2496 - DNA, 486 bp, Homo sapiens
  CDS 160..465
acacagcatgcatttcttcaacaagcgactcagaaggcacttgcacatcgttgctgttctgcctctttgcttcagcatgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccgctggctggaggcgtgatcctgggtgtggccctgtggctccgcatgacccgcagaccaccaacctcctgtatctggagctgggagacaagcccgcgcccaacaccttctatgtaggcatctacattcctcatc

SEQ ID NO: 2497 - DNA, 793 bp, Homo sapiens
  CDS 109..396
actcactcgcccgccgcccgggaggagaaggaaggcatggaaagttccagccggttcgagagctagccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggac

SEQ ID NO: 2498 - DNA, 491 bp, Homo sapiens
  CDS 153..437
agggtgaggggcgccaccgaggaagcgcccaccgggctcccggggctgccaggccccaaattgaggaagttgactgccagatcacactctgttggcccacgcagatagattccattcatcctttctaatgtctacaccatattttggataacatgccatcatctcacattgtgttgaaagaagaaaccagaatgttggggttgatgtatgccatatggatgaatttaaacagtttcggccttgcaataattggtatacttctaattgcatgtgaaattatactctttttaacgaaagatgaaactattcagtggccacatgtacccagtaacagagggagcaaagcaaatcttatcctcaaagaactgcagctgcttgttagatctacctggtggttccatagagaaactgctcagagaacctgcctttacctcgcctaaaacagaactatcccggagctcagttcatcaactcaggatccagtagtgtaa

SEQ ID NO: 2499 - DNA, 780 bp, Homo sapiens
  CDS 288..443
ctttaaccatgataggcatctctgcaaggtaggttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaaatactaaaattttacatgtgtattttgaagttttt

SEQ ID NO: 2500 - DNA, 300 bp, Homo sapiens
  CDS 10..195
tcggcgggcatggctggggcacctggcgccatctttttccaccgtgcgaaggcaggagcccgagactggggaaaggcaggatcctggtttcaaaatctcagaagtgttcctggactctgtgcttcctcccccacctctgaagctgctgggtctcctcccatcggggcaggcccactggggctccgcgagtcatcttagtggaagccctgggctcctaagctttcttcttcccaagtgtgtcccagcttcagcaacatagtgagaccctgtctctaccaaaaaaaaaaaaaattkcgaaaa

SEQ ID NO: 2501 - DNA, 466 bp, Homo sapiens
  CDS 131..334
  misc_feature 447: n=a, g, c or t
ctttgcctaagattagcctatgggaagcatggcctctgtgtgaattggtggtggattcaaagcacagcatctggggtcctgtgtcaattacgctctcctcaacagaagatctgagtggtggtgcatcttcatggctgctggaaggccccgctgtgtaattacgtctggaattggtgggttcttggtctcaccgacttcaagaatgaagccgtggatcctcgtggtgagtgttacagctcttaaggtgacgcacctggagtttgttccttctgatgttcagatgtgtttggattttcttccttctggtgggttcgtggtctcgttggctcaggagtgaagttgcagaccttggcgctgacagaatcaagttttaaagatccagttaaatgcctggctatcaacttgccaagagctgatccagatggaagccatcatcctaagagtcanacaactcattaactctaaa

SEQ ID NO: 2502 - DNA, 405 bp, Homo sapiens
  CDS 22..213
agtttgaacttggcgggccagatgtgggcggcggggcgctgggggcctacttttccctcttcctacgccggtttctctgctgactgcagacccaggtctcggccctcctcggactcctgctcagtccctatgacggggaggatgaggaagacgtggatgatgaggaagacgtggatgaagatgcccatgattcagaggccaaagtggcgagcctgagaggaatggagttacaggggtgcgccasatcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaa

SEQ ID NO: 2503 - DNA, 476 bp, Homo sapiens
  CDS 22..444
agtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccasatcaaggttgaatcagaaaataaccaagaagaacagaaacaggtgcgcttaccagaaagccgcctgacaccatgggaggtgtggtttattggcaag

SEQ ID NO: 2504 - DNA, 456 bp, Homo sapiens
  CDS 191..376
aattagcagtacctaacatttcctaagcatttgctatgtgcccggctgcatgccaccatactttatagatggagtctcgttctgtcacccaggctggagtgcagtgacgcaatcttagctcactgcaacctctgcctcccggattcaagtgattctcatgcctcagcctcccaagtagctgggactacagatgcccactgccatgcccaggatacttacaggtcagaagggtcttcaggttgagttctggccaaaatttgtggcatttccaagtctcacttcactgaatgagtacaaccctgagacctgtctgggaacatggagtgaamagaaactaagagagccaccactgctgaggcagggagggatggcctggtgatacacaggaaaggtttatggaaactcatggttgatatgctcaggtgcagtcctcctagctacctattttccartttg

SEQ ID NO: 2505 - DNA, 543 bp, Homo sapiens
  CDS 39..527
agcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttga

SEQ ID NO: 2506 - DNA, 507 bp, Homo sapiens
  CDS 31..261
attgtattaggcatacactagcttcattaaatgagttggaaaattattttcctcctctgttttctggaagactggtattacttcttctcaaacatataccagacttcactagggaagccatttagaactgaaattttttatgtgaataatatggtaaggtactcaatttatttaaaagatctagactattcagatgttcatcttgactcagttttgatacgttgtatttctaaaggaatttgtccattttatctaaattattaaagatactggcataacattatttataacattcccttattagtctcttaatgagtctaggacctatagtgagatcaactttttttattttggatactggtaagccaccacacctggcctaatatcattcttaatggtgaaatgttgaatgtttcctcctaagattgggaagaagatagagttgtccactctgactcagcgttacatggatgttctaggcagtgtattaagtcaagaagatgagta

SEQ ID NO: 2507 - DNA, 513 bp, Homo sapiens
  CDS 81..326
agcagttctctgcggagggccggttgatacagttccggtgggagaacgcggctgcraggttttcggctttggctcctgatatgcagcgacagaattttcggcccccaactcctccttaccctggtccgggtggaggaggttggggtagcggaagcagcttccggrgaaccccggacgggggcggaccacggccgccctcccctcgagacggggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaaggaagatacttttgttaacatttctgaaattcaactggaagcttcatgtgtcaggaacatcttggacaaaactttaagttgtgttgatataaatttacccaaagatgatgactttgat

SEQ ID NO: 2508 - DNA, 488 bp, Homo sapiens
  CDS 22..255
agagactaaagtgatgcagctatgagcctaggaatgccaaggattgccagcaacttccagaaaccaggaaaatgcgtggaaggatccttcctccagagactttggagggagagtgaccctaccaacacattgattttggatttctggcctccagaactaactcagctttctacaaagactgccttgctcagttgtcatcgtgtggctggtcggggtgtcagtattctagtgtttcctactcaacagatgcaggaatagagactcacaggggtaggatggtctgcccykgggycarrramcamsggggaagattcagagtcaccgagaagttacataagcacagcccaccaagctgagagcagcgattttgcctgagggcctgcagaagaatttctcccgtccatgcatccaagccatgactgattcatttcctttaaaaacaaacaaattgtgtttttacatcaggaaaaaaaaaaaaattcctaaaa

SEQ ID NO: 2509 - DNA, 482 bp, Homo sapiens
  CDS 22..270
agagactaaagtgatgcagctatgagcctaggaatgccaaggattgccagcaacttccagaaaccaggaaaatgcgtggaaggatccttcctccagagactttggagggagagtgaccctaccaacacattgattttggatttctggcctccagaactaactcagctttctacaaagactgccttgctcagttgtcatcgtgtggctggtcggggtgtcagtattctagtgttcctactcaacagatgcaggaatagagactcacaggggtaggatggtctgccctgggtcacagaacaacagagaagaatcagagtcaccgagaagttacataagcacagcccaccaagctgagagcagcgatttgcctgagggcctgcagaagaatttctccctccatgcatccaagccatgactgattcatttcctttaaaaacaaacaaatgtgtttttacatcaggaaaaaaaaaaaaaattscgaa

SEQ ID NO: 2510 - DNA, 489 bp, Homo sapiens
  CDS 264..452
atcacgagaacaacacgggaaaactgtccccataatcaagtcatttctctycctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggactctccagaactctaagatgtcagaacaaactttgggacatagctggtcttgtagcaaaggatacaaagaatagacgaactacacctggctcttcgagtgtctgatag

SEQ ID NO: 2511 - DNA, 508 bp, Homo sapiens
  CDS 16..165
agtttccatggtgagatggtcaacaagcctgtaagttcctcagctacgactaccaggtacctcgggttcctccctcctccgagagaccgccgaggtgcgggctgtgagagggggagcgtggagcctccgaggccgaggtacggagtctcgctctgtcgcccaggctgaagtgtagagtgcagtggcatgatctcagctcattgcaacttccacctcctgggttgaagcaattcttctgcctcagcctccggagtagctgggaatacaggtgcaggctgccacgcccggctcatttttgtgttttagtagagatagggtttcaccatgttgcccaggctggtctcaactcctgagctcaggcaatcctcccgccttagcctcccaaagtggtaggattacaggcgtgacactgcacctggccctcgactcacagattttcaaaatacttttgaacagtaagctgaggacagtgtttattatgactatactggtctcctttcactagctc

SEQ ID NO: 2512 - DNA, 471 bp, Homo sapiens
  CDS 202..462
  misc_feature 419: n=a, g, c or t
aacatcccgcgccctggacctgcaggggtagaggagaggccacctccactgctcctatgcccaccccaggtccacaagagcctgcagaggatccgggaacggaagttggccaacttcatcccgtggggccccgccagcatccaggtggccctgtcgaggaagtctccctacctgccctcagcccaccgggtcagcgggctcatgatggccaaccacaccagcatctcctcgctctttgaaagttcctgccagcagtttgacaagctgcggaagcgggatgccttcctcgagcagttccgtaagaggacgtgttcaaggacaactttgatgagatggacaggtctagggaggttgttcaggagctcattgatgagtaccatgcggccacccagccagactacatttcctggggcaccagnagcagtgatttccctccccactactccttctccttctagatggtaaccacag

SEQ ID NO: 2513 - DNA, 478 bp, Homo sapiens
  CDS 107..376
  misc_feature 200: n=a, g, c or t
ctcgcggaggcgggactctggccgcctgttttttttgcagccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgngtctcaggtttgaggtggtcccctccaagtttaaagagaagctggacaaagcctccttcgctactccgtatgggtacgccatggagaccgccaagcagaaggccctggaggtgcccaaccggctgtaccaggcaaggggcccctgcccttcggcccttatgaaaattcctttgctgtgatgaggggatttgcgggtggtaaatatacatgatacaaataaacgtcattcaaaagatgcagttggtggcacagcttagctattgctatgttataatgta

SEQ ID NO: 2514 - DNA, 498 bp, Homo sapiens
  CDS 171..449
tgttacaaatattccctatgatctctcctttaaatattcttatcaggatattggaaattcttgattttcacaactctgcttcagtggcatatgtttagctttttgtcttctgaattaattgggcttctgatggtccctagaggtatcagctactcagtcagaaaacatacatggggaagaaactgaagttcatgccacaaactgtagcagctttggaacagaagggaccagacaacctcaaggagaatgggcccaaataccaaaaatttactcttggtgacccttgttgcttctactgtaccaggcaactctcttgggcaggattttacttttgcacacttagaaagatcctgcaccagggaaaatcggtctcctggggaggtattccagcaaccatgcaagtctggaggcgggggggttggagaaccaaatgcccaagggcagctacttagccagcacccactacctgccttcattaattgttctcacgggcaggcc

SEQ ID NO: 2515 - DNA, 446 bp, Homo sapiens
  CDS 37..192
agtctcgtcgagggctttccaacaagcaacttggaaatgagcgacggtataatgatgtcaccatccatttatcctctgcacttaaaggttgaagctcttcaacaaatctctcctcagccaaatacatctggtaccttaatggaggcgacagacaggcttctgattagttcacacatcactcaccaattagaatagaagtgcatttacagtctgcaaacaaggattcatcatgggaaactgtttttaaagtcagaagatcttgattcaagtccaattctgcccattaccatgtgaccttgagtgaatcttgtaatctctcttttaaaaatacagacagcaacacttgccccctccatttacggcattacaagcatctgatgggatcacacatttgaaaatatattgaaaaacatacatgaatatatggtgtctagttatcaagactc

SEQ ID NO: 2516 - DNA, 553 bp, Homo sapiens
  CDS 279..545
tttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgcctgcgcatgactctg

SEQ ID NO: 2517 - DNA, 468 bp, Homo sapiens
  CDS 74..274
acattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactcgactgatccacgctgacatcaatgtgatggaaaacactatcaaacaatctgagaatgacctaaacaagctgctagagtctacaaggaggctgcatgatgagtataagccactgaaagaacatgtggatgccctgcgcacgactctgggcctgcagaggctccctgacttgtgtgaagaagaggagaagctttccttg

SEQ ID NO: 2518 - DNA, 484 bp, Homo sapiens
  CDS 86..325
  misc_feature 100: n=a, g, c or t
acagttctctagcatttttcagtcacaccactccttcactgctctgaaattttgatagtatcagattcaatcccaagacaggattatgatactccaccanctgttgtgtcagtatatgactgctgctgctcctatgcaagggacctacattcctvagtacacgcctgtgcctccgacagctgtttctattkaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcacttgaacaagaagttggcttccagtttgcacagacgtcaatggaatgcatttttttgttgttgttgttgttttttttttagtgttataccttacccaatgaaag

SEQ ID NO: 2519 - DNA, 488 bp, Homo sapiens
  CDS 300..455
aacgaaaccttctgggaagtgtagtccagcaagccgctcacttttcgtgaggcgtcacatcctgctgcttcaccctctggtgcacgggaggaccaactatttcagtcgataacttgaaggtcatgatgttctgttttctagttatgctgacgactcaaatcagtttctgagaggcttctgggaggaagaccaccgagctgcagcctgtagaaatgctggtgaatactcaacatgtggaggctgtgtctcacagttcacagttcctaaaatgacaaatagtgcacaggttgtcactgtgaatggcagatccaaagacctggggctcagctgtctccatcgttcagaaaggaattgagagttatttctataccaatctaggcaggcctggctggctctgcacctgccagctgttttaccttgcatttgacttgtttgagcctctattttctcattggtagaataaatttatttatatctaaaaaaaaaaa

SEQ ID NO: 2520 - DNA, 525 bp, Homo sapiens
  CDS 65..454
gtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggaccagcagatgacctggcccaggagatggaagatgtggactttgaggaagaagaggaggaagaggggcaacgaagagggctgggttctagaaccctytwtggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatgggggagctgctctttgagtgtgcaggccataaagactctgtgacttgtgctggtttcagccatgactccactctagtgccacagg

SEQ ID NO: 2521 - DNA, 457 bp, Homo sapiens
  CDS 68..238
ctccgggcgcgaggccggtgggcagagaggcaggtcctcgtccctcgggcccgtggcgctgtcgtggatgccacctgaccagctgaggagatcgtcagaaaggctgggacaccaacggatgacgcacaaatggaggaattttcaggcacggtcaaagctaatgggagggaaaatactgaagtgtaatattccagagttctctcttgtctgctctgactcctgccagctgccctgcacctagagggacaggaggctcttctccggggcattgcatggccgggagccaaatgagctggcaccagaacctggaaccctctctttgggtctggattgggacccctttccagtaccattttttctagtgaaccacgaagggacgataccagaaaacaccctcarcccaaaggaaatagactacagccccaattggctgactttggctatagaaaaaagaaag

SEQ ID NO: 2522 - DNA, 452 bp, Homo sapiens
  CDS 49..228
agtttgaacttacaatacttaagtcctggcaagtcataagtggggaaaatgtctctcccaagattccaaagagtaaactttgggccatatgataattacattccagtcagtgaattaagcaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcasctctcaaaccaactcgtactgtcgaggtggattctaaagcagcagaaattggtaagaaaggtgaagacaagacaacacagaaggacacaacagattcggaatcagaattaaaac

SEQ ID NO: 2523 - DNA, 538 bp, Homo sapiens
  CDS 20..349
ttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccatttctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggaggtatcatgatgatacttgttgatgccactgttatcatcctcctagcagaagatagtcctactgagaaaatgagcacttgatcat

SEQ ID NO: 2524 - DNA, 600 bp, Homo sapiens
  CDS 20..349
ttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccatttctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggaggtatcatgatgatacttgttgatgccactgttatcatcctcctagcagaagatagtcctactgagaaaatgagcactttgatcattcagtctttgaactttamctttgactgttagtcttaaatagttgggacatcagctgactaa

SEQ ID NO: 2525 - DNA, 390 bp, Homo sapiens
  CDS 2..238
aatgaggaakccctcctcggcgtcccgttgccaagcaactgggttsysyccacccccacccggcccaagggttagcagttgcctactttccccgcagtgcgataaacccctcgttggggccgccttagttctcggccgctctcggaggatggcgatctgggagcccctccatgggacccctctcacactttgtcactggaattttatttattttttagttcatattttattttgcttatagaagagaaagatatcccttccgaagaggaggaagcttacagaagtttataacctttcaaaacgtaaataagtccaggcttgctgattctgccctacccggacttccttatcccgtctgtgggagaccaggtgctttctcattactcttca

SEQ ID NO: 2526 - DNA, 469 bp, Homo sapiens
  CDS 68..223
aacccaagcatccctagggacccgggttgttgcgcgaggggtgagctgagtgttgttttagagcctgatgcagttctgcctccctttttatgagagtgtttttgtggcagtaccgacagtgacgaaagacagatgtaaaatcctcagatacaggcaattgccaccgggaggagtctgcagtgattgtctgggggacaatttggagttgaatttgttaaactactgaatcctgttgtgagattttgagttgtgagtctttctgtggcatcatcatccccaaacaccgtctctttaaaatgtctttgtgaagtggaaattttccttccctgcattctctcatccactcggtaatgcttctggcattccctctgcagtcgtcttctttgcctttgccctacttagaaggtctacatttcaaagcctcctaatggttctcgcattgctgccagattctggaaatggaccatca

SEQ ID NO: 2527 - DNA, 521 bp, Homo sapiens
  CDS 119..313
aagataccccatgtcacaaaatcatctagtatcatgcagaaaaaatgtctaaagaaccaaaacagattcaatgcagtgacggcagaaagtgtaagggcatgaagattcaaagaaaaagatgcggccgttgaaagatttatatgctcctttgctccaggtacctgaatcactaaggccagtttcaccaaattcatttagtccagaagcaccaacaccaagttcatctgcactcttacctcctccaccacttccagaatcagaagaccaagtgtttcctcctaatggaaatcaaaatgtgacccttcaattatattgaataaagaccagcatttttttaaaaaataacaaaatctgtgatccactccttgctgcaattcttaattatgtaaaaaggaaaaaagcaagtaagacccaaactgagtgttcagctgcagtaatctgcttctcttggtgggactgagagcatttactccctccactttctgtaatgaccctattcacaatttataccagtcttatgt

SEQ ID NO: 2528 - DNA, 513 bp, Homo sapiens
  CDS 21..326
ctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatccccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcagggattccatagctgcgtcacttgtgcttgtggtcagcctgcatatgccc

SEQ ID NO: 2529 - DNA, 525 bp, Homo sapiens
  CDS 13..165
ttttcccccaagatggcgtccatgcgggagagcgacacgggcctgtggctgcacaacaagctgggggccacggacgagctgtgggcgccgccagcatcgcgtccctgctcacggccgcggtcatcgacaacatccgtctctgcttccatggcctctcgtcggcagtgaagctcaagttgctactcgggacgctgcacctcccgcgccgcacggtggacgagggtctggcgctgtcaaccaggctggagtgcagtggcaccatcgtgactcactgcagccttgacctcctcacctcagatcttcccatctcagcctcctgagtagctgggactacagggtttcaccatgctgcccaggctggtcttgaactcctgacctcaagcaatctgcttgcctcagcctcctgaagggctgggattacaggtgtgagccatggcactcggcctgctgtttggttttctgctttgagaattgtatattcaaatctgcttttaaattctcttttttcccaaaaaaaaaaaaaaa

SEQ ID NO: 2530 - DNA, 500 bp, Homo sapiens
  CDS 105..314
ttaaaaaaaaacgcctgattttattttgcatttgaaatttatagaatacaaggtctttttgtatcatagtctcatcattgtaaacatcagttatcactaagtaaatgaacactggaagtgctattaacatatattttaagttaatatatagacaaatttgcttttatagtgtatggaaagacttatgcccattgatcattcatggttttgtaatgagcgtttttaagataacatttaccaaagctctatattttaataatccagaaaactataaagaaaataaaaaatcagccaggcacgatggctcaagcctgtaatctcagcactttggaggccaaggtaggcagatcacctgaggtctggagtttctgaccagcctggtcaacatagtgaaacaccatctctactaaaaatgcacaaattagccaggtgtggtggtgtgcacatatatcccagctacttgggaggctaaggcaggagactcgcttgaacccaggagc

SEQ ID NO: 2531 - DNA, 484 bp, Homo sapiens
  CDS 111..410
aagacctactcagaaccccctgggctgctggctgctcaccctccccccaggccagatccttacctgtacacagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagkaataacaatagccatgcaaagtatatgatatatatcataaataattgtacttacattatatatgawaatgatactctttttgatatgctaggtaaataa

SEQ ID NO: 2532 - DNA, 481 bp, Homo sapiens
  CDS 171..389
aaaatctgttctcttagctggatccaggtatgtgagtkatcacctcacctgtgagctgtgaccatgtatatgtcacaatttcacctgtgggcaggaaccagacatgagagtcctatcacctgggtgctgggtgtaagagtcaacaactcctgagacttaggttcaagtgcatgagtcacaatctcaacagtggattgcatcctgccatgagagccccaatcccttctccaagctgtgttccagtagaggagtcgcaacatcaatggtgtgctgaatcctggttggagagttcccacttcacctgtggactggatctgtatataagaggagagatgtcgactctcatgcctgggcttagggcaatgggcatgatcctacatttgggattgtagcaacaactcttgactgcccctgggtgtgagattcagaacctcaattgtgacctgtgtacacttgggcatgtgacaatttctactttttg

SEQ ID NO: 2533 - DNA, 487 bp, Homo sapiens
  CDS 22..318
taaggactgacattcgtgcttatgtgtgagggtctccctctgtcaccgaggctggagtgcagtggcacaatctcaggtcactgcagccttgacckkscaggctcaagtgatcctctcacctcagccttccaggtcgttgggactacaggcrcacgccaccgtgactggctaattttttgtattttcaccatggtgcccaggctggtctctgaactcttgagctgcctcggcctcccaaagtgctgggattacaggcgtgasactgtgcctggccaagagaaaagaatttgtttgacattggctcattttcatatcaagtgaatcagaagaatcagatattttttaaaaaatagagacggggtttcgccatgttaacgaggctggtcttcaactcctgacttcaagtaatctgcccgccttgggcctccccaaagtgctgggattacaggcatgagcacacatctggccaggagtatctttacaatta

SEQ ID NO: 2534 - DNA, 465 bp, Homo sapiens
  CDS 80..247
  misc_feature 230,452: n=a, g, c or t
acaggccccgggcctccagagacaccacacgatccagaacagcgacgatgcttatgtacagctggataacttgccaggaatgagtctcgtggctgggaaagcacttagctctgcccggatgtcggatgcagttctcagtmagtcttcgctcatgggcagccagcagtttcaggatggggaaaatgaggaatgtggggcaagcctgggaggtcatgagcacccagaccdantgatggcagccagcatttaaactcctcttgctatccatctacgtgtattacagacattctgctcagctacaagcaccccgaagtctccttcagcatggagcaggcaggcgtgtamaagaaacagagagttttgtgtacagcttgggaatgaaaaggttgattgtaaacccacagtatctagcagcgttgtgccaaattgcccttgtgtttctctccacccanaatatcacagctg

SEQ ID NO: 2535 - DNA, 463 bp, Homo sapiens
  CDS 232..402
agtgatgccatcaggtgtggtatgtgatcacaggcaactcaggaacagctctccagccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagagagactgtggaatggaatgactctccagagctgcagattgaagatctcaatggcgggaacaccttcatggcccctttatagctggtatgttttcttcttatggacaatgagaaacatgtaataaactgtgtttccttctcgctaggaaaccctgagttaaagctttaaaaaaaaaaaaa

SEQ ID NO: 2536 - DNA, 484 bp, Homo sapiens
  CDS 243..464
  misc_feature 310,347: n=a, g, c or t
aggaatctgaccctcagaaaataatcacatacgcggmstcactagtggcagagccacgacacccgctcctctccagctctctctttacggacagagaggaatctacttaccaagatggcaggagcaagtggttatcagagcctgctctctagaaatacaattaaacaagcagcccctgtctctttttctccactttcagtcttggggaagggattggaatatgtgagcaggagagaagggtcatgttggagcagccaggactcagagcctttccgcagactgagtctggatcctttccttcggcctccangaatactcccggctccacacccagaatggtaatccangcaatggctctggtgtgtggccacmtgccacctattacctgtgggtccaaatgcagtgactcaacttctctgtgcctctctttccacatgtataaaatgaggataatgttgctattgtaagaattgcatcaattaat

SEQ ID NO: 2537 - DNA, 533 bp, Homo sapiens
  CDS 160..405
akttctggtctctcttccacctcttctaaggacaacaatcctgctagtttagagtcccactcataacctcttttacccttaattagcaattaaagaccctatctctaaatacagtaacaatgatgggtaactcgatcatggaagattattctaagtacaatgcttacactgacttttcttcttgtaggactcctaaatcatcagtggcttaaagaaacagatgttcctcagaaatccagacaattatatgccataattgcagaatatggttcaaggctttataaatatcaggagacttacagaggagagagacacagagaggagaagaagagaccacgtaaaggcagaggcagagactggagtgatgcagccacaagcctaggaatgcccagagccaccagaagttagaaaaggcaagaaacagaatctccctgaggaccttcagaggagtgtaaacatgttggacacgttgaccttacactttttgacctccagaacagcgacggataaattccattgtttcaaccaaaaaa

SEQ ID NO: 2538 - DNA, 516 bp, Homo sapiens
  CDS 261..476
agatttagatacagagacacaaaggccatatgacaacggaggcagagactgtaatgatgcagctacaagtcgaggagtgccaaggattgccagacaccagcagaagctaagaaaagaggccagaaatctttcaagaaaaagtctcatttgaaaatctttcacatcttgtgaggatgaataaaagacagaatgtcaactttgccgccttaaaatttcaaaaagaggaaacattccaaaatcgcatacagcatccatgatacatgatccttgatccagacataaaagagaatataaaaatgaagaaaagagacgctgttagagaaaaatgggacttccctccaaacatcttgctcctcacccacatgggtggaagtgatcaaccctcagtcactcagatgggcacaggaagggccttggattatcccttcaaagctggcggcccaagaaaactgttttctgcaccctatgtcagcccttaaaactttactatagctctaattcaaattgtaataataa

SEQ ID NO: 2539 - DNA, 484 bp, Homo sapiens
  CDS 85..297
gagtcgcgcagagtggagtcaaaggcaaccagtgctcgctgcggtctctggggatcgggaccgcggcggcgtcccgcgagcgggatgttccggggcttgagcagttggttgggcttgcagcagccggtggcaggcggtgggcagcccaatggagatgctccacccgagcagccgtccgagacgtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatggttgacactaacgatgaagaa

SEQ ID NO: 2540 - DNA, 985 bp, Homo sapiens
  CDS 524..904
caattttkctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcacaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctggggaccccgagcacacgtggaatcgagcaaactgaaagtcatgcattttgtggcaagggttcttaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtacccaaggagtagatgccagggtcctaagttg

SEQ ID NO: 2541 - DNA, 508 bp, Homo sapiens
  CDS 170..346
agtagggtgggtgcacttagaggaagagacaccaaagttttctgtctctaccatgtgaggacacagtgagaaggcagctatttgcaagccaggaagagagccatcaccaagaactgaatctgccagccccttcatcttggatttcccagcctccaaaactagtgcagacatgagtccagcaagcagtaccacgtcacttcctgttagtcctcttactgaagagccagtgcctttcaagaatattcagcattatatcaactgtacacacatatggtctgacacatgccactgcatcattatagaagagccaaaggataaccaattttgcataggatataatgaaagatgaatgctcgatgctcaagctgcagctgaaagagaaggatgaactcatttcccaacttcaggaagagctgattctaaagcaaactactacacgtagccatcatgttccaagtttttgaaagttcatctttttcatcttgttgataatttcatcaacttttat

SEQ ID NO: 2542 - DNA, 484 bp, Homo sapiens
  CDS 189..455
ataaaatcggaacctctttcttttgaggaaggtttaagcagcagctgtgaactgggcatgaaacaagtttcctatgaccagaatgaaataaagaacagttaaaagcattcgcgctaaaaagtgcagatttctcttcctatttgctttctgagccacaaaagccttttacccaattagctgctcagaaaatgcaggtgcagcaacaacagcagctctgtggaaattatccaacaatacactttagtagcacgagtttcaaaagggcagcatctgcaattgaaaagtccattgggattttgggaagtggctccaatcctgccacaggcttgtctggtcagaacgctcagatgcccgttcagaactttgccgacagcagcaatgcagatgaattggaactgaaatgctcttgccggctgaaacatgattgtgtgcaaaggctgtggggccttctgccatgacgactgcataggtccttcaaaacttt

SEQ ID NO: 2543 - DNA, 544 bp, Homo sapiens
  CDS 275..457
aatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcatagtgccccccacaatcgtaggaactgtgtcgccgcgcttcccgttaacttgccgctaagtttttctagaaaagtcgcccttattgccaggggtgtcctatagactttgtcatggagtgaaacagaaacaaatgtgttttcagaaaaacatccctgacaaaccaaccacataccacacacacgcccctacacctctccaagatgctcagaacttttggttagaagatgaggaaatcaagaaacagaaatttcacttgtccacgtctcacggcaagttagcggaaaggctgaggaatttatgtacaaaagcgacttaaactggctgcatgcaacggcaactctcgaacaaagagggctgttctgcccaacaaaaattcagtgtatatatcttttaaaataca

SEQ ID NO: 2544 - DNA, 450 bp, Homo sapiens
  CDS 154..306
  misc_feature 434,440: n=a, g, c or t
gttgactccgggggcgcggcgaggagtactgtccatctgcctgagcgccgtggccacggccasggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaactgttgatcccatccgagctagggtatggagagcggggagctcccccaaagattccaggcggtgcaacctggtgttcgaggtggagctgctcaaaatagagcgacgaactgagctgtaaccagactggggangggcanggggatatgc

SEQ ID NO: 2545 - DNA, 584 bp, Homo sapiens
  CDS 257..454
atcaccctccttcaggacctagatgcagggcgtttctatcttaggctgacacttgactccttgcctacatctatagcttggcacagagagattcacgcaccctcaagagtgtgggtgagacatatacagcctgttagacctgaaggcagatggctcttcttaaggccaataaggatctcatttccgcagattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttggaawaaaaaaaaaaaaa

SEQ ID NO: 2546 - DNA, 438 bp, Homo sapiens
  CDS 4..270
cacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggcttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatcgaaaaaaaaaa

SEQ ID NO: 2547 - DNA, 578 bp, Homo sapiens
  CDS 56..277
accctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcgatcatcctcctggtgaaggctgggcaagctgtggatgatttcatcgagaaattggtaccattgttggatactggtgacatcatcattgacggaggaaattctgaatatagggacaccacagtaagtgttcttcagtccagattcttccaggttccgagaacattctagaaaaaagtgtcagcatcgcatatgtgacagtaggggtgamctgccctgtggtactgatttttttgagagtactactgatacaatagttctcagcctttttttctgtaaacacacttaacagaatgcggtgtgttgtgtcmactgta

SEQ ID NO: 2548 - DNA, 497 bp, Homo sapiens
  CDS 197..364
attatacaagactatttgcattgactagtaacatctatgcttgtggctgcattcttgctgttgaagtcagcgttctaactgttgttacttcataggcccagctgtgagatacagtaagttcaagatgtcagaggccaggccgcccccgctgctcgggcacacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatt

SEQ ID NO: 2549 - DNA, 459 bp, Homo sapiens
  CDS 168..365
gagagattcacgcaccctcaagagtgtgggtgagacatatacagcctgttagacctgaagatggctcttcttaaggccaataaggatctcatttccgcagattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactcttgccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcataaaga

SEQ ID NO: 2550 - DNA, 478 bp, Homo sapiens
  CDS 220..399
gatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaagatgtagacgtttactctcaaatcttgagaaaactcttcaatgaatcccatggatctttctgggcctccagagaattgacgag

SEQ ID NO: 2551 - DNA, 424 bp, Homo sapiens
  CDS 193..348
  misc_feature 370,385: n=a, g, c or t
tatcagactttgagaacatattgaaggcattgactttgaaaatcatctctttttctcaagaagaaagcaatggagaatcaaatttgtttcattcagtgaatccccagtttggggcttgtggggcttagagacattgtgaaatcaaatcttgtgttatacttttctcctggctcactttttttgagaaggtttatgggctatttggctggtgagacacgatccctcctaagaaaatgtaggtgctcagacagccttttcaggagccaaaaaaacaaatacaaacaaacaaaaaaatacccagagaaaaaactttccttcttscccttcctgatgatgagtcagaagtattgagaastttcggggtsagtgnccttctaaaagtccncttcccccaataatgcagctgtataatgaatggtaaatg

SEQ ID NO: 2552 - DNA, 484 bp, Homo sapiens
  CDS 113..391
attattagttctgccactggtaggcattagaagcaagaaaaggggagacggaccgaggaagccactttggtgaaacaaaaagaaaagcatttgtttatttagaacgggcaaaatgatacgtttcagattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactcttgccaaccctttcctggccaagtacagggacttcctgaagtctcatgagctcccgagtcacccaccgccctcctcctagctcagggacccagcccctcctctctgagaaactctgaccttcatttccttaggctgtgctcctgccactctaccctgacacctcaataaa

SEQ ID NO: 2553 - DNA, 390 bp, Homo sapiens
  CDS 83..274
aaaagcgggcgccatccgggaccggcggttgtctgtggccggasgkgaattcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttaggtgtcttcttattcaacaccgaaaataagcttctgctacagcaaagatcagatgctaagattacctttccrggttgttttacgaatacgtgttgtagtcatccattaagcaatccagccgatctttgaggaaagtgacgcc

SEQ ID NO: 2554 - DNA, 488 bp, Homo sapiens
  CDS 14..286
aagtyggsttscaatgscgccggtraggggtyccgcgaagtggcggcctggtggtattgaggcgcgtggtgaaggggtttccactgtcgggtacaggaataagaatgtgagacagaagacatggcggcctaaccacccgcaagccttcgtggggarcgttcgcgargggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttaca

SEQ ID NO: 2555 - DNA, 477 bp, Homo sapiens
  CDS 30..344
asacggtccgttgttgactaaaatgttatatgatcttcagatccctacstgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagtttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggascttctatttatatactgtsaacatcctgtcagchgsscgaatgttgttgcacaggtgctac

SEQ ID NO: 2556 - DNA, 502 bp, Homo sapiens
  CDS 241..390
aggttctgaggtaggacctatgcaatgtgctgtgattacagaggatgctgctgtcagctagacttgtccctgcagacagcacaaacctccaaatatttcaagtagaaattcctggccagaagaaaaatcaacttgcaaaaaaaaagaaatgtattagtccattctcatgctactgacaaagacatgcctgagactgggtaatttctaaagcaaagaggtttaattgactcacagttccacatggctggggaagcttcacaatcatggcagaagatgaaggaagagcaaagggacgtcttacgtcgtggccagaaaagagagaatgagaaccaagtgaaaggggtttccccttataaaaacatcaactctcgtgagacttactcactactataagaacaatatgggggaaaccactcccatgactcaatgatctcccaccgtgttcctcccacaacacatgggaattatgggagctacatttaaagatgagatttgggtgggg

SEQ ID NO: 2557 - DNA, 528 bp, Homo sapiens
  CDS 60..221
agttcccctccacttttaaggatgggccaaaatgacagtctaatctcacctctctggccatgacgaatgtttcaagaacggcacctgaccccctaaacactgataagatcagcaacaatagattttctgagactcctgcgaaagtgaagcaagctctctctttcataggaattaccagggataaccatcattctttctcagaaacctcatcctatgtatcttaattgtctagttgaccaccgtaatgagctggactgtgcccctgcaaaattcatatactgaagtccaaacacctagtacttcagagtttgactgtatttggagagagaactttaaagacataattaagatcactagaatgggtchtcatccaataagactggtgctttaataaaaagaggttagtctctctcaacaagttgagtatagaataactatacctcaaaatgataaagaccagatatgacaaacccacagctaatatcatactgaatggggaataatggaaagcctttcccgtaagatatg

SEQ ID NO: 2558 - DNA, 513 bp, Homo sapiens
  CDS 73..261
ctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaatatgtgtacacatatgaacgcacaacatgcacattcatcctcacatgtggcacgtaaggtctcatttgatattgt

SEQ ID NO: 2559 - DNA, 346 bp, Homo sapiens
  CDS 115..288
taaatatattaaatatgtgtattatattaaatacagtattaaaaaaaaaagattgaggtggccaggcgcagtggttcatgtgtgtaatctaagcactttgggaggccgaggcagatggatcatttgaggtcaggaatttcagaccagcctggccaacatggcgaaacccccactctactaaaaatacaaaacttagtcgggtgtggtggagcgtgcaggtcatctcagttactcggaaggctgaggcaggagaatcccttgaaccgcggggcagaggttgcagtgagctgataccgcaccastgcactccatcctgggtgacagaktgagacctcgtctcaaaaaa

SEQ ID NO: 2560 - DNA, 505 bp, Homo sapiens
  CDS 180..437
agagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcwwtcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccgggacatgtgctgtttgcttaaactctgcacgatggttgccccaaagctccgctcctggatgtatgctgtgtacggggccttggctgtgatgggcacaatgggcccttggtacctgctgctgctgcttgggtcactgtgtggggmctctatgtgg

SEQ ID NO: 2561 - DNA, 473 bp, Homo sapiens
  CDS 90..368
  misc_feature 354: n=a, g, c or t
aattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgncaatcaagaatgaataagaatgaggctatagtgatgaaagaagcaagtaggcamaaaactgtagctttaaaaaaggcatctaaagtttacaaacaaaggcttgaccattttacaggagc

SEQ ID NO: 2562 - DNA, 589 bp, Homo sapiens
  CDS 182..379
ccccggcgcgcggccccgcccaggacgaggggcggtgggcaggcagcgctgggtccagtggtcgggggaaggcgaggattaccctcccggagcgttgtctgcgactcggcggaggctccaacttccagtggcccggtcgggaaagatcagagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggagcagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgwattggccacatgcttgctgaagagacttgttttcc

SEQ ID NO: 2563 - DNA, 502 bp, Homo sapiens
  CDS 168..380
taagtgcctggtacaacaaagtaaagtgttatgagtcacgcaagtkttaagtttggtcctgggtctccttttttctatccacacttatctccctagggactcatgggagaaagaatgccttgagtaataaatttggccctcattgccatttagtggtattcaaagccatggtaatgaatgggcttaatgcaatgtcccccaggagacgtggagcaaagtccagagacatttgtgattgtcgtaattgggagatttgctattggaatctagtaggtagagaccagggatgctgctcaacatcctacaatgcacagacaacctcctctcaacaaagaaattatcttgcccaaaaggtcaatagtactgattttgagaaaccctgacttaagtatatctattgtatcagttaataattatttttctgctggcatataacagaaacttctgaaagggtggcttagacatagaaggcaattatgggttttttttttctagtaacaaa

SEQ ID NO: 2564 - DNA, 513 bp, Homo sapiens
  CDS 215..433
acaagatcatggccactaactacagtrccaaccagtatgaaaaggctttctcatccaagtatctgcagaactggtctcccactaagccaacaaaagagagcatctcttctcatgaaggctacactcaaattattgccaacgatcgtggtcatctactgccttctgtgmmccgttccaaggcaaatccttggggttccttcatgggcactggcaaatgcctctgaagataccccctgctcgggtgaccctgacctcccgtacaactgctggtgctgcctccctcaccaaatggatacagaaaaatcctgatttactcaaggcctccaatgggctgtgtcctgaaatcttaggcaagccccatgatccagacagtcagaagaaactcagaaagaagtctatcacaaagactgtacaacaagcacgaakccaaccataattccaagctccccagctgccaacctcaattccccagatgaactccaaagctcacacccctctgcaggtcatactcca

SEQ ID NO: 2565 - DNA, 593 bp, Homo sapiens
  CDS 18..272
ttaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaa

SEQ ID NO: 2566 - DNA, 510 bp, Homo sapiens
  CDS 256..429
aatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccagggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagscccttggaccatcacagatgccgagcttcgggtaactcttacggtggaggattcc

SEQ ID NO: 2567 - DNA, 361 bp, Homo sapiens
  CDS 108..266
caaaaattagccaggcgaggtggcaggcgcctgtaatcccagcttttcaggaggccaaggcaggagaattgcctgaacccaggtggcagaggttgcagtgaggcgagatgtcaccaatgcctgtcctagagcgaccactaaagaaaagaaagccaggcgcggtggctcatgcctgtaatccaaacactttgggaagccaaggtgggcagatcacgaggtcaagagatcgagatcatcctggccaacagggtgaaacctktctctactaaaaatacaaaaattaggcmtggcgcggtggctcacggctgtaatcccagcactttgggaggcggaggcgggcagatcacgaggtcaggagatc

SEQ ID NO: 2568 - DNA, 483 bp, Homo sapiens
  CDS 72..335
aggagcggccttgttcctcaagcggccgctgggggcgccagagcaggaccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggcccactggcccaccacagctgccatgccaccctctgcccgtatgaagaggtcactgggggatggagctggcacccacatgaatagctgtatgcactgtacttgtttcttaataaacttatttttaagcacaaaaaaaaaaaaaa

SEQ ID NO: 2569 - DNA, 613 bp, Homo sapiens
  CDS 326..556
agttaagaaaaactgccaggttacaggaatgtgatattgatttttgatttcttttaaattaataatcaatggcgttctgaatactgcttaatttcttatttgtagaggtacagagctgaagcctgttagatgtcgtttacggcattttccagaggcaaataatgagggctcagggataccttggtagcagctaaattactagtgaaggtttttcatgagtttaaaagtgttcttggaccttcagatatggaacctggggaccagtggggcaaagaagaattaacagcacctacatagctctgattatgtcaagcacttcgtctaaatgtttgcacagatgaactcatttaagccccagaacaactccgtgagtaaccttaacatctggacgcagacagccccagcaatcctggaggaaaccttggaaatacgcgggtcatcttctatgaagaccacagcagccctgagaaaccaatacagcgttccaatctttaaaagaagagccaaacgtcatgcctggattattccagaattttgctgctacgaacaatgctgctaagatgagtgtcttcaatcacttgcacaattgtttctctagtctataatatattct

SEQ ID NO: 2570 - DNA, 624 bp, Homo sapiens
  CDS 132..281
tgagattccttgtgtctgggagtttggacagcttcagatgtacagttacactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaa

SEQ ID NO: 2571 - DNA, 483 bp, Homo sapiens
  CDS 68..238
attggttctagactgcaaacctgtataacatgttactgtactgaatactgtagacaattgtaacacaatgataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacacccttttaagcagggtctgaaaacccttggtgttttggagaaaattcaggcttatccagaagcattttgtagcatcctgtgtcataaacctgagagtctttctgcaaaaatccttagtgagctttgtacagtacacacattacctgatgtgaaagctttggggttttggaacagttacttacaggctgttgaagatggtaaatctacaacaacaatggaagacattcttatttttgcaactggttgcagtt

SEQ ID NO: 2572 - DNA, 452 bp, Homo sapiens
  CDS 25..231
agatcaagatgcacacaccagaagatgatagagtatgacaggatccgagctacaagcaaggagcttggctgtgctcgcccactgatatcggtgtactccgaaaagggggagtcatctggcaaaaatgtcactttgcctgctgtattcaaggctcctattcgaccagatattgtgaactttgttcmaccaacttgcgcaaaaacaacagacagccctatgctgtcagtgaattagcaagtcatcagactagtgctgagtcttggggtactggcagagctgtggctcgaattcccagagttcgaggtggtgggactcaccgctctggccagggtgcttttggaaacgtatcctttgtttcactacctaagactggtcatctctgatggaatttagcggcctgggtctggtttattgatgataatacggtgtaaaaatattacttttttttgtct

SEQ ID NO: 2573 - DNA, 363 bp, Homo sapiens
  CDS 57..224
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcmaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaaatgtttg

SEQ ID NO: 2574 - DNA, 834 bp, Homo sapiens
  CDS 497..826
aaatywwaaakkwwscsggrsstrrkssmgrsmcrggwgscrstsrmrrsksygarrcmsrrgkakcmswtgmswcstgrmsswrkrkrswsywstkwkmrgyswtysyrmyrcysmwwwmcmrscyksrsrmcmmwgsgrsmcmygwsarwcwrycmryyrwtcarksrmkcmwkwksmgscwksckssmcatgctcgtgaccaccgggggcgacatagwscctaaccctaagtccaaccccaaggcagaccccaccgtcccgccagcgcactcctaagagcgcggcttccggagcaaagccgctgacccccgcccccagggtcttggcgccgattggccaacgagagcgcagggcggasaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagcwgcaggcccacgtacggggcgaagskgctgcgcggtaccactttgaggatgttggtggcgtgcagggggctagggctgtccatgtggagtctgttcagcctctcagtttggagaacctggccctgaggggcgctgtcaagaagcctgggtcctctctggcaagcagcagatagctaag

SEQ ID NO: 2575 - DNA, 530 bp, Homo sapiens
  CDS 264..422
tttctctcagctgcgccccctgacctagtagtcgctggcacaagctgcgcccggagacgtgggagcgttctcttgttttccgagtgcgcggactcatcgggtcacagtttatgcttttatgacgcgggaacacaacagatttgagaagcctcggattaaggaataatttatgaagctccgttgactaccgtggagagatcataatttggggttcaagattccagtctgtgtttttccagaggtgccctgaggagcagggaagcatggctattgtggatgtaaaagccatgttcaagatagagcgggggtccccaaaacctgggccacagaccagtactggtccttggcctgtgaggaaccaggccacacagcaggagccaggtatggtggtatgtgcctgcagtcccagctactcgggaggctgagatgggaggatccacttgagcccaggaggtcgagtccagcctggacaactatcaagaccccatctctaaaaataaataaataacattctaaaaaaaaaaaaaatg

SEQ ID NO: 2576 - DNA, 456 bp, Homo sapiens
  CDS 60..215
aaaccttagcaagatggcggctccctgggcgtccctgcgcctggtcgcccccatgtggaatgggcgtatcaggggcatccatcgcctgggtgcggcagtggccccagaggcagtcagaagaagaaaaggacaatactccagttcctgaccaactatttctacgatgtggaggctctgagggattacttgctccaaagggagatgtacaaggtgcatgagaaaaatcgatcttacacctggctggagaagcaacaggcggtcagcagctgcccttggcaccctccagccctcagaagttgcgtaggagacacagcgcctccactgaggcacctctctgggaataactttccccagcaccccaaatggatttccagtcaattcagaagcattttaccagtgaagccctcattattccagttcactgttaaagccagtaattctctatattaaactttc

SEQ ID NO: 2577 - DNA, 534 bp, Homo sapiens
  CDS 57..212
tttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgscccggcattcaatattgtatggktcattaggatctgttgtggctggctttggacattttttgttcactagtagaattagaagatcatgtgatgttggagtaggagggtttatcttggttactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccac

SEQ ID NO: 2578 - DNA, 534 bp, Homo sapiens
  CDS 57..212
tttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgscccggcattcaatattgtatggttcattaggatctgttgtggctggctttggacattttttgktcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagccaaaaaaaaaaaaa

SEQ ID NO: 2579 - DNA, 556 bp, Homo sapiens
  CDS 91..246
ctacttccgggggagcggcgcgacggcgcgggagttggttctaaagagtggtgagtcagaagagacgtcaggcagcaagcgacttgggccatggcctctgacctagacttctcacctccggaggtgcccgagcccactttscctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgagggaggctgtgacgccctatgaccgcagagatctagacagtcgtaacagtccccaggctcbagctgggcaatccaccacttcctcttccttctgcttctgtgacg

SEQ ID NO: 2580 - DNA, 622 bp, Homo sapiens
  CDS 210..392
gaactacttccgggggagcggcgcggcggcggggaggatctctcaccccatcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggagtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgkgcagggagagggtcttkggggacagcctcctgggaatctacattgtgtttcccccgcattyccaggctcaggttctgargargctgtgacgccctatgaccgcagagatctagacagtcgtaacagtccc

SEQ ID NO: 2581 - DNA, 463 bp, Homo sapiens
  CDS 110..328
agtagttgatgtgtaaagagatatccaagtggagatgccaaagtaagagatgtagacctgtggctcacaagagaaggaagaggtcattgagatctgatattcctctttaatggcgtataagttacctgtggaggatgtccaccctctatctcggccctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgaaaaaaaaa

SEQ ID NO: 2582 - DNA, 450 bp, Homo sapiens
  CDS 69..308
attctacaaatgtcaaggatgaaacaaaagctcatgtagttgatgtgtaaagagatatccaagtggagatgccaaaatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgaaaaaaaaaaaaaaat

(The sequence listing continues in the following parts.)

What is claimed is:

1. An isolated, purified, or recombinant polynucleotide encoding a signal peptide, wherein:
    a) the polynucleotide encodes a signal peptide consisting of residues −102 to −1 of SEQ ID NO: 3986; and
    b) wherein said signal peptide directs the secretion of a polypeptide when located at the amino terminus of a polypeptide.

2. The isolated, purified, or recombinant polynucleotide of claim 1, wherein:
    said polynucleotide consists of nucleotides 144 to 449 of SEQ ID NO: 126.

3. An isolated, purified, or recombinant polynucleotide encoding a signal peptide, wherein:
    a) said polynucleotide, consists of a nucleic acid sequence having at least 90% homology to the polynucleotide of claim 2; and
    b) said polynucleotide, encodes a signal peptide that directs the secretion of a polypeptide when located at the amino terminus of a polypeptide.

4. The isolated, purified or recombinant polynucleotide according to claim 1, further comprising a nucleic acid sequence fused in frame to the polynucleotide of claim 1 and wherein the nucleic acid sequence encodes a heterologous polypeptide.

5. The isolated, purified or recombinant polynucleotide according to 2, further comprising a nucleic acid sequence fused in frame to the polynucleotide of claim 2 and wherein the nucleic acid sequence encodes a heterologous polypeptide.

6. The isolated, purified, or recombinant polynucleotide according to 3, further comprising a nucleic acid sequence fused in frame to the polynucleotide of claim 3 and wherein the nucleic acid sequence encodes a heterologous polypeptide.

7. A vector comprising a polynucleotide selected from the group consisting of the polynucleotides set forth in claim 1, 2, 3, 4, 5, or 6.

8. The vector according to claim 7, wherein the vector comprises a polynucleotide according to claim 1.

9. The vector according to claim 7, wherein the vector comprises a polynucleotide according to claim 2.

10. The vector according to claim 7, wherein the vector comprises a polynucleotide according to claim 3.

11. The vector according to claim 7, wherein the vector comprises a polynucleotide according to claim 4.

12. The vector according to claim 7, wherein the vector comprises a polynucleotide according to claim 5.

13. The vector according to claim 7, wherein the vector comprises a polynucleotide according to claim 6.

14. A host cell comprising a vector selected from the group consisting of vectors set forth in claim 8, 9, 10, 11, 12, or 13.

15. The host cell according to claim 14, wherein the vector comprises a polynucleotide according to claim 8.

16. The host cell according to claim 14, wherein the vector comprises a polynucleotide according to claim 9.

17. The host cell according to claim 14, wherein the vector comprises a polynucleotide according to claim 10.

18. The host cell according to claim 14, wherein the vector comprises a polynucleotide according to claim 11.

19. The host cell according to claim 14, wherein the vector comprises a polynucleotide according to claim 12.

20. The host cell according to claim 14, wherein the vector comprises a polynucleotide according to claim 13.

* * * * *

UNITED STATES PATENT AND TRADEMARK OFFICE
CERTIFICATE OF CORRECTION

PATENT NO. : 6,639,063 B1
DATED : October 28, 2003
INVENTOR(S) : Jean-Baptiste Dumas Milne Edwards, Severin Jobert, Jean-Yves Giordano It is certified that error appears in the above-identified patent and that said Letters Patent is hereby corrected as shown below:

Title page,
Item [57], ABSTRACT,
Line 10, "ESTs." should read -- 5' ESTs. --.

Column 2,
Line 5, "CDNA" should read -- cDNA --.

Column 6,
Line 36, "RNA/NA" should read -- RNA/DNA --.

Column 8,
Line 21, "CDNA" should read -- cDNA --.

Column 18,
Line 46, "12, 15, 18, 90, 23" should read -- 12, 15, 18, 20, 23 --.

Column 26,
Line 54, "1000V" should read -- 10000V --.

Column 27,
Line 34, "5ESTs" should read -- 5' ESTs --.

Column 51,
Line 8, "*FEBS Left.*," should read -- *FEBS* Lett., --.

Column 56,
Line 43, "Cytokine Cell" should read -- Cytokine, Cell --.

Column 65,
Line 25, "inhibin a" should read -- inhibin α --.
Line 53, "chemoatactic/chemokinetic" should read -- chemotactic/chemokinetic --.
Lines 57-58, "mast cells eosinophils" should read -- mast cells, eosinophils --.
Line 61, "proteins of" should read -- proteins or --.

Column 77,
Line 25, "60(7):3170-3179;" should read -- 160(7):3170-3179; --.

Column 79,
Line 37, "position EST-related" should read -- positional segments of EST-related --.

UNITED STATES PATENT AND TRADEMARK OFFICE
CERTIFICATE OF CORRECTION

PATENT NO. : 6,639,063 B1
DATED : October 28, 2003
INVENTOR(S) : Jean-Baptiste Dumas Milne Edwards, Severin Jobert, Jean-Yves Giordano It is certified that error appears in the above-identified patent and that said Letters Patent is hereby corrected as shown below:

Column 80,
Line 49, "Nucleic Acids Positional" should read -- nucleic acids, positional --.

Column 84,
Line 16, "Nucleic Acids Positional" should read -- nucleic acids, positional --.

Column 87,
Line 2, "Nucleic Acids Positional" should read -- nucleic acids, positional --.
Line 49, "Nucleic Acids Positional" should read -- nucleic acids, positional --.

Column 94,
Line 61, "Triton X1100" should read -- Triton X-100 --.

Column 95,
Line 24, "Nucleic Acids Positional" should read -- nucleic acids, positional --.

Column 97,
Line 58, "p13H2" should read -- P13H2 --.

Column 101,
Line 65, "$1 \times 10^4 M$" should read -- $1 \times 10^{-4} M$ --.

Column 102,
Lines 41-42, "ligonucleotides" should read -- oligonucleotides --.

Column 107,
Line 1, "components 105" should read -- components 110 --.
Line 13, "device 18" should read -- device 118 --.
Line 14, "devices 101" should read -- devices 110 --.

UNITED STATES PATENT AND TRADEMARK OFFICE
CERTIFICATE OF CORRECTION

PATENT NO. : 6,639,063 B1
DATED : October 28, 2003
INVENTOR(S) : Jean-Baptiste Dumas Milne Edwards, Severin Jobert, Jean-Yves Giordano It is certified that error appears in the above-identified patent and that said Letters Patent is hereby corrected as shown below:

<u>Column 110,</u>
Line 64, "feature+s" should read -- feature's --.

Signed and Sealed this

First Day of June, 2004

JON W. DUDAS
*Acting Director of the United States Patent and Trademark Office*